United States Patent 7,892,730 (COMPOSITIONS AND METHODS FOR CANCER) - sequence listing, part 12

SEQ ID NO: 1175 - DNA, 1706 bp, Homo sapiens
cctctgagcccagccctccctagcatcaccacttccatcccattcctcagccaagagccaggaatcctgattccagatcccacgcttccctgcctccctcaggtcccagctcttgctcctgcctgtttgcctggaaatggccacgcttctccttctccttggggtgctggtggtaagcccagacgctctggggagcacaacagcagtgcagacacccacctccggagagcctttggtctctactagcgagcccctgagctcaaagatgtacaccacttcaataacaagtgaccctaaggccgacagcactggggaccagacctcagccctacctccctcaacttccatcaatgagggatcccctctttggacttccattggtgccagcactggttcccctttacctgagccaacaacctaccaggaagtttccatcaagatgtcatcagtgccccaggaaacccctcatgcaaccagtcatcctgctgttcccataacagcaaactctctaggatcccacaccgtgacaggtggaaccataacaacgaactctccagaaacctccagtaggaccagtggagcccctgttaccacggcagctagctctctggagacctccagaggcacctctggaccccctcttaccatggcaactgtctctctggagacttccaaaggcacctctggaccccctgttaccatggcaactgactctctggagacctccactgggaccactggaccccctgttaccatgacaactggctctctggagccctccagcggggccagtggaccccaggtctctagcgtaaaactatctacaatgatgtctccaacgacctccaccaacgcaagcactgtgcccttccggaacccagatgagaactcacgaggcatgctgccagtggctgtgcttgtggccctgctggcggtcatagtcctcgtggctctgctcctgctgtggcgccggcggcagaagcggcggactggggccctcgtgctgagcagaggcggcaagcgtaacggggtggtggacgcctgggctgggccagcccaggtccctgaggagggggccgtgacagtgaccgtgggagggtccgggggcgacaagggctctgggttccccgatggggaggggtctagccgtcggcccacgctcaccactttctttggcagacggaagtctcgccagggctccctggcgatggaggagctgaagtctgggtcaggccccagcctcaaaggggaggaggagccactggtggccagtgaggatggggctgtggacgccccagctcctgatgagcccgaagggggagacggggctgccccttaagtgtcggtgaatagtgaggctggaggccggaatctcagccagcctccagcaccttccctctcaccatcccactgccccctcgctcccatgtttccacccggcaccctgatcctcacccgaatctcctttttttttttcttttgagacagagtttcgctttgtcgcccaggctggagtgcaatgcacgatctcagttcactgcaacctctgcctcctaagttcaggcgattctcctgcctcagcttcccgagtaactgagattacaggcacccaccaccatgcccagctgcttttttgtatttttggtagagatggggtttcaccatgttggctaggctggtctcaaactcctgacctcaggtgatct

SEQ ID NO: 1176 - protein, 400 aa, Homo sapiens
MATLLLLLGVLVVSPDALGSTTAVQTPTSGEPLVSTSEPLSSKMYTTSITSDPKADSTGDQTSALPPSTSINEGSPLWTSIGASTGSPLPEPTTYQEVSIKMSSVPQETPHATSHPAVPITANSLGSHTVTGGTITTNSPETSSRTSGAPVTTAASSLETSRGTSGPPLTMATVSLETSKGTSGPPVTMATDSLETSTGTTGPPVTMTTGSLEPSSGASGPQVSSVKLSTMMSPTTSTNASTVPFRNPDENSRGMLPVAVLVALLAVIVLVALLLLWRRRQKRRTGALVLSRGGKRNGVVDAWAGPAQVPEEGAVTVTVGGSGGDKGSGFPDGEGSSRRPTLTTFFGRRKSRQGSLAMEELKSGSGPSLKGEEEPLVASEDGAVDAPAPDEPEGGDGAAP

SEQ ID NO: 1177 - DNA, 24291 bp, Mus musculus
  misc_feature (1)...(24291): n = A,T,C or G
gcgcacgcctttaatcccagcactttgggaggcagaggcaggcggatttctgggttcgaggccagcctggtctacaaagtgagttccaggacagccaggggtatacagagaaaccctgtctcaaaataaataaataattccaggacagccaggggtatacagagaaaccctgtctcaaaattaattaattaattaattaattaattaaataaaataaaaaataaaagaaataaatcttaaaaaaaaaaaaaaaacttgccttatatataacaacagacaccataaccaaagtaactcttgtaaggacaacatttaattgaggctggcttacaggttcagaggttcagttcattatcatcaaggcaggaacatggcagcatccaggcaggcatagtgcaggaagagctaagagttctacatctccatctgaaggcagcaagcagaatactggcttccaggcagctaggatgagggtcttaaagcccacatccacaatgacacacttcctccaataggtcacacttcctaataatgccactccctgggtcaaccatcacaacaaccatgatgaaaagagcttccccctaagtaagaggcacccctggaccttctagcaaagtagattcccatttctctgtgcttctccaaattttaacacctaaaactggtctattgcaggacctggccgctgtgtaagcaaaggagggcttggccggcgtccgcctctagctcgagtaagggtggctgtgcggctgcgcccgtttatggatggagagacagaagcgaaggagctcccctgtgtccgagccatagacagctgctctcttgaagtggctaactggaagaaataccaggagacgctcaaatatcagtaaggttcaggctgatcctccacctcggcctgcgcgtttgttactctcactgggtttctgagatctctctctctctctcaggatcctgttccttgctgtcactcaatccttcctccagttatttagatgttaatggtgtgaggtgagtgctgtggagaaagactagaagttgaacaaaggaaggaaggagcaatgtggcttcaaataagttctagaaaatacaggggaagggcaggaaagcagacctggcagtcaaccagagaagaccattcagattccggaatggcaaacaagacgggaactacacaaaagacttacacttggcctgttagtctggcctagagggctataaaccacagactgcatgcaggtcagatccaaccaaagtcttccatttggttgtttcatttttttgtttctttggattttgttcttttgaaacaaggtctcataaagtccaggctggccttgaactactgatcctcttgacttccctcctcagtgctgggatcccaggtgctgtgctgacatgcccagcacagtagacttttctgtaaataaagtttatcatttgtttacaaaacaataggtgcttaactagccttagaattaaggcatgtttacacaaaacctaaaatatttattatttgcttctttataggaagttagtttacctcagtgctaatcccttagcaattaggcttctggccctttccagctctctcttgtcagcatgcactgactcactaggccaaccttttatttaccctgttccaatgctacctcaaggaaaatactggaaagccctttcacaccatgttgtgtgggtgcttgtcacagggcaggaactaactgccaaaataacctaaataaggacaccaccaatatccaacttggtgagccaacacgttttatttggggttatttataggaatatgggtttataagcaggtaaatgacccatagacagctgtatcaccagagcccactccagctcacagagatggaatcctggagcacgtggcacagcctgcaggcaatgagcctcttccaagcagctcaactggcctctgtttctccagcctgctctgctctctgaaccctgtctgctatgtctggggaggcagttgttcacgtcaagctcaggacatacttccggagtttaggctcccctccacagagcactgcctcttgtccctgtgtcctacttggcagcacttccttctgctggcaaaatcatttattccttctaacatggtcttgcttgtctcctgaatcattgtagagtatggatatctggccaaccagattgcagtgtgagattaatttgtttccctaacatcagtacaatgactggatatggtaaaattttcagagacactttgaaggtctttgtcaaaaaaaaaaaaaaaaatgggatagagcctttaaagccagcatcatctaggtgagggtatcaataggacatcctaataacaccttttttcacctacaggtttgatgccttctatggcgagaagagcactcagcaggaagtctatgtaggttcagtacagcccatcctaaggcacttgctggaagggcagaatgccagtgtacttgcctatgggcctactggggcaggtgagagagccagacgagaactacctatgcatgaggaaaagaactaggaacattgaggggaacttcatacctttctctgctctttgcccagggaagacacacacaatgctgggcagcccagagcaacctggagtgattcctcgggctctcatggacctcctgcaactagcaagggaagagagtgctgagggacggccatgggacgtttctgttgctatgtcctatttagagatctaccaggaaaaggtaagggggcaaagtaccagggccatctagagaggacatgaagctctcctctagtaaaggtgtagtgaagcctagacaggcagggttggggtagcaagtgaaagaaccctaacagtccagtagagaaagggatcctaacccctgcttcagcaggcaccctggtcatggagaaatgggctcactgtcactgctcaaataggtattagacctcttggatcctgcatcaggagacctcgtgatccgcgaagactgccgagggaacatcctgatcccaggcctcacacagaagcccatcaccagcttctctgacttcgagcagcacttccttccagccagtagaaatcgagctgtaggagccacccggcttaaccagcgctcttcccgtagtcacgcagtgctcttggtcaaggtaaggcccgctgacagaaaggcctgggaagcccctgaaatgtggactgagtctgggtctcttgctcttcccctaggtagatcagcgtgaacgtttgactccatttcgccagcgggaaggaaaactctaccttattgatttggctggttcagaggacaaccgtcgcacaggcaaccagggcattcggctcaaagagagcggagccatcaacacctccctctttgtactgggcaaagtggtggatgcattaaaccagggcctccctcgcataccataccgggacagcaagctcactcgtctgctgcaggtcatgtctacccatgttgaatcaaaaggaacaggagaaggtggcacttaggcctgctggttagggaagcaggcattgttgtaaaggaataggagtctgacccatactctaattctcactcctcaggactctctgggaggctcagctcatagcatcctcattgccaacattgctcctgaaagacgtttttaccaggatacaatttcagcattgaacttcactgctaggtccaaggaggtgattaaccggcctttcaccaatgagagtctacagcctcatggtgaggactagggaagaggggtggaatagccaggagagttggggagtttgccaaaatcaccaagcactgatactgaagctgaccactctgattcttctatctcattaatcttcttagccttggcacctgttaagctgtctcagaaagaactgctaggcccgtcagaggcaaagaaggccaaaggccctgaagaagaatcaactgggagccctgagtctacagcagctccagcgtctgcctcccagaaactaaggtgagagtcaggccttccctacaggataagatagctggaggtaacagtggggttagcctgtcgagtctttgagcaaagggattcatcctaaactcaccaaagggccagccagattggcgctctggacgaaggcacgcttagatggggcgcatcaagcttagatcctcactttgaggattcacttttaggagatggagatcctgagtttttaaagccaggaagctcatacagaaaaccaggtgcccagcagtggtggtgcatatctttaatccagcacttgaaaggcagaggcaagtggatctcttgactttgaggccagcttcatctacaaagcaagttctagaacagctagagctacacagagaaaccctgtctctaaactgttccctaccccactccccaaaaagaatgactcgttctgtgaaagccaggaaaagttattcctactgttcactctacactttcttatgctgttctcctaaggctgggacatggagaacaggtcatggcctgtggctttgaagagctcgttcagtgtagcacagataatctcactggatgttattagaaaagtggcattttcactttgaaaaaacaattttcatcagaggtgagggtgaaggttcaaggcagattgatgtatgactgataggacttactgtgcttagatagccaggactccgctggaacaagaatcttctgtatacagcccactggataaaggcgtcttctcactttaggtctttagtaactttcctgttcacgagggcctcttttgtgacactttccctgcttgctttacaaatgtccaagccctcagctcttaccttatccctttctttgtgtttgtggtatgcatggttatgtgtgcatctgcatgtggtatgcaaggctatgtgtgcttgcatgtggtatgcatggttatgtgtgcatctgcatgtggtatgcaaggctatgtgtgcatatgcatatggatgcttgaggatgaagctgagactctgcctcagtcactcttgtaccttacacactgaggtaaggtctcaataaaacccagagcttcctgttgtggctagtatttctagcctgcttgcttgcttgcttggggcatcctgtgtctccctttgaggctagaataataggctgccacacccacttggcatttattgtgggctctaagtatccaacttccaagtcccttgtttacatggcaaagcatttaactgctgagtcatcttcccagcgcccccctccccttcttccttatcacaagtacctcttggacagggtagaattgaggtccctaatgtgtggcatccagtgcatgttagcctcttatctgatattccagtatccctgagagtttacttcacctgaaaaagacaagataactagatatcagttatcagagactaggtaactgcttaaagagtcccatcaggatcatggaacacatgcaccaagttaaggtatgacaagggttgtcctgctgctggaggtgaggagagaaaaggtaacctttttttcaactcagcctcttacagaagctaagcaatatggatccagccatgttggagaacctcctgagtatggaacgtttgctgggttcccagggaagccaagggacccccctactgaataccccaaagcgagaacgaatggtgctcatgaagacagtggaggaaaagaacttagagattgaggtaaatgttggggaaggtggctgaatattccaaccagctttaagaagcattcctagtatcttcagacaggaaaggatgcttagatgctgatctagaattcagtttccatcccgttctggacattttctgtcttctgttggaataatgtttgtttggtgtttaagatttatttttatgtatattggttttattctgacctttatgactgtgtatcacatgtgtgcaatgcctacagaggtcagaagaggttatcagatactctgggtctagagttaagagatagttatgaactgccccatattggtggaatcaaacctgggttctctggaatagtatacttagctactgagccatctctctagcccctgcttgaatgcacttaacatgactgaagcctaagaaacaactgagatcagataacagggggaagaaatccaaattagagaaatggctcagtggttaggagcccatgctgttctggcagaggacactaatccaattgccagcacccacatgaggcaacttccagcttcaggaagcaaacatctctctgaggtctttgggtatatacatagactgcacacatacacaagatagtaaatatattaccagaggctagagacatgactcagcagttaagaacactgactcaatttctagcaactacagagcagttcatgactgcctataattctatttccagaggacccatcactgtcttctgacctacaagggcaccaggcacatagcgcacagacatccatgcaggccaaacacccacacatataagtaaaaatatataacctgcctaagtaggcaggcagctctttttgtgaattcgtttggcccaatctacatagtaagttctaggccagctgtggctacatagtgagaccttatcttaaaaaaataaaaaagtaaaagaaaaaaaaatctaaggctggagagattgctcagaggttaagaatgctggttttccttacagaggtcctgagtacaggccccagcaacggcatgatgggcggttcagaaccgtctgcagtgagatctggtgcctatgcaggtataacactgtataatcaaaaaaaaaaaatctttaaaacatgaggtggtgttgcagacctttaattcgagcactctgaaggcagataggtagatctctgagtttgagtttcaccacttgccttgaaaagccaaaaaacaaacaaaaacaaaaaaccccacaaaccaaaaaacaaagcctcctcacgttgaataccttgcttaaaaggactcattctgtctttaggtagccctctgatgtagacctcccttagttattttgaattctgtctctcctcttggacctcagaactctatctgctaaccttcctaatccactgctttggggctggagctaaatcacatctcccatgattctttccgacagaggcttaagatgaagcaaaaagaactggaagccaaggtgttggcccaggaggcaccggatccaagggaaaaagagaacactcccacaattctccagccgcctgcctcttatagtggcacagtggcaaagcccctgaaaaaggctgtagtgatgcccctgcaacggagtaagtttagttccaggttccaggaagaagcagctatttcagaaaggaagagacggaaagatgctgttatcatgtcactcatcctcccactgggtctgaagaagccctagatgcttgtcctctagtattgtagacagtggggtactgactggctatggtgccactcaggagggtgaggcaggagggttactatgagttctaggttagccttatagaatgagaccctgcctcaaaaaaaaaaagtcatgttgaaaggaaggagctagggaaatagaaatgggagaagcaaatggttactaggaggggagggagggcaggaggtggcctgtgtctttgaccagttccaaattcctttcagttcagaagcagcgagagtcctcaaaccaaatccagctcctgaagaaaggccccaaaaggaaggtgagtcccaccccattttccagctgggagccttttgcataatgccttaaagatgccttatagagcttttttgagggggtgtggtgggggagtgaggtatggatgtgtctcatagaaaatatctaccactgtttcttttcttcttgatgcccctgatgccccttgtgtttggattggctgctgactggatctaatgtggcccctgccctctaagaactgtagagcctatttaggaaatggacaagtatttaagaatctctcacataaaatgaaaaatataattttctccacacaaaacattagtagaactgtccccattgtaatggcatgatgcagtttcccccgcatgggttttttgtttggtttcccttttcccccctgtactggaaattgaaccccagccctcaagcatggaaggcaagcgctctaccactgaattacacttcttcctaatcaggattgatgtgtgcgctcagtcactcactgactcttcacagcaactgagaaaggagctagcaattaaagaagcacaacaaaattagtgaccagaggggagaggccgcagagagatggactgtgcctcgtcatggcagtcacccactgcctttactggcatttctgttacctcatagctggagccatcccctgagtcagaagctgtggaaaaggatgaggactactgggaggtacagattagcccagagttactggcacatgggcgcaaaaaattattggatctgctgaatgaaggctcagctcgggaactgcgcagcctgcagcgcattggccagaagaaagcccagctcatcgtgggctggagggagctccacggccccttcagtgaggtaacaaccctggggacaggtgcagtgggggggtccccgtgctgtgtccactcccttcctagtgttgctgtcccactaggtggaggacttggaacaggtggaaggcatctctgggaagcaggtggagtctttcctgaaggtaaggccacctttgccctttctgcatggtgttcccccaccgcagcccaccttaggctgctatgctaacgcacgttcctcttctttacaggcgaatctcttgagcttggccgccagccagcacagcggtccctcttgacactaccttcttttaaaaatccttgtatagtgacgtgttgtgtaaatacagtttttattccatggttgagcctggtttttgaggatgacagggctggggtcagagtccataactaccctgggggtcaggatcaagctctgcaggacacccatgtaggcgccatctttgggaaacccccaaactaggccaagattgtaaataaaccactggaatggggaggggacggtggcctagaagaatcaaaaagctgacgcgaaagcttaagcacagcgaccgaccgttaagcgggcacgcgctccaagctagccccgccccgctgtaactccctcggcgcgctccccactctcccgctcagcaacgacgtccctgttatgtgcgcgtgcgcgcgaaataacggccgctggcggagggaagtggggggtggaatcgttcaagtgggggaagagaagccgcctagtctcccgcgcgcccaccacctgcaccatcgccagccaatcagcaaccgtcttgggggtctcgcgctcggggcgaccggggctgctgggtggctccccagtccctccgccctctagagtccctcctgtccctccccctcccgctggccccgcgcgcactcgcgctcgcgcccgctccagcctcttgtgtgtcctcgcgcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcccaacccggccggccgggggcggcgccccgagcccgggccccgcgcggcccgtgcccccggctgccgctgagctccgggggcccccactgtggccgaggccatgttccccgtgttcccttgcacgctgctggccccccccttccccgtgctgggcctggactcccggggggtgggcggcctcatgaactccttcccgccacctcagggtcacgcccagaaccccctgcaggtcggggctgagctccagtcccgcttctttgcctcccagggctgcgcccagagtccattccaggtgagtaggggccgggccgggcgggcaggcgccgaccagcgaccgcggcccacacggcgccttgtctccgcaggccgcgccggcgcccccacccacgccccaggccccggcggccgagcccctccaagtggacttgctcccggttctcgccgccgcgcaggaatcagccgcggcggcggcggctgctgcggcggctgccgctgcagtggttactgcacccccggcccctgccgccgcctccacagtggacacagcggccctgaagcagcctccggcgcctcctccgccaccccctgccgtctccgcaccagccgccgaggccgcgccccccgccgcggccgccactatcgcagcagcggctgccaccgctgtcgtcgccccaacctcgacggtcgccgtggccccagttgcatctgtcttggagaagaagacaaagagcaaggggccctacatttgcgccctgtgcgccaaggagttcaagaacggctacaacctccgaaggcacgaagccatccacacgggagccaaggctggccgggtcccttcgggtgctatgaagatgcccaccatggtgcccctgagcctcttgagtgtcccccagctgagcggggccagcgggggtgggggagaagccggggctggcggcggcacagccgcggtggcggccggtggcgttgtgaccacgactgcctctgggaagcgcatccggaagaatcacgcctgcgagatgtgcggcaaggccttccgcgacgtctaccacctgaaccgacataagctgtcgcattcggacgagaagccctaccagtgccctgtgtgccagcagcgcttcaagcgcaaggaccgcatgagttaccacgtgcgctcacatgacggcgctgtgcacaagccctacaactgctcccactgtggcaagagcttctcccggtgtgcaggggcctcgctgcccactaggccggtgggggggagggcaacaaggtggcctgtctttggctggtggggaggcggctcccgttcctggggacaggaaccactcccagggaggagggaagttgctaggaacagggggtggtactttagaagaggtgggtctctgggctgaaggaaagcagcctctgggcagaagaggaatcttggtttgagggctttcctgcctgaggactgaagctgagggggaaacgctgggacctttgcagaggcattttggaggaacctaggtagatttgaggcacaccttaccttggagcctaagccctaacacacaccccctcccacctcaacatatccctaggccggatcacctcaacagtcacgtcagacaagtgcactcaacagagcggcccttcaaatgtgaggtaggaagccagcttcctcctgtcctggttttcatgattttgatcctcattgtagctgtgtgggttcagcctctcagaccccctttttctctctctttttgcctcttcactccattttcacatttctccttcaaggcctggtcatctcacgcccatttcctacagatcaaagacccccgagactctgatccccttatcttgctcccttctctctactccccgaagctttaactctcctgtgaccccacaccctcccccagaaatgtgaggcagcttttgctacgaaggatcgcctccgagcgcacacagtccgacacgaggagaaggtgccatgtcatgtctgtggcaagatgctgagctcggcttatatttccgaccacatgaaggtgcacagccagggccctcaccatgtctgtgagctctgcaacaaaggtacatgctaaggggtgccaggagggcagggactaaaaaggggggcacagagctgttgggttttttttcaccgatgtgggtcaagggtgctgcagctaagagcttgtggcgagtagagagaactctttaaggggcaagtacaacagcattggaaacaccaccactaaattatgtgccatggttcacaggagaccgtctaccagaaattcaacctcatgggtgtgcttgggagaatgaagtgggacgtggttactttgagaaaggaatagccaaaaagccagtcccaagggtttcaacttagcagccacaagctcttgtctccagctcctggggcaggtggagtacatcagcaggggtgtgacgagcatgcaccctacccagtagcagaaagctgtttcactgtggttggtgactaaaggagctgagacgggggcactggagaggggggggacacagccgtctccactgagagtcaagcctttaaaaagctaggtagccgtgtcgtggacggtctctgtagagattaaggactaagtaagggcaccacacaaaccagtccccagcaagcgtagggaaaggctatgcttctctggagtagttggccccagcctaccaaggatgtgggaggaggacagtgccatgtgaggagggtgtccccagcctaggagaacagccctgtctctggggtctccaccaggctgaccccaaccccccatcccaacccccccccccaataggcttcaccacagcagcatacctgcgcatccacgcggtgaaggaccatgggctccaggccccgcgggctgaccgcatcctgtgtaagctgtgcagcgtgcactgcaagacccctgcccagctggccggccacatgcagacccatctggggggggccgcccctcctatcccgggagatgccccccagccacagcctacctgctgagggggacccctgcacccaccaggcaaggtgtgggacatggctggggggggcagcatgggatgtgtgggacaagggaactcaaagggcccaataggggatcgcaggaaggccagggatgccagtctgtcactcagattagggagccttgggatccagagagggcagtatggacatgctcagtctgggtaagcaggcaggccgaagcctctggggaccagataggaagtaacggctgtgtcccaggggaaatagggaaatagttgaaaagtctggggtatggaacatgtttcttgccatttaggttgtgctgtgatccttggtgtttctccctataggtactggtgaggtttgtccaatggcggcagcggcagcagcagcggcggcggcggcagcagcagtggtggcagccccccccacagctgtgggctccctctctggggcagagggggtaccagtgagctctcagccacttccctcccagccttggtgagctccaagttgatgggggagaggggagagtggaggaaagctcttcttggtacagtctcctcttcccaccaactcctcacgactcttcatcaaccaaggagcctccagacagagaggaggaagaaggaattcactaggttttaacaatgtttctcctgctcctttcttctccctatcagagctgaccctacaaacacctgtcccctgagttgtgttgaagtcccctggacaatgagcaggggtggcagaggacagcagcagccactgccctcacctttaaccccttgccttgcctcccagggatttgtgagcctttcctagaaggtcctgtgctctcctccttctgtcccctcccctactgtctgctgccccttcctggggagttggtgctttcttttttgttgttgttttttcccaggggtagggaggagagaggaggggaaagaagattctgtcccagaggagagaaaaggtggtattgaggaggggcagaagcggggaaggcagagggatacttgagtaaggttgggtggttaaaccccaagcatcctactggagtgtctgtccagggagaagccaaggggagcatcagaaggagccactggagccagaggcagaacaagagagatggaatcttagggggccagggcaaaggaggggagccagggacaagaggtgcttcctgggggtgggggaatgcagccacagtgtctcccccttccctcttccaccccagctccagccctggtctttcttcctctttcccataacagaagctatggccctggccatgtcatcgtgttcctgtgtcccttgcatgttccccaccctcccctccctccttttgcgcagaccccattacaataaattttaaataaaaacttgtctctgagttcctaagttatcttcaccaagccccctgttgtgtgtgctcatgcctcacccctcccagggagagggaggggttctttgttgaccttgatcttggtcccaacctttcctgctctgcaaagtggtagcttctctcttctgaggtacaacctctagctgcagtacaacacaaatttagggtagggccaagaatccagaagttatggagagcagattccaggtcttcagggaatacccaatctgaacaggcacagaatacccactggagattagggatgccaagctagttattgatgctgtcctgtctacaacccagcaccaggctgcacatacagatcccagggtccatggttgacacagggttcagtaagctgcattcgggtcccactgtggtggtcatggactgcttgccctggcccttcctagcttgctggaatttccatttctgggctttgctcaaacctttacaaagaccctcccttaagcttccatcacgcattgctgctgctgctttccaagagtaggaaggcttcagttctgcaggctcccttctcttgaaaccccacgcagttcccctgcagccaccccaaacttagacctgtttgcttaacccatctatgctgctcagggtgcctccacccaatcctcactggtccgtctcttcgcagacctaggtctctgccaggatcccccggtgaccgttggcgggaggggccgaggacttaggaagaagggggtgccccaccaggaggtgcgcgtgagaaaggacagggagggggcgagaaagggcagggagggggcacgagtggtccccaggccggttacccaggtaacacggggcctggcacgaggttctcttgggctatccgggaggggcaggaggcgtgctaggggcgggggcggcgcggcagcagtggagcttaggggaggggaccagagaagaagggccgagcaaacccggaggagagaggaggggagacccgccacctcccttcattgctcacagacttgttccctccccggtctgcggctgctgcagcagcagcggcggtggcggcgggacgcaggagcagtcccgaggctggcagcggatgagactgggaccaactgagactgctggtaggtgtggacgacagacagctgggtggcatgagaatgcaggtgccaggcgaactagagggtggtgctgggtgcgtcgtaccatcgggagaagatcccctccccctcagcctctgctgaaagcaacaagggaacccctaaaagaagggctaagaaggtatgcacaagatactgggtcttccccaagaatggggctggaaggaggtagacgggcatttgagcccaaatgcacagtaggaaaccctgcacttcttaggtggtgcccagagaggagggaagggtacagaaggagcagactgtgtggggtcctggtcagtctgcctgttggagtgcctgacgcatgcacagattttcatgttctggtgcgccttcgagttggaagctgagagactgggtcttgttgggtgtgttggatggatctaggaacagacccaagagcagttctgtttagaaaagggcttatcttcccatggctctccaagccgactttaaaatacttctccaccttaaagcaaaggaaatcccaacttttcctcctctccctagggacagtacaggctagccttgaaacagaatcctagccctcttgagcctgtggtgatgagagacactcttccctcctcaccaagcctgtctcctcctcttccaggatttgctactgtcactgttgtctcctcttccccacgggccctctcccatctcgcttctctaagatggcagccagcagctctcaggtctctgagatgaagggggtggaagacagttccaaaacccagacagaaggtcccaggcattctgaagaaggactaggtcctgtccaggttgtagcagagatcccagaccagccagaggcccttcagccgggcccaggcatcactgcagcccctgtggactcagggcctaaggcagagctggcaccagaaaccacagagaccccagttgaaaccccagaaacagtccaggccacagacctcagtttaaacccagaagaaggctccaaggccagccccagccccagccccagcgaggcacgccaagagccagcatccaaaccagatgtgaacagagagactgcagcagaggaagggtctgagccgcagtctacagcccctcctgagccaacctcggagcctgcttttcagataaacacccagtcagaccctcagccaacttcccagcctcctcctaaaccaccccttcaggcagagccccccacccaagaggaccctaccacagaggtcctgacagaaagtacaggggaaaaacaagaaaacggagcagtggttccccttcaggctggtgacggggaagagggcccagccccccaacctcactcaccaccctcaactaaaacacccccagccaatggggctcccccccgtgtgctgcagaaactcgttgaggaagacagaataggaagggcacacggtgggcatccaggatctcctcgaggtagcctaagccgtcatcccagctcccagctggcagggcctggggtggaagggggcgaaggcacccagaaacctcgggactatatcatccttgccatcctgtcctgcttctgccccatgtggcctgtcaacattgtggccttcgcttatgccgtcatggtgagccccaagggaccctggcccaagtgtactgtggctctcagcttcgtgccagtgtcagcccagagccccagtaatgacaccttccctcacctctctgcatggatcccacttttccaattgctggccctttgcttgtctctccccaggacctaaccttccaaggcactcctgcccgaccccttcaagcgggagggaaacagatgtgtcatataatcttactgacctgtaccctcttcctcctgcgtccccaattctccttcctttctcaaccccattgggctgaccttcctcctctggactctcacctgatccctgctgggctggctcctgctgacctgggccatgatacctccaaacccctcaccctcaccccagtcccggaacagcctgcaacagggggacgtggatggggctcaacgtctgggccgagtagccaagctcttaagcatcgtggcgctggttgggggggtcctcatcatcatcgcctcctgcgtcatcaacttaggcggtgagtgggggtcagggacaggaagggaggcgcggagggttgaccagggcagctttactaacccctgaccctgctctctcctgtctgtcctccctatgcctttgtctcttcctgtctccttccctgtctgtctttccctctcctctcccacagtgtataagtgaggggctctgccctgcattccaagacttttcttcctgttgggagctgtcttgggtccatccctgtcctgggagaatcccagtccatggccctggcccccatctctagggaccaagggagcctgagcggccttgtttacagcttctttccccctgcatcctgccaggctcctctgccagccataggcttcctttctccctgcacttttgcctgcagacccccaccccactcctgcctcttgacctccctaaccctgcactctgaaaacctctctgcacttctggaagccttcctgaacatctaaattgtactctgcacctctgcatctctcccagcctccctgcacttcttcctgcctctggaatcctctgaaccttatccctggcctcccaacgttcattgtcttggtatctaacccatcccgttctccccttccttaacaccgtttttccccttgccacgtcccctgaccctttctcccttttcatctcccccttagcgtcttcaccctcctgccaacacttagtctgcaaaaactgcagtacttaggtcaggctgagggaagaaggatggtgtggggagaggagcctagctgggggctctgactgttctctactggggaccacccaggcccagaccataccctacccctacccctaaggtgcctattgggtcccaaagctggcaagtgagtcctcacctgggggaccttctgagagtccttattctgaacatccaggggaggaaggggcatagctgcgcctgaagagtcagcctgaattgatctgcccgtttgggctttttaacctcagagtttcttgtttgaaggtctatttatgtgctttgtaaacagtagaattcaaaacaaaacaaacaaacaaaaacaggaccaaagttcccagctgcagggagcaagggaagggtgggggagctctgtaattattctctaagaggatgagggaggtttgttgcacgcgacagccctctgaggaggcagagagccagctgcgatgcatttcagagttggcggggttttttgtttgtttcctttcttttttaaaaaaaaaaaaaaaagttgggggaaaactaaaattccttttcaaaaaataaaactgagtctccctttttgtatgctgaatgctgcatgagtcttaaacactaataaacagagaatgcatgagactggcctcagttggtccctgtgtttgcagagtcaaggtactgctttctggcaggccctactgaacggaatacgcatgcgctgccgcagtggccatctttagtatgggccgaggttaatgagtcctaagggccaaattgcgcatgcgcaagtcttctctttcctcttccaagtagctttgactaccgcggagcctccgcgcgccatttctctgcgcctgcgtactgagatgctgcgcagcctgggaggcgggttttagctccaggtttgtaccgctgctgagtagacgcgaactaggtttgcccggtctaaaaagatgacttccatcccggtgatggagaaggcgatgtgaaagcgagaaaacaggcccttccctttccagctccgagcgtgtttcctgcgggtccctgggaacggcagaattctgggtccgtggggtggggtctgtccttgcaggggtttgagcgccccctcctggggacggtgctctggccgcagtcagctgttggactgactggcgatttcctagacctagaaaggctctccagcctttcgggtgaggcgcactggtttggtactctagaatctcctctattgctgggcttcttctctagtactctatgtcccttgccctgggccatggaaccattgcaggcagcacagcagcgcctctgtctgaagaaggggaagtgacttccggcctccaagctctggcggtggaggacactggaggtccctctgtctcggctagtaaggccgaggaagaggggaaaggcagtcaggaggaggccgggcgtgagggatccaggcctgaggaggcactagaagctcccagcgctgcgagcgacgagcgtgcggagggagaagccgaagactggtgcgtgccctgcagcgatgaggaggtggagctgccggccaatgggcagtcctggatgcccccaccctccgagatccagcggctctatgaactgctggctacccaaggtactctggagcttcaagcagagatcctaccccgccggccgcctaccccagaggcccagagtgaagaggagagatcagacgaggagccagaggccaaagaagaggaggaggaaaagtgaggccatgctttacacattattcccgggactgctctcctgagcacggagcctggagggaggggagagcaggaaaggatgaggcggcgggctggggtgtgccagcgggtgttagggagtgcttctctcaaccttggctttctgtccaccctgtttcaggccgcacatgcctacagaatttgactttgatgatgagccaatgacaccaaaggactcactgattgacaggagacggacaccaggtacggatgagagggaagaactgaggggaggtaaagggcctcccctagttaccccgcccacaagtgggctggtctgaggccttggctggtttcagccatcatcttgaccagcagtgggacggagcattcatacagtagcattcacacagtagcagcatagttctggcttaggtcagtgccatactttcctatcagggaccccgcagaccttcccagaagttcaaagtttgttgaacacatctctgaagtactatgttcatgcccagagctgacctgacatcccagcctgtgggccttcctagaatatgcttttagaatcattctggagctctctcgcagccggccaagccaacagcaagttgcattagctccgcttgtacagatccaccattgtcaaccagaggagtccttttaagtgaggtcccgtctttcctcagcttgtactactcccgaggattccattccagagaggaagagcatgtccacggagagtcttaagttttctggcctctacccctgccccaggacctttgcacatgatggttatgttccccagccattgcattatgggtatcttagtctaataccagccatcctgtgtgtggcccaaacctaaacattagctcctctgtgcccctgaggcctaagaagggagtatttaacaagatctctaagtgtgggcacttggagggctcacgtctcaatgctgtcatgttttctaccatcttaggaagctcagcccggagccagaaacgggaggcgcgtctggataaggtcctctcagacatgaagcgccataagaaactagaggagcaaatcctccggaccgggagagacctcttcagcttagactcagagggccccagccccaccagccctccactccgatcctcaggaaacagtctctttcccagacagcggaagtactgactggtgctgctcctgcctacaggtgcagactgttttgtgctgggcatggccagcctttcccaacccaggctctggggaacttgtaatggggaaggcctcaggctcccagcgcagtgcctctcaggagagtgcctgtgtgttctgtttagtgtctgttcgcagttttgagctggatgtgctaaatctaataaaagatgcccgatgagttgggcgtggtggcgcacgcctttaatcccagcactcaggaggcagaggcaggcggatttctgagttcgaggccagcctggtttacagagtgagctccaggacagccagggctacacagaaaccctgtctcgaaaaaccaaaaaaaaaaaaagatgccgggtgatcttctcagaggagagactgcagctcaacccaagcacgcattctcacttgggcagaggcagagctgtgttcctccacactgtaatattgaagccagaagaggcagagggctcagccagccaccatcccccacccccacccttactgctgcatcctctgatttcctagtctcggtccagacccgccagttagcactgattcagaaactgcccccagctgtggtgacttcagtgcagcctggaggagcaaaagatccagttgcagggccctttaaatacacaagctccgcccctgcctgcccagcccattagggaagtcatcccaagtgttggtgagggaaattcctgacctgtggcctgcagcagccagctaccctgctaaatgtgagtacggatcttgtgaccgtggcgggacccccaagactccaacccgggagtagatgtctgtcccacaggctctctctagtctgactgctttcctgcgacgtttcttctggggcagtgacgtctcagcagttacaggaaggagggcgtgggcagctctgccttgtgaggtttcactttctaagactttcagggttcgaaagcaccctgttaatgtcctcggcccccaaaacctcaggcgtccctgacatagggtctccctcacaggagatgggcggtaaggggacttttgtcaggcccagtagcacacatgtgccactccctactcagaaacctgaagcaggaagggtgccttgcacttagcaggagagaccccatcatttctgtttctcttgtttggttggttgactttaggttttgttttgggggtggtggttgttgttgagaaagggtcctcctcagccgggcgtggtggcgcacgcctttaatcccagcacttcggaggcagaggcaggtggatttctgagtttgaggccagcctggtctacagagtgagttccaggacagccagggctacacagagaaaccctgtctcgaaaaaaagagaagggggggtcctcctcattttttctaagtggtcttgaactctctgtgtagctcaggatgaccttgaacatctaaccttcttgcccccacctcctgagtgagtgctaacattatagatttctgtcatgaatatcagttttattcagagctggggctcgaacctaggatttcatgcatttgggacaaggactctacaacctgatgggtagagtgtgactcggtggcacagcatacttacatgtaatcccagcacttgggcagctgaggcaggagggtctccagaggcttggggccagcctgagatatagttccaccacagcctaagctaccgtgtaagaccctgtcacaaataacagaagccaactgggcaaagttacagcttccactcagactccattgctggcttttcccttctgccgtcactccagaggatccgggctctaccttctctgagtgactggcatgtgtgacttcacctccttgattcccttctccactggtcgtggaggctttttcctgctgccctgggcagggctgtgcgaaccatgggccttggccatcttttcggtggtgagcgggacgatcacaagagtagcttggtttccaggaggtgcagatttaatgagaacgagaggaaagctttaggggaagaaacaggaggaagctcaatggacagccggcctgagggtctggggacttgggattggtgactattgcccagctctcgtgggagatggtggttgacaaagctgttccttctgccctgcctgcctgtggctccctgggacatgaaaaagaggctggccatcacaggatatacctttggcacacaggatatctatccccaccctgaggtggggcacctgggcaggacagctaccacctttgccatcctgggcgctcgatgctcaggcctgctgtggtatcccacactcttctcgtgtagccaagacttcgctggctccgcgtatggaaaatgctcgcctttgaaaagccatttcagctgggcatggtggtgcacgcctttaatcccagcacttgggaggcagaggcaggcagatttctgagttcgaggccagagtgagttccaggacagccagggctacacagagaaaccctgtcttgaaaaaaaacaaaaaagaaaaataaaagccatttcctggacagcaacaaaccggaacaggtcctctgtgtccccttcagtgagactggctgacaacctggtgctgacaagccatactgtctccaggaacgccagggaaacctggccaaccatccaggaccaagccgtatggctgggctaggtcttgacctcaaaggctagaatgagtcatcagaaggcattggacgtagggtgggcgattcctggaatccttgattctgtgaatctggagtaaggcctgagaaaagtgtgacgaggactcaatgttagtcagaagccaggtgtggaagcatggcaattgttttatccccagagtttcaggccagcctaaacaacacaataaaactcttcttgacacaagctggagagatggctcagtgagtaagagcactgactgctcttccagaggtcctgagttccattcccagcaaccacatggtggctcacaaccatgtgtaatggagtctgatgtcctcttctgatgtgtctgaagacagctaactacttacataaagaaaagtttaaaaaaaaagaaaaatcccagtcaggtctcgtttaggagagaaaaccttaatggagatcagggctcctgagtcagtctaattctagtctgcacactct

SEQ ID NO: 1178 - DNA, 2129 bp, Mus musculus
atgttccccgtgttcccttgcacgctgctggccccccccttccccgtgctgggcctggactcccgggggggtcacgcccagaaccccctgcaggtcggggctgagctccagtcccgcttctttgcctcccagggctgcgcccagagtccattccagaagaagacaaagagcaaggggccctacatttgcgccctgtgcgccaaggagttcaagaacggctacaacctccgaaggcacgaagccatccacacgggagccaaggctggccgggtcccttcgggtgctatgaagatgcccaccatggtgcccctgagcctcttgagtgtcccccagctgagcggggccagcgggggtgggggagaagccggggctggcggcggcacagccgcggtggcggccggtggcgttgtgaccacgactgcctctgggaagcgcatccggaagaatcacgcctgcgagatgtgcggcaaggccttccgcgacgtctaccacctgaaccgacataagctgtcgcattcggacgagaagccctaccagtgccctgtgtgccagcagcgcttcaagcgcaaggaccgcatgagttaccacgtgcgctcacatgacggcgctgtgcacaagccctacaactgctcccactgtggcaagagcttctcccggtgtgcaggggcctcgctgcccactaggccgaaatgtgaggcagcttttgctacgaaggatcgcctccgagcgcacacagtccgacacgaggagaaggtgccatgtcatgtctgtggcaagatgctgagctcggcttatatttccgaccacatgaaggtgcacagccagggccctcaccatgtctgtgagctctgcaacaaaggcttcaccacagcagcatacctgcgcatccacgcggtgaaggaccatgggctccaggccccgcgggctgaccgcatcctgtgtaagctgtgcagcgtgcactgcaagacccctgcccagctggccggccacatgcagacccatctggggggggccgcccctcctatcccgggagatgccccccagccacagcctacctgctgagggggacccctgcacccaccaggcaaggtactggtgaggtttgtccaatggcggcagcggcagcagcagcggcggcggcggcagcagcagtggtggcagccccccccacagctgtgggctccctctctggggcagagggggtaccagtgagctctcagccacttccctcccagccttggtgagctccaagttgatgggggagaggggagagtggaggaaagctcttcttggtacagtctcctcttcccaccaactcctcacgactcttcatcaaccaaggagcctccagacagagaggaggaagaaggaattcactaggttttaacaatgtttctcctgctcctttcttctccctatcagagctgaccctacaaacacctgtcccctgagttgtgttgaagtcccctggacaatgagcaggggtggcagaggacagcagcagccactgccctcacctttaaccccttgccttgcctcccagggatttgtgagcctttcctagaaggtcctgtgctctcctccttctgtcccctcccctactgtctgctgccccttcctggggagttggtgctttcttttttgttgttgttttttcccaggggtagggaggagagaggaggggaaagaagattctgtcccagaggagagaaaaggtggtattgaggaggggcagaagcggggaaggcagagggatacttgagtaaggttgggtggttaaaccccaagcatcctactggagtgtctgtccagggagaagccaaggggagcatcagaaggagccactggagccagaggcagaacaagagagatggaatcttagggggccagggcaaaggaggggagccagggacaagaggtgcttcctgggggtgggggaatgcagccacagtgtctcccccttccctcttccaccccagctccagccctggtctttcttcctctttcccataacagaagctatggccctggccatgtcatcgtgttcctgtgtcccttgcatgttccccaccctcccctccctccttttgcgcagaccccattacaataaattttaaataaaaacttgt

SEQ ID NO: 1179 - protein, 353 aa, Mus musculus
MFPVFPCTLLAPPFPVLGLDSRGGHAQNPLQVGAELQSRFFASQGCAQSPFQKKTKSKGPYICALCAKEFKNGYNLRRHEAIHTGAKAGRVPSGAMKMPTMVPLSLLSVPQLSGASGGGGEAGAGGGTAAVAAGGVVTTTASGKRIRKNHACEMCGKAFRDVYHLNRHKLSHSDEKPYQCPVCQQRFKRKDRMSYHVRSHDGAVHKPYNCSHCGKSFSRCAGASLPTRPKCEAAFATKDRLRAHTVRHEEKVPCHVCGKMLSSAYISDHMKVHSQGPHHVCELCNKGFTTAAYLRIHAVKDHGLQAPRADRILCKLCSVHCKTPAQLAGHMQTHLGGAAPPIPGDAPQPQPTC

SEQ ID NO: 1180 - DNA, 24525 bp, Homo sapiens
tcctccaggttatttgtgtatacattacagtctgagaagcctgctatacacctgctgcacttgcttgtagagcagggaaggcactgaggccaagcttaggggtgtccacaacatgaccagggcagaatgagcttctccaacatgagctgtggcccccagcccgcccagcaaagttggtccctgcttcttctgctaccaccatacttcatgtctaaaagtgatcttctctcctccaggagctggtcgctgtcggctaagcaagattggagctactcgtcgtccacctccagctcgcgtaagggtggctgtgcgactgcggccatttgtggatggaacagcgggagcaagtgatcccccctgtgtgcggggcatggacagctgctctctagagattgctaactggaggaaccaccaggagactctcaaataccagtaaggttcaggccactcctcttccctcatgccatcacctccctctcctaggcctgcccacgttcccctgcctccccaggatccttgctccctccttagcaccgctttgttccctgagccttcactgttcacttaggaaatgttgacaggtgcccccatgatgggccctctctgggatactgtagggagagatgagaggttgaatcaaacatacattactgtgcacagagagggaggagcaatgagggtgagcaggtgagccccaagtagaggctgggggacatatcaggagggttgggggaacacagacctgccagccagcctacccaagctgcagctgggtagtgtcagagaagaccacccagatttggggacagaactcagaagggcagctactttataatcctactggggatttaaagttcaaactccttggcctgtttttctaggcgggggctggcaaaccatggcctgcaggtcaaatctgatcaggagtaagattttcagtaaataaaattttatcgtttatttacatattgtctatagctgctttctgactacagtggcagagttgagtagttgtaaaaggaacacatggcccacaaagcctaaaatatgtacaatctgcctttttacagaagtttgctagctcccatactaggccgttaacaatttgggcttcagtttctttccagcctcattccctcaatatatattaaactccctgctgtggcctaagctgcacttctccaccagaacgcagtggataggtgattggtatgtagagtctagttcagtcataagcagcatcctctattttccccattatggtgtaaaatacaatgttctacacatgtagccatttgaaaaagactgggaagccttgcttttttgctattcttgattctcagaatttctttctttggtcaaaatcttccttccttgagcagaatcagttactcctttgagagtgtgttcttatcttcgtttcctaaatcacagcaaagtgtggatatctatcctaccagactgaaaaactccaagagcagggatatcagatctatctctgtattcctaacaccaatagagagatgaggatggagtaggtgttaggtggatgctttttaaggtctttgtacaagaaaggggatagagacgttctcttaaatccaaggtccagatgagagtagaatcccttacccacccccaccccactccaccccttacacacacacacacacacacacacacacacgctaatttctttctttcttcctgcaggtttgatgccttctatggggagaggagtactcagcaggacatctatgcaggttcagtgcagcccatcctaaggcacttgctggaagggcagaatgccagtgtgcttgcctatggacccacaggagctggtgagggagccagaaaagaaacagctatgggtcagaaagggctggggaaacggagaggaaaacctcacagttttctccactctcttcccagggaagacgcacacaatgctgggcagcccagagcaacctggggtgatcccgcgggctctcatggacctcctgcagctcacaagggaggagggtgccgagggccggccatgggccctttctgtcaccatgtcttacctagagatctaccaggagaaggtgaggccccgtgctggttgggagaggagcaacaaagggtcaaagtaagacctggttctagaacatgaagctctgctgtagcagggaggtaaggtgagacctagaaagacagagactggggtagcagatggtacaactccgagaatagaacagagaaaggaaactgatccccaggaagaaacagcctctctatggagaattgcccttccccttcactgcttacacaggtattagacctcctggaccctgcttcgggagacctggtaatccgagaagactgccgggggaatatcctgattccgggtctctcccagaagcccatcagtagctttgctgattttgagcggcacttcctgccagccagtcgaaatcggactgtaggagccacccggctcaaccagcgctcctcccgcagtcatgctgtgctcctggtcaaggtgaggccgcagacaggggcgaggacctgggaagcccaggagcctgagctaagcacgagacctttgttcttacccccaggtggaccagcgggaacgtttggccccatttcgccagcgagagggaaaactctacctgattgacttggctgggtcagaggacaaccggcgcacaggcaacaagggccttcggctaaaagagagtggagccatcaacacctccctgtttgtcctgggcaaagtggtagatgcgctgaatcagggcctccctcgtgtaccttatcgggacagcaagctcactcgcctattgcaggtcaggcccacctgtctcagggaagaaggggctgcagaaggaggttctcaggcctgctgtggggtggggaatagcagttgaggcataggaaggctgggcttctgacccacccactgcctggtctcaccctcaggactctctgggtggctcagcccacagtatccttattgccaacattgcccctgagagacgcttctacctagacacagtctccgcactcaactttgctgccaggtccaaggaggtgatcaatcggccttttaccaatgagagcctgcagcctcatggtgagaactgggggaggcaggagtggaaacgctgggtctggaaattagggagtttgttgaaaccaccaagcatcagcacagaggctgaccacccccaatccctctctccaccccatcctccaatcatctagccttgggacctgttaagctgtctcagaaagaattgcttggtccaccagaggcaaagagagcccgaggccctgaggaagaggagattgggagccctgagcccatggcagctccagcctctgcctcccagaaactcaggtgagcagtggggccttgggtgtatccccttcctgatgtatggcttagcagcagagctgcaatgcccgtcagatccttgagcagagagctgtgatcttgttcctctcccattaaattcaccctaggccggatgcggtggctcactcctgtaaccccagcactttgggagactgaggttgggtggatcacctgaggtcaggagttcgagaccagcctggccaacatggtgaaacctcatctctactaaaaaatacaaaaagtagccggatgtggtggcatgtgcctgtaatcccagctacttgggaggctgaggcaggagaatcccttgaacccaggaagcagaggttgcagtgagctgagattgtggccattgcactccagcctgggcgacacagcaagactccgtctcaaagtaaataagtgaattcaaccctggctaggcacggtggctcacgcctgtaatcccagcactttgggaggccaagacgggtggatcacctgaggtcaggagttcaagaccagcctggccaacatggtgaaaccccatctctactaaaaatacaaaaattagccaggcatggtagtgggcacctgtaatcccagctactcaggaggctgaggcaggaagaattgcttgaatctgggaggtgaaagttgcagtgagccaagatcatgccactgcactccagcctaggtgacagagcaagactgcatctcaataaataaataagtaaataaataaattccccccaaattctactccattgaatcactaaagtctaagattaatctctcctcagtgctgctgccttggggacctaaggaggcctcctcctggggatcctttccattttccaacccctttagccttcagcaaaacttctcactttgggacagctgtttcaaggatgagcatttttgcttctggttcaaggagtgatctggatcagatctttcagatccatgagagcaaagcaaaggagacttggaagagctgtcctgctgagaccatctggtctgtgtgtcagtgcccagcttctccatgactctccggggagccagctgctgtcctaactgcgtctaccctcaatccagataaagcctctaaactaagtcctttgtgtcacctcctgccccaactccaatcaccccacctcatggcccagtatgtactaatcctcaggtcatctctgttcaggggtcttgctttctgtgtctggccacttagcccttgcgctattccctccaccccccaggagccagttgcagttttaactttgccctgtttctacccctagcccaaataaagcctgtgaactactaaacagaggtgacctgaggtggccaagggttagtgcccactctgtcccagggggctactgtagttaaggaagatgccacacacaagaagatgcttgtgcactcatgaccccatctctcagtcttgtctttcccaaaccatctgtcagcactccccactgctgtgtgcacccagaaatgtgcacaggtaagctgtcagacaggcactctgagtaaggggaagctcagagttgggcacatcaaacccagcagacccagagcttgggggcctcacaggagagcaagtcagatgggaacatcagtatacgataccaggtggagaattcagaatcaggaaggagtagctgctgctgctgtgagagtcaggaaggaagagatgacttctagtgtttgcccacgtatgttctgatcctgtttttccaaggcactagcatggaaagcacaggagtgtccctgtcctccaggagccagttcacagcataggaagggagatgcattgttaagcttggcgtcatgggaaaggtggcatcaaactgacctggaaagattattgatacagatgtgaggaggtgtggggcaagattccaggcaaaataaatgaatgttagacgttgctgactgggcgcagtggctcacacctgtaatcccagcactttgggaggccaaggtgggtggatcacttgagcccaggagttcaagaccagcctgggcaacatagtaagaccccatctctacaaaaaataaaaaaattagctgggcatggtggcatgcacctgtggacccagctactcaggaggctgagacagggggattgcttaagcctcaggaggccaaggctatagtgagctgtgatctcaacactgcactccagcctgggtgacagagcaagaccctgtctcaaaaaaaaaaaaaaaaaaaaaaaaagaatgttaagccttaccgtgctcagagtcagtcaggactgcttgaacaggccttcccagctgcccacagcagggaagcttggcagctgaggtcttcggtggatttcaaagccctgctaaagatggcatcctctgtgatgttttccgcaactgctcctccaaatggataggcactgtcctggctgtcaccttattatggtctcttgatttcctcagtagacagtgcctccagggcagggcagtgtcttaggtctctcatacctggcactcaagtgttcgcctgatttcctggcatccccgagcagtcacttcacctgatgaagacactgcacccagagaaactggatgcctagcaagttaacattaggttctggagctacaggatataccaagttaaggtgtggtgaggggagtcctgctgctgtaggtggtgatgagggaggaggtaggtggggagcaacttctttttctgctcagccccctacagaagctaagcagcatggacccggccatgctggagcgcctcctcagcttggaccgtctgcttgcctcccaggggagccagggggcccctctgttgagtaccccaaagcgagagcggatggtgctaatgaagacagtagaagagaaggacctagtagattgaggtacgtgttttagggatgtgggagctggattcctattggccttgagaagcaatccttggatcttcagacagggaaggacactcaggctggactagagtccagttttctcccaataccggaagttctccagcttctgcttgaatgtccttaacatggctgaactttgacagacaattgagaccagatgtgagggtgagaagaaaaagttcaaagtaaaagcaacaaatgttaaacattacatttcctaaagcccagctcaattaattgaggactgtgcttgaaaagcctttcccttcaatatttgcagaggcttgttccacctctgggtagccccctaatcacagaaagcccttaattatgttaggctccacctgtctcctggtaacctcccactggtcctagccctgccctctgggggctcagagccttgcatactcaccctggtaacccactcccttcaggctgccctggagttgggtctggatcacatctccctgatcctttccaacagaggcttaagacgaagcaaaaagaactggaggccaagatgttggcccagaaggctgaggaaaaggagaaccattgtcccacaatgctccggcccctttcacatcgcacagtcacaggggcaaagcccctgaaaaaggctgtggtgatgcccctacagctaagtaagtttgactccaggggctggggggccaaggcagctgagatcctataagggaggaagtgttaggagcagctgtctccatgtcattcatattctcccaccacataccagtcccagggaggggtgaggaggctctgaggcagtgctgggggtgctctgccctcgggtgtttaggacagtgggatggacaaacgagtagaggattgaagataatgcaagactgactgaaattcctttaaatgcgggtataaaaaaggtcatgtggaaacacaacaggttaactctggatggaggggagctggggaatcagaaatggaagaatcgaagggctaccagggagggtgaaaagtaccctttgccctgactccaattctcgattcctactttcagttcaggagcaggcagcatccccaaatgccgagatccacatcctgaagaataaaggccggaagagaaaggtgaaagtagctgggggcttaggctacacctggagcccagaagtaagggggagtaggctctagggggaggagcgttggccttggggttaaacgaactggatgatggccgccagctactaacagacctcaacttgcttacccctggaatgtggtgatggatggttccttgcagggcatttagggtggaaggcagtgatgtggatgtacctcgcagagcggatgttccactgtgtagcctggcttctaccctctacaagcttaagagggaaaacttagggaactatgacctaagcagtcaagcaagaaaccacacatatgcacatacccagaatcgaacaccactagaactacccaaaaactgagatggttgggggaggtatcatttattcatattactttctcccatgtactttttgaaagacagcttattctttcccttttagagatgagggaccagatttaagagcttattttgtgctttacattcattaactcacttgatctccacagcaactccatgagaagggtgctaatattaccactgggtactgagtagtacctctctttcactagttgcataataagaattaacccagagagtgacctgagggcgggattttggacacacttgacaagagaggaagaggctggagcgcaggaggtagctggtgctgggctcctagtcttggcagaggagcccaaagcacttggctgccctgcgtgtcactcatctccctttgcctcccagctggagtccctggatgccctagagcctgaggagaaggctgaggactgctgggagctacagatcagcccggagctactggctcatgggcgccaaaaaatactggatctgctgaacgaaggctcagcccgagatctccgcagtcttcagcgcattggcccgaagaaggcccagctaatcgtgggctggcgggagctccacggccccttcagccaggtagcagcccactggactgggggagggcgggggcgggggagaccgggtacccccgagaccctgtcccctatcgatcctgtcccgccaggtggaggacctggaacgcgtggagggcataacggggaaacagatggagtccttcctgaaggtgaagtcacggccctgcccctcctctgcctgtcctgcgccccgcgcccctctctaacgtcgctgtctccctccctcctgtgttgcaggcaaacatcctgggtctcgccgccggccagcgctgtggcgcctcctgaccgtcgtctcctcactccgccttttcaaatttttgtataaccccgtgttgtgtaaatacagtttttgctccggtgcttccgcctgatttttggggctgcgggggcgggaccggggtgtgaccgcctcggggtgggccgcgagcaaggcaggcgactccactgggcgccatcttcggggaacgactcagcgcaggattgtaaatacaccgctggggtggggcggggaggacggtggcctgcaggacgcaaaaagcggaagccgaagcatgaggcctgcgaccgttaggcgggcgcgcgctcagggattagccccgccccgtccgtgcccccggcgcgcgcgctcccccattctcccgctcggcaacgacggcggccttgtgcgcgtgcgcgcgaaataacggccgctggcggagggagggggagtggaatcgttggcggggggaagaggagagaagccgccctgtctcccgcgcgcccaccacctgcgccatcgtcagccaatcagcagccgtctcaggggtctcgcgctcggggcgactcgggctgctgggtggctcccccgtccctcctcccgccagagtccctctcgcgcctgcccctcccgctggccacgcgcgcgctcgcgctagcgctcgcgcccgctccagcctcttgtgtgtcctcgcgccccccgcccgccctccccgcgcgtagtgtgctccgcttcccccaccctccacctcccccctcctgcccgccccgcgcgcctcctcccgggttccccctcccccaccgccgccgcctcctcctcccgccccagggtgagcgcgagccacctccctccctccctccgccatggatcccagcaactggagcagcttcatcttccaggtaacaactccctccccccgcccccacccccctgcccacaccccctcctgcccgccctccctcccgtcccaccccccctccgcgcgcccggtgcgcgcgcagctgtccccctccctccctcgcgccctcccccgccctccccgaggcgccggctgggcgcgcgcgcggcgggggccgaggctgctccctcgctccccccaccccgccccggcaggctccaaccgccgccgccgccgccgccgccgcccgggcccccgcccccggccccggccccgcggggcctcccgcccccacccagggggcgtcgccgccgccgtcgccgcggcgctccgcggcccgcaaggcgccctcctttcctccctcccgccggccggggtgcgcgggcggcggggcggcccgcgggccatgcgttcggcgcggcccagcccggccggccgggggcggcgccccgagcccgggccccgcgcggcccgcgcccccggcccccgctgagccctgggggccccgctgcggccgaggccatgttcccggtgtttccttgcacgctgctggccccccccttccccgtgctgggcctggactcccggggggtgggcggcctcatgaactccttcccgccacctcagggtcacgcccagaaccccctgcaggtcggggctgagctccagtcccgcttctttgcctcccagggctgcgcccagagtccattccaggtgagtagggccggccgcggcggcccgggctggggggggacgcccgcccgcacccgcggcccactcggcgccttgtctccgcaggccgcgccggcgcccccgcccacgccccaggccccggcggccgagcccctccaggtggacttgctcccggtgctcgccgccgcccaggagtccgccgcggctgctgcggccgctgccgccgctgctgccgccgtcgctgccgcgcccccggcccctgccgccgcctctacggtggacacagcggccctgaagcagcctccggcgccccctccgccacccccgccagtgtcggcgcccgcggccgaggccgcgccccccgcctccgccgccactatcgccgcggcggcggccaccgccgtcgtagccccaacctcgacggtcgccgtggccccggtcgcgtctgccttggagaagaagacaaagagcaaggggccctacatctgcgctctgtgcgccaaggagttcaagaacggctacaatctccggaggcacgaagccatccacacgggagccaaggccggccgggtcccctcgggtgctatgaagatgccgaccatggtgcccctgagcctcctgagcgtgccccagctgagcggagccggcgggggagggggagaggcgggtgccggcggcggcgctgccgcagtggccgccggtggcgtggtgaccacgaccgcctcggggaagcgcatccggaagaaccatgcctgcgagatgtgtggcaaggccttccgcgacgtctaccacctgaaccgacacaagctgtcgcactcggacgagaagccctaccagtgcccggtgtgccagcagcgcttcaagcgcaaggaccgcatgagctaccacgtgcgctcacatgacggcgctgtgcacaagccctacaactgctcccactgtggcaagagcttctcccggtgtgcacggggcctcggccgcccgctaggccgtggggagggagggacgcgacggaggtggcctggccgtggctggcggggagggaggcggctgctgaggctggggaaggggagccactcccagggcggagggaggaagcctctcccggttaccagggagcaaggggtggtcctttgtcgaggaggtgggccttggggttgacggaagcttcgcgtgggaggaggcggcggcggcggcagcggctgctgggctccaggggagggatttcctgcttaagtgtcgctgtgacggcctgggctccgggaggaggcgcagggatcctcggaaaggcctgtggtgcggtttggtggatttggggcgcaccacctccgccctaaccccaaccccaacgtgtccccaggccggatcacctcaacagtcacgtcagacaagtgcactcaacagaacggcccttcaaatgtgaggtaggaagcccgcctcctcctgtcttggttttcatgattttgatcctcatggtagctgtctgagtcagtctctcagaccccctttttctctctcttctttttgcctttttgctccattttctcatcccttcttcaaggcctcatcatgtcactcccatttcctacagatcaaagatccccaaggctctgattcctttaatctcttgctcccccctccccagcccaccaagctttaactctcctgtgacaccccccacgcccctcccccctcctcagaaatgtgaggcagctttcgccacgaaggatcggctgcgggcgcacacagtacgacacgaggagaaagtgccatgtcacgtgtgtggcaagatgctgagctcggcttatatttcggaccacatgaaggtgcacagccagggtcctcaccatgtctgtgagctctgcaacaaaggtacatgccgagggctgccgggagggccaggggcagagggtgggcgcctggccagacgccttgccacggatacgggttaagggtgctgtagccaagagctcgtggcgtctagattcctacaagaggtcaagggagcagcggggggacacctgaatgaacatcattagactctaagaagtcctggttggaagagatgatctgccagagaggttgaacctcctggtaatgtgtggggaaagcgggagtggaacttggctgctctggggaaggagtagtcaagaaagccagttccaggggtcacaaggcaaggtttccgctgcgcagccacaaggtcttgtctccagctcctggggcaggtggagtacacgggccgggctttaccagcacgcaccctgcacgggtagcagagaaagctgccttcagtcagactcaccggttaactgggttgagaccgcggggcactggagggaaggggacacagccgtctctgctgagggtcaaccctgcaagtggctaggagtcagtgtctcgtcatcctgggagaggtctcccggccatggagaatgagttctgtaggtaccaaggctgagaagcgggcaccacacaagccaggccccaggctcagggaggggctgtgtctaccagccccaacagagcagttggccccaggctaccaaggataccgtgggaggaggacagggccatctgaggagggcatcccccgcctaggagatcagccccgtctctggggtctccgcctggctgacccccgccccatcccaatccaccccccaataggcttcaccacggcagcatacctgcgcatccacgcggtgaaggaccacgggctccaggccccgcgggctgaccgcatcctgtgcaagctgtgcagcgtgcactgcaagacccctgcccagctggccggccacatgcagacccatctggggggggccgccccccctgtcccgggagacgccccccagccacagcccacctgctgagggggacccccgcacccaccaggcaaggcgtggggcatggctggggggcgggatggggggtgtgggggacaacggggctcaaagggcccaataggggatctcaggaaggcgagggatgcccatgtaccactcaggctagggagacttctgggcacagggaggatccttgagaactgctctgtctgggtgaggatgcaggctgaggcctctggggtccagataggaagtgagcaacggctgtgtcccaggggaagcaggctgggaaggtgtggggtgagggcaaggctcttgccattcagatcgcgctgtgatccgtggtgtttctcctgtgcaggtactggtgaggtttgtccaatggcggcggcagcggcagcggcggcagcggcagcagcggcagcagtagcagcccctcccacagctgtgggctccctctcgggggcggagggggtgcctgtgagctctcagccacttccctcccaaccctggtgagctccaagttggttgcgggggagaggggagaatggagtagagtcccttggtacaagctcctctcccccctcttttcccaccaactcctatttccctaccaaccaaggagcctccagaaggaaaggaggaagaaatgttttcttaggggaattcgctaggttttaacgatttgtttctcctgctcctcttctatcagacctgaccccacacaaacctgtcccctcggttgtgttgaagtcccctggacagtgggcaggggtggcagaggacacgagcagccactgcccgtaccccctctcctctctgtaagcccatgccctgtcttcccagggacttgtgagcctcttccctcgacggtcctcttctctccttccagtcctctccccctgctgtctgcagcccctccccggggagttggtgctttcttttccttttttttttttttccagggggagggaggagaggaaggagggggatcagagctgtcccaaagagggaaagcggtgaggtttgaggaggggcagaagcagggccggcaaaggttgtaccttcataaggtggtatggggggttggggtcaggccctgaacatcgtcctacttgagaatctgtcaggggaaaaagtcaaggggagcaggaggaagagccaggagggccagaggcagagaagagatggagtcttaggggccagggtgagcgaggggtccagggcctagaggtgcttcctgggggcgggggaatgcagccagtgtccccctcccctcttccaccccagctccagccctggtcttgtcttttcatccctcttccccacgacagaagaagttgtggccctggccatgtcatcgtgttcctgtgtcccctgcatgtaccccaccctccaccccttccttttgcgcggaccccattacaataaattttaaataaaatcctgtttctggctctggattgaatgaattgccctcactaagaactgccgccaaccccaagggtttcttctcggcctggtgtccgtcaatccagccttgctctgccctgtgaggctgtgaggttctggctccgccctccccaggggcagccttactggcggcagcacagatacagggcggggccaaggctgtggctgtggagagcaagttccaggtctctggggaattcccaactcggacaggcccagaatagcccctggaggtttgaagaggccccgtcagaaacccaaacagagctgccagacgggaatgccgccctcccccgtccacactcatggccgctgctcagcccccagccgcctccctccccacgcgcgtcacggccctgaggccatggtgggtggatgcggctgcggaaaggctggggagtccgagccctaggactgggagcagcgaggtagagaatgaaagctgcacctgtccctcatcctgggcatgggccactctgtgtttacacgggctcctctgcccagctcctcctgccccttggaattccctttcctgtccccgctccgtcctttccagggccccttttttgagccttccagcgccagtttctgccgctcctttctgcaggctccattctctccaaaccccaccctgctcctcctctgcagcctccccgcgtcttgccccatcttccttgccctcctgctcgtagggacgcctccacccggtcctgcctgtctcactggtcccgtctcctcgcagaaccctctccgtttcccccaaatccccgtctcttccaggaatcccggtgaccgttggcgggaggggccggggacttaagaaggaggcgtccctcctggaggcgcgcgtgagaaggggcagggagggggcgcgagtggtccccgggccggttgcctgggtaacgcgtggctcccttgggctggcgggaggggccggaggctcgcgaggggcgggggcggcgacggcggcggagcgtaggggaggggaccggagaggaggggatgagcacacgggagaggagaagagggagacccgccgcctccctccctccctagctgacttgctccctcccgggctgcggctgctgcaaaagccagcagcggcagcgggagctgtccggaggccggcgtcgaggtgagacccgggcagactgaggctgcgggtaggagtggaccgaccgacggctgacgccgggcggactgcacgggaatgcgggtgtctggagggctggtggtggtgctgggcgggctgaaccatcgggaggaggcgccagcccaccgaaggcgagggaagccccgggagaggggctgacaggggatcgaaggagataaccaggtcccccagaaaggggcgggagcgtcctcgccctaaacgcgcagcaagaaaacccgcaccgcctgggagcccagggaggaggggaggatgcagagggagtggaatgcgaatgtcgggtcctctgcccagtcggcctgtcggagtgctatttgcacagctcgttgattttggggtgctgggatctgagagtctggatcttgttggatggacccagggagagaccctggagaaggtcctgtttacaaaagggttaatcttccccagggctctccaagcagaagactttgagtagagcactcctcccgcagggatgtcccaccctaaggcaaaggaaaccccaacttttcttcctctccctagaggcagtgcaaggctggccctgagacaggaatgtggcccaattgggcctgcagtgctgagcgccctcttccctcctcaccccaagcctatctcctcctcttccagggtttgccgctgtctctgctattccatcctccccataggggctctctcccctctcccatctcaagatggcagccagcagctctgagatctctgagatgaagggggttgaggagagtcccaaggttccaggcgaagggcctggccattctgaagctgaaactggccctccccaggtcctagcaggggtaccagaccagccagaggccccgcagccaggtccaaacaccactgcggcccctgtggactcagggcccaaggctgggctggctccagaaaccacagagaccccggctggggcctcagaaacagcccaggccacagacctcagcttaagcccaggaggggaatcaaaggccaactgcagccccgaagacccatgccaagaaacagtgtccaaaccagaagtgagcaaagaggccactgcagaccaggggtccaggctggagtctgcagccccacctgaaccagccccagagcctgctccccaaccagacccccggccagattcccagcctacccccaagccagcccttcaaccagagctccctacccaggaggaccccacccctgagattctgtctgagagtgtaggggaaaagcaagagaatggggcagtggtgcccctgcaggctggtgatggggaagagggcccagcccctgagcctcactcaccaccctcaaaaaaatcccccccagccaatggggcccccccccgagtgctgcagcagctggttgaggaggatcgaatgagaagggcacacagtgggcatccaggatctccccgaggtagcctgagccgccaccccagctcccagctggcaggtcctggggtggaggggggtgaaggcacccagaaacctcgggactacatcatccttgccatcctgtcctgcttctgccccatgtggcctgtcaacatcgtggccttcgcttatgctgtcatggtgagccccatgggaccctagcccaggcctgctgtggctcccagcttcccgccagcgctgcaatagagcctctggagtaatcatgccttccttcccctctcctctctgcatggatcccacctccccaattccagggcctttgtttgcctctccctaggacctaaccctctgagccaccactgccctgcccctttgggtgggagggatatggaaacacgtgtcacacagcctcgctgacctgtgccctcctccccctgccccttcactcctccttcctcccttacccgccatctatggggctggcctctctctcttctggatgacttttccacctgatcccttctgggctggcttctcctgaccccggctatgtgcctccacccctcgccctaaccccagtcccggaacagcctgcagcagggggacgtggacggggcccagcgtctgggccgggtagccaagctcttaagcatcgtggcgctggtggggggagtcctcatcatcatcgcctcctgcgtcatcaacttaggcggtgagtgggggcttgggacaggcaggggaggaatggaagggttggcaagggcagctttactaacccctgcccctgctctctcctgtctgtcctccttacctctcctttgtctctccttgtctccccctccccccgtctgtccttccctctcctctcccacagtgtataagtgaggggctctgccccgcatcccaagacttttcttcctgttgggagctgccttgggcccatccctcccctggggggagcccaactgatggccctggcccccacccctaaggaccaagggagcctgagcggccttgtttacagcttctgtcctgctcctgcatcttgccaggctcctctgccaactgtaggcctgcctcatccctgcactggttccaacctccctgcactaatgcctgcatcccctccggcctcttggccccctatccctgcacttctggaaacctccctgcactctggaaacctccctgaacacctccccaactctgcgctctcagcctccctgcatctctcctggcctccctgcacttcttccagccccccaaattctctggacctccaccctggcctcctcctcccaactttcattgtcttggcatctctcaaccctcagtcctctcttccttcccttctttatcatctcccctttcctctccacgtcccgcccccttcctcttcctgcctcctcatctcccttaagcatcctcttctccaacctcccgtcaccgtttactctgcaaaattgacagcacttagacgaggcttgggggcagggagcagtgttgggagagggctccccaaccccaggctcggactgttctctgctgggaccacccagggtcggacacccaagggtgcctggcaggtcgcagagttggcaagccgggcctcgtatggggactcgggtgagggtggcgagtactggttccgaacgcacgcaggggagaagggagggacgcggcgctgacccttccaggtcagctggagttgacccgcccacctgggcttttcaaccccagtccgcgagtttctttcttgaaggtgtgggggctagattcattcacgtgcttcgtaatgaaataatccaaaaaataggaccaaagcgcccactggcaggagcgagggcggggcgccgcgctctataattattttctaagatgatgggggaggtttgttgcacgcgacagcccgctgaggaggcggggaccgagctacaacgcggttcggatttggcgggggtttttttccttaaaaaaaaaaaaaaaaaaaaaaaaaaagtctgggggaagaaaaaaactaaaattcttaaaaaaaaaaaaaaaaggctattatcaaactgatttctccctttttgtatgccggatgctgcatgagtctgaaacaccaataaacggagactgcatgagactcgcctccaatctcggttggttcctgcgttcgtcccgccggcccggcggtgctgcctttctggcagaaccttactgggtggtatacgcatgcgacttcccggtggccatctttactgtgggctgaagcctgtgcgcttactcgcgcatgtgcaagccttccctcgctttcctcttccaagtagccttgcctagagcggagcctcccgcgccatttctgtgcgcctgcgtagcgtgaccctgcgcagcctgggaggcgggtcttagctccaggtgcgtacggcatctgacttgacgtggcccacaactgaaaggtctggggagaaggcgccgtgtccgggtgtggagaggggcgtcgtggaagcgagaagagtggcccgtccctctcctccccctttccctctttcggaaagtggtttctgcggggcccgggagcctcggagtaccgaacctcgatctccggggcggggtccttggtggggactgagcgccccctcccggggacgggcggtctggccgcggagtcccctgcgggagcgtgattggctggaaacggtcccgaacccccaggggagcccgatccctgggggaccctggcttcggactccagtatctgtcgtcgcagggtccctgccctagtggcctatgtcccttgctcggggccatggagacactgcggccagtacggcggcgcctctgtctgaagaaggggaagtgacctccggcctccaggctctggccgtggaggataccggaggcccctctgcctcggccggtaaggccgaggacgagggggaaggaggccgagaggagaccgagcgtgaggggtccgggggcgaggaggcgcagggagaagtccccagcgctgggggagaagagcctgccgaggaggactccgaggactggtgcgtgccctgcagcgacgaggaggtggagctgcctgcggatgggcagccctggatgcccccgccctccgaaatccagcggctctatgaactgctggctgcccacggtactctggagctgcaagccgagatcctgccccgccggcctcccacgccggaggcccagagcgaagaggagagatccgatgaggagccggaggccaaagaagaggaagaggaaaagtaaaggcacacccttacaccttgtcccggggctgctcccctgatggcgggaggaaatagggaggggaaaatgtgggacgctggaacctttgaaagtggagggagggaagccagcgggggaggaggaacgggcaggggagaagcacacgtgtgggtgggagggaggaccgccctcacccttaactatgttcacctgtcccagaccacacatgcccacggaatttgattttgatgatgagccagtgacaccaaaggactccctgattgaccggagacgcaccccaggtacaaacgaagaggaaacagttgggggaggtgaagggcctcggctcagttacccaagatcggctcccctagaggcctttgcttgctgcctcagctcccacacaacttacagctgcaggagagagtattcacccagtagcaccatctttatgacttagattactaccttgtcttccttttttttttttttttttttttgagatggagtcttgcccttgtcccccaggctggagtgcaatggcacgatctcaactcactgcaacctccgcctcctgggttcaagcaattctcctgcctcagcctcccaagtagctgggattacagacgcatgccaccactctgggccaatttttgtatttttagtagagacaggctttcaccatgttggccaggctggtcttgaattcctgaccttgtgatccgcccacctcagcctcccaaagtgctaggattgcaggcatgagccaatgcgcctggccccttgtcttcctttaagagacaattataatacaaaaaattagccgggcatagtggcgggcacctgtagtcccagctactcaggaggctgaggcaggagaatcgcttgagcctgggaggtggaggttgcagtgacctgagatcacaccactgcactccagcctgggcgagagagtgagactccgtctcaaaaaacacaattacagataattctttttttaaaaaaacaactagtcattgattctggaaaattacagataattctatcatgtttcccattcccagaagtccaagtcctggcctttcaatattatctagatctgcatccctctactaccatgtacattctttaatcacaccgctggccccatttcccaccccacatgccttcctagaatttaccctcagagtcatgcctttccttttttcttttttttgaggggtggagagacagagtcttgctgtgttgcccagactggttggtctcgaactcttgagctcaagtgatccatccgcctcggttctcaaagtgctgagattacaggcatgagtcactgcacccagcctagagccattcttgatttctctctcttttacctgaacattcacaccagcagcaagtcttggtagctataagatgtacatttccaagtacctctgctagtctccactttcaataccacatccccatccaagccactgtctttcttgcctggatagttgtagtagctcctaactgggctctctgcttccagtttctgcaattcagatgaaccttttaaaacataaatcatatcactttttttttctttgagacgaagtctttctcttgctcaggctggagtgcagtggcatgatcttggctcactgcaatctccacctcctgggttgaagcgattctcctacctcagtctcctgagtagctgggattacaaggacacgtcaccacgcctagctaatttttgtattttctagtagagagggggtttcgccatgttggcgaggctggtcttgaactcctgacctaaagcttcccaaagtgcctgcctcagcttcccaaagtgctggaattacaggcgtgagctgctgcactcagccataaatcgtgtcacttttccacttaaaattttccaagggattccatcttgccagggaagagcatgtcaaaggagaatccaagcgcttttcccgccacctccagttctctgcactcttttttttgtttttgtttttggcgagtaggggagacggagtgtagctgtgtcaccgaggctggagtgcagtagtgcgatcttggctcattgcaacctccacctcccgggttcaagcgattctcctgcctcagcctcccaagtagctgggattacaggcgcccaccaccacgcccagctaattttttgtgttggccaggctggtctcaaactcctgacctcgtgagttgcccacctcagcctcccaaagtgctggcattacaagcgtgaaccaccatgcccggcctgcactcttctttgaacagaactctgttcttgtcctggggcctctacccttgccattcccctgcccagtatgttcctccctgttcttcacattacctgtgccttcctgtcaatcaagatctttgcttctcaccctctctgaggtccaaccctgaacctcaggtcctccaagacagaggcctggggacctgcatgtttaaccagctccccaagtgatgagtgaggtccaggcaggtatggtgtacaccacctccatcccttccatgtatcttaccttcctcttctccaggaagctcagcccggagccagaaacgggaggcccgcctggacaaggtgctgtcggacatgaagagacacaagaagctggaggagcagatccttcgtaccgggagggacctcttcagcctggactcggaggaccccagccccgccagccccccactccgatcctccgggagtagtctcttccctcggcagcggaaatactgattcccactgctcctgcctctagggtgcagtgtccgtacctgctggagcctgggccctccttccccagcccagacattgagaaacttgggaagaagagagaaacctcaagctcccaaacagcacgttgcgggaaagaggaagagagagtgtgagtgtgtgtgtgtgttttttctattgaacacctgtagagtgtgtgtgtgtgttttctattgaacacctatagagagagtgtgtgtgttttctattgaacatctatatagagagagtgtgtgagtgtgtgttttctattgaacacctattcagagacctggactgaattttctgagtctgaaataaaagatgcagagctatcatctcttaaaaggaggggctgtagctgtagctcaacagttaggccccacttgaagggagaggcagaattgtactcacccagattggaaaatgaaagccagatgggtagaggtgccctcagttagcacctgtcccatctcgggccctccaactcctcccagtcccactccagtgcagccagctggctccaaggtagaaacccatgagcactcagggagcagtgtgccttcagctgcagcagaagcagcccggaggataaaatgagaaccagctgcacacgggccctttaactcccaagccccacccctgggcttggcctgccttgccctgccgggaagtgatccccaaggcagggtgagagttccccatctgaggcgtttgttgcagctacctgcacttctagatgtgagtacattgtactagccccccaaaccccaaatcaggggcagatctttgtatcccttgaggctctctttagtcctgtcttgctttgaagggccttgcttctgctggggcagggaaaacatgtctgaatcagagtggggaaggaggatgggtggtggctttgcttttggaggtttcactttccaatagttgggagtcttctgggttttgaagtaaaggcagattaacaccaacaccggtcccccacccccctgcaactctcaggcctctctctgacttcagggtcccacctgggaaatcaggtggggaaccttacagggtcattcagaccccatcttagccctagatcggtgcttgctctactcacctgcactgtcctggggacctgggctctggcctgtcaccttgagctccaagaatgtgacctgtacccattcaggccccttaactctgacagatgagggtttcttactcctccatgcagggctgggccagctgttggtctcagtcgatcattcaggaagtcattagcagagtgatttccagaaggcgtagaatttagtgaccaaggttctttcctttttgggaggagaaagtgaaaactaggatgctcagctggacccaccagcctgagattctggggattttagagctgtcccttggggagccaagca

SEQ ID NO: 1181 - DNA, 2429 bp, Homo sapiens
cggcccccgctgagccctgggggccccgctgcggccgaggccatgttcccggtgtttccttgcacgctgctggccccccccttccccgtgctgggcctggactcccggggggtgggcggcctcatgaactccttcccgccacctcagggtcacgcccagaaccccctgcaggtcggggctgagctccagtcccgcttctttgcctcccagggctgcgcccagagtccattccaggccgcgccggcgcccccgcccacgccccaggccccggcggccgagcccctccaggtggacttgctcccggtgctcgccgccgcccaggagtccgccgcggctgctgcggccgctgccgccgctgctgccgccgtcgctgccgcgcccccggcccctgccgccgcctctacggtggacacagcggccctgaagcagcctccggcgccccctccgccacccccgccagtgtcggcgcccgcggccgaggccgcgccccccgcctccgccgccactatcgccgcggcggcggccaccgccgtcgtagccccaacctcgacggtcgccgtggccccggtcgcgtctgccttggagaagaagacaaagagcaaggggccctacatctgcgctctgtgcgccaaggagttcaagaacggctacaatctccggaggcacgaagccatccacacgggagccaaggccggccgggtcccctcgggtgctatgaagatgccgaccatggtgcccctgagcctcctgagcgtgccccagctgagcggagccggcgggggagggggagaggcgggtgccggcggcggcgctgccgcagtggccgccggtggcgtggtgaccacgaccgcctcggggaagcgcatccggaagaaccatgcctgcgagatgtgtggcaaggccttccgcgacgtctaccacctgaaccgacacaagctgtcgcactcggacgagaagccctaccagtgcccggtgtgccagcagcgcttcaagcgcaaggaccgcatgagctaccacgtgcgctcacatgacggcgctgtgcacaagccctacaactgctcccactgtggcaagagcttctcccggccggatcacctcaacagtcacgtcagacaagtgcactcaacagaacggcccttcaaatgtgagaaatgtgaggcagctttcgccacgaaggatcggctgcgggcgcacacagtacgacacgaggagaaagtgccatgtcacgtgtgtggcaagatgctgagctcggcttatatttcggaccacatgaaggtgcacagccagggtcctcaccatgtctgtgagctctgcaacaaaggtactggtgaggtttgtccaatggcggcggcagcggcagcggcggcagcggcagcagcggcagcagtagcagcccctcccacagctgtgggctccctctcgggggcggagggggtgcctgtgagctctcagccacttccctcccaaccctggtgagctccaagttggttgcgggggagaggggagaatggagtagagtcccttggtacaagctcctctcccccctcttttcccaccaactcctatttccctaccaaccaaggagcctccagaaggaaaggaggaagaaatgttttcttaggggaattcgctaggttttaacgatttgtttctcctgctcctcttctatcagacctgaccccacacaaacctgtcccctcggttgtgttgaagtcccctggacagtgggcaggggtggcagaggacacgagcagccactgcccgtaccccctctcctctctgtaagcccatgccctgtcttcccagggacttgtgagcctcttccctcgacggtcctcttctctccttccagtcctctccccctgctgtctgcagcccctccccggggagttggtgctttcttttccttttttttttttttccagggggagggaggagaggaaggagggggatcagagctgtcccaaagagggaaagcggtgaggtttgaggaggggcagaagcagggccggcaaaggttgtaccttcataaggtggtatggggggttggggtcaggccctgaacatcgtcctacttgagaatctgtcaggggaaaaagtcaaggggagcaggaggaagagccaggagggccagaggcagagaagagatggagtcttaggggccagggtgagcgaggggtccagggcctagaggtgcttcctgggggcgggggaatgcagccagtgtccccctcccctcttccaccccagctccagccctggtcttgtcttttcatccctcttccccacgacagaagaagttgtggccctggccatgtcatcgtgttcctgtgtcccctgcatgtaccccaccctccaccccttccttttgcgcggaccccattacaataaattttaaataaaatcctgtttctggctctggattgaat

SEQ ID NO: 1182 - protein, 491 aa, Homo sapiens
RPPLSPGGPAAAEAMFPVFPCTLLAPPFPVLGLDSRGVGGLMNSFPPPQGHAQNPLQVGAELQSRFFASQGCAQSPFQAAPAPPPTPQAPAAEPLQVDLLPVLAAAQESAAAAAAAAAAAAAVAAAPPAPAAASTVDTAALKQPPAPPPPPPPVSAPAAEAAPPASAATIAAAAATAVVAPTSTVAVAPVASALEKKTKSKGPYICALCAKEFKNGYNLRRHEAIHTGAKAGRVPSGAMKMPTMVPLSLLSVPQLSGAGGGGGEAGAGGGAAAVAAGGVVTTTASGKRIRKNHACEMCGKAFRDVYHLNRHKLSHSDEKPYQCPVCQQRFKRKDRMSYHVRSHDGAVHKPYNCSHCGKSFSRPDHLNSHVRQVHSTERPFKCEKCEAAFATKDRLRAHTVRHEEKVPCHVCGKMLSSAYISDHMKVHSQGPHHVCELCNKGTGEVCPMAAAAAAAAAAAAAAVAAPPTAVGSLSGAEGVPVSSQPLPSQPW

SEQ ID NO: 1183 - DNA, 28903 bp, Mus musculus
  misc_feature (1)...(28903): n = A,T,C or G
actggatggtctggggagaaaggctatgagaaaaattctttacggcagctttattgtctttggttccatgtttcaggtgctttatcattcttgatccttcaaactatgggctgagtggcttctggctgtgagggacacctggagggaggcactttaagggaggagcctaaaggcatagtaaagagggggatactatcggtggaaaggtctaagcagtgggggaggtgaggggcagattgcagatatgtggggagaattacctgggacaaagggaatataaagaagcaatataggagctggagagatggctcagccattaaaggctaggctcacaaccaaaaatataagaagctatatagaagaccacaatcatataacccaaattaaacacacgcacacacacacacacacacactgaagggagttacaatacaggctcttgttagtcctcttggttgctcacaagatcagattgcagaagacaccacacaccttggttgccaggtacaaaaaaaagcaatatggaactgaattggaaacctcatccctgttggctagcttttgaaggcactactgggaaatgtatgaactaagacatcctgtcgagccttacctgcctgtgcaatagtggcatgactgctgttgggctctctggttatatttgaggcctgttccacagaagggaatgacccatgcctggcacgataaaccccacttaatgacacaggtctgtggagtcacaggcccagaggagggacttattgttgtcatttaaggaaactgacatagcattaaactaccttctgaatatgttcatacctacttgaagccttattcagagaaccctctcctcacaatgaacggcaccaagtgcaagagactcatggcttcccaaaataccgagaataagtcacagctgtggtctcagccctaagcaagatatttatatcacccactctaaggctcaggcaaccttgcagaaggggtatgctggaagacaggatgaaggtctgtgaaattctatactctcgttgatacaaccactacaatcattaaccctcaactatagtgttacttacaagactacccctgtctacagttataaaatggaagggctcatgtggccctactctttactactgaactactgggtagagacagagtctgggaaaggagggattactgctttcagttgtgtgcctacctctgagtccaccagtctccaacccacagtgccaaatccatgttcacaggcatagcccttgttaaaaccaatgggcaacaaaataagatgtatggacatgaatgttagagatttgtggagagcaacgggatggacagggatggtagaaagatgtgagaggctgaggatgagagtggtctgcaattatttgcatatgtgtataagttgtgtaagaacacatttaaataaaaattacatgaacattttctattaccattttattcaaattcatacaataaaatagtgcaatttttaaaaaggtcatttatttattatgtataaagcattctgcctgcatgtatgcctgcagtccagaagagggcactagatcccattacagatggttgtgagccaccttgtggttgctaggaattgaactcaggacctctggaagagcagccagtgctcataactactgagccattttttcagccttagtacaatatttaatgtgactagttgtagtggatattcctggttgtcaacttgactatatctggagtgaactacaatccagaattggaaggttcacttgtgatcctatctggaagctgggagatacaaatttctggatcttggcatggagatcttgaggcatagtggctatgaatctcagaagatctgagccacaccttctgctggcaacctacataaggacattggaagaaggaagattcgctctttcttctttgcctgcttgccttgtgggactaaacaactgctagatccttggacttccattcacagctgctgctgaccattgttggttgttggactgcagactgtaagtcttcaacaaattcccctaaaaaagagactacccataagttctgtgactctggagagccctggctaatacagtggctcacagccatctgttgagacaaccagtctcaaaagacctgatgccttcttctggcttccacgagcactgcatgcatgtggtgcataaacacacacaagcagtatacacttgtacacataaatacatgaaatgttcaaaacatattttaaaaaatcacatggaacatgttcaacatctctagccattaggaaaacaaaaatttccccagtaagaatgtgtatcaaagcaatcaagaagcaacacatgttggcgaggtttggggtgggaaacttataccactgcttggaatgtaaaacagtgtggaggttcctttaaaaacagaattcccacatgaccctgtcataccacttctgggaatatgcctaggcaaatgagttaatttactatacagatatttgcatatccatttgattgtggcaatattcactagccaacacaaccaaggtgtccaataacagatggatgatttaaaaaagcacgttacattcacacatggaatactattctatcataagaacaaagttatggaacttataggaaaatggataacactagaaatcatattaaaatgaaaactggtatcacaaagataagcatcccatagttcctctcatctgtgggatataggggacatggtagtaagagaaactactaggaagctggaggggagattggaaatgcataatagaaggggtgagtatggtcagtgtacattttacagaaagggaaatgttacaagaaaactcattagctttacagccaataaaaattgaaaacaagaacatacaggcctgtgtataatccaacttaggaacttaagagactatcttgtcatactactcctgcactgatagaacatggcaactatgataaatggggggagaaagcacagatgcagaagccgggcatctgagtgctgggccacatcaaggacatgccccactgtttactaaactgagccttcagcaagtttccttttttatttgccgagacagtctatgtaattcaggctgcctttgaacttgcaatcctcctgtctcagcctttagggcaccccaggaaaattttctaacaatataccacaaaatactgagaaaactgtaaaagtttgtaaaacaatttgaaagttcttttaaatcccagttctctagtattaatagtcattagtattactatcattaacctatttttttaatcaatctccagtttgatgggggtggtggctatcaagtacttcctgggtaaaagccagctcttaggcaatctaaggtgttgtataaccagaggctttcagcaccagatgtataaagtgaagcacgacctctccagggtatggctgagggtaaggttttcattgtagctatgagggggagcacagccagaggcatctgcgtgagccctgagcaggaagaggaagtagtagaccaaacatnnnnnnnnnnnnnnnnnnnnctgaggaagcctcttggaggccagcaagtacgcaccacacttagccatttgtcccagttccttctgtagcagacagtggttaaatagcccagcgcatcagccctagattgagagacataccagtacccaaccccacccgactaattccagcaactgaaaaattatgaaaaacaccccgtagtacagaaacttacatttttaacaacaacaaaaccaaaaggatatcgacttagaaatgtccttatttgagtgtacctacaaccttgtttgtaaagccgcaatgagtgggagtcttggaaaagaccacaattaagacaatcactaaataacatggtatacttacactaggatcactgcagtgttagtcaccgttgttactgtgcaacgcacacaacacattgctacacatacttgattcagaattgagtactgtgaaaatatttttaagaaaggccaacataataatgttttattgatctaggaactctggcactgaaagcgtgaacaacccaaggtaacgatgtcgtcaccaagggacaagcatagagcccaaatcccttgactcctaggctgatgttttccactaattgtgttcctttctactcatacgagagcttcaagtgtgaagggctggggaaggcagaagacctattatgagccaaatcgaggtggggggtgctctgaaggtcttcagcagtcgccgttgacactcttctttgttttggctgagcaagatgaaagcggcaaccacagaccccagggaccaagaactggaactaggtaccgcctgttgtggtaactctcttttcttcagtcggggcctgccctttctcatctcttccttctagtcaagctctaacgctctccctccgactccatcggtccctatcttccctccttcaccccctttgcacacaactgctttgtattttcgttgaacggggacctcctggtgctccctccagctttagcagggattccaggagcctggtggtgttctctagagccatgggctagttagcattgtaacacgcgattcagttgagaaactacggtgggagccagggcaaacgcgcgtgtcgagtgggcgttggggttcctcaggacaaagcacaattagacaatgaggaccttgcctccctcccggacgcctaacacagcttccctcgggcacccacggagcgtgcgtgtttacacttctctacacccggcggcggatccggggggcattccaaaccgttactccgcccgctggggtgggaccagcccaacggctgagactgcgctctgggcggactacaaatcccagaaggcctcgcgccgcaggggggcgggcggcggcttacctgcctgccgcgcttccctttggttcctattgctttctcactgcgagaagtatcattcctacagctgagggctgcctctggggagaactagcagcctcgacaccaaaaccctcgtgttccccctcttcccgcctcagtcctggctatgtctgactccttcgccggagtcgggtgctacggctagggagggaagcccgtgagagcagttcgggcgcacttccgcctctgcgctccggaaggtagggcgcaggcgcttactgcgactccggagcgactgacttccgttcccactgtgccccgcgagccgaatcatggatcacactggtaaggaggcggaggcagcgggggtcctagtttcttgcccccgtggctcgtgtgggactggtcgcccagcaggcacaaggggctatgctcgccccactgcgccgggacgtggcggagaggaagcaagctcagacccggtcccgggctgagtctgctgcttcccggcctaccctccggagcggtgcctccatcctggagaccggcagcacggctcctttggtgccgctgagctcgtttcgggaccctcctccgcgcagacttgttggaaagggagggtcccagttttgtttttgtttttgttctcattccggttgctttgcacttttgctggggaaataggcgggcgttttccactctcggaattggagaagcgtccggactctgggcgagagtgggttggagacttcctgctgcctctcggcttcgggcggctgctgcagtggtcaccgcctgtggttattgtcttgttggcttttcgcggactagtggttagagaagagagtcggatatagttttcgaagttataagcggagcatcttttctaccggaactcaaagcatgcccggtccttcggccgtggtcctttcgcatcttttggggacatcgcatattacgagtagcttcaaacctcatttctgctggcttcgttttcttggttttagttttagcacttggctttgagtgcttcagacagttttatcgccaagcaggaggaaaggctttttctttaggaattgactgagtgcgcccagtcttcaaacactaagttatataattggatgcagatacttgtaggcttggagatagaatggtggaatggtaaacaataagactacgttcttgtcttcgagttttcattctgtcaaaggagacaagcagattggtttcttctttaacagctgtttacaatttgtggtgagaacttttagaaacaggtgcttgccgggcagtggtggcgcacgcctttgatcccagcacttgggaggcagaggcaggcgaatttctaagtttgaggcaagcctggtctacagagtgagttccaggacagccaggactacacagagaaaccctgtctcgaaaaaccaaaaaaaaaaaaaaaaaagaaaagaaaagaaaagagagagaaatgaatgcccatggagtaggaagtttcagagtgccagggaaaggtgtttttggaatggtaggaaggtatagagaggaccaaatgtcggtagactagttagctttaagttgagaaggagaacacaaattacctttttcaggactttgaaaatcatgataaagggtttaagtggctataaagcaacaattttgactcttctatggagaatggtgtaggagaggaacaacagaagtaagtataaatcatctatgggtggttgcagtgccacagagggaggctcagtttagttgaatcgaagctcagtggtagagcaacttaaccagctagcacgggtccccagcaacgccgtagggagaatgggagcaggacagagagagtaggcagggggagtgggagcaggacatagagtaggcagttgccacaaatattttggtggagaatccagcagctgctaataggttggtttgtggaagtatgtgagagaaatgaaaaaaacctgagtttcccagtagagtgtcttgatactgcatgggtaaaagtattaccctagtttctaagttattagccaaagattgcctggggaaataaaaattattctaacatgaaaataatcactactgacctagctaaggttaaaaaatgagtttcagggcccgtgggtggtggcccacgcctttaatcccagcacttgggaggcagaggcaggcaaatttctgagttcaaggccagcctggtctacaaagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatacaaatttgaatcatagagcctttggcaaaccaagaaaatggtagttagctagttaattgacaattttctgactgagtagacttctcaaaataatgatttttaatgtcaaaggatcaagaggtcttgtaaatgggagtattgaagtagaattctgccagaaaaaaaaaatttagaatttttttaaatggcaaacacgtattgctttctttagtgtttctctagattgcagcagtgtcagcggtgagctcagggccctcgggggtggagagaagcagcagaaaggtgatggcacccttgcagctcctttcaggccagctctgtcccatgctcttacctcacgggcacccaggccaataaagaccctgcaaacacttgattcattctttagtcattgtaagagatggttagtgcttaggtaaaaggaacccacatttttaaaatactgcttcattcttttgggggagatagatcctggggacctgaacccaggaccttagacaggttttaccactgagctacatacctggcttaagttccttggctccttttattcaagataaaatattaagtgtgttgtttttaaaactatataataaaataatatatttttaaaggtatatttactttaaatggcccaattattctttttatcccttatgtaacatccagatatttattacatgctttgtgttttgtttctgtgtatgggtggccccacacaaacaaacttcagaattttgtcccttgaaatctgtgaggcaaacagtagctttagaaagaggctcgtgaaagagccaggctactgtttaaataatgggaaactgggttatgtgagctggttggaaggctgtgcaggtagtgtgttgtcaatcacagactgacacactaataactcttgtgatatctgaagggcaacatgttggctagttcagttctttggaaaggtgggaagactttttgtgcaaggggaaaaggttatctgagatctatgtaggtacttatatatagatgagcgaatgcagcagagactgctgaaatacatgaaagacactccattttagtgcagtattgaagattgatcaagttggtttattataattcaagattgtagctattcatctaatctttccatgaaagattttgagaggagttagctgttataagagtagaaagtaaacatgtttaatcattaaaacccattttaaatttcattttattttgatgatagaaagggcaagagggtatgagtttaattggttggtattgcctatagaagtggacattattagtactagcagactacgttcacatttgtgttttgccggatttaacgtggacagtttggctctcagcttcgattgtaactcttgcaggagctctgttccgtaatttgtgttgcagacactacaattttaagattatatttgcattttttacccttacgtgtttccctttttatcctaaggtaaagtttaatactttgtgttacatatttttatgtacttctatgtgattcagtcctgtgaaataatgtgccccttattcatgaacaagaattcctttttttcattgatggtaagatttttaaggactagaaagtgtcttgttttttaagacccaggtctaactaatagttttccattgcagtgttgactgttaactaaagatacctgttgcctgtgtctctagaaatgttatagtacaaataatgcatgtgttctattaaatgatatatttttgtttccgttgaataattttttaaaaaaatgttatgcttaagggaataattacctctttaaagccaacacataagccagtaaggtggcgtaacgggtgacactgctacctgctgaggccctgaagtcaacatctggggctcaggtggttggaggggagaaacgattcccacagattgttttctgacctccacatattcactgtggctccacagcagtcccccctaaacataataaattaaaactttattttcaaatatatttcagatttagggttgcattttcaatttgttatgtaaatttactaagtttactgcatggctacttcacctgtttgataattaggcacatatgttaagacaatttttttttctcctttatttttaaaaatctttacaatctgtaagaggtttttagacttttaaagagggttatctttttgtaaactactatagaattgtatggtaatttttattgctcattttttagaaagataaatgttctataatttttatcagcttctgaaagggttccctgacaaaataaataaataattaattaattaaataaataaagcttaaccgaaagcatttctttaaaggtttaccccaaataaagactattagcagttacacttaccagtctagtatttaaaatcagagccaagatcttcagtttattgtttgatgttgttgattttatctttatacttgttgtagaacaattttcaaaaagaaaagtaaacataattacaatttcttatcttacattcatatagacaatgagttacaaggcactaatagttctggatccttgggtggtcttgatgttcgcagaagaatccctataaagctcatctccaaacaagccagcaaagttaagccggcacctcggactcaaaggactgtcagcaggatgcccgcaaaggccccgcaaggtgatgaaggtaactggtgtaaactgaaatgtttacgagttgtcaggttggagatggctcagggattcagagcactgaatgctcctccagaggacccagcttcagttcccagcacccatatggcagtccacaactgtgtgtaactccagcaccctcacgtagtcatacatgcaggcaaaacaccaatgcacataaatacaagtaaaattttaaaaagagttctcttgtttatctgagtgtatcaagtaatccatctgattttattaaacctattttagaattagtttagttctatccctttttaagcgcccttcccctggtattgcacagagcattacattaaaagtaaaatttgttttcacggtcctctataaaactgatgctagtgccccttaaaaaaaaatctttcaagtaagctgggtggtagtagtgaatgcttttaatcccaacactccagagacagaggcaggtagatctctgagttcaaggccagtctggtctacagggcaagttccaggacagacagggctacacagaaaaatcttgtctagaaaaaccaaaaataaaatatagttttacccaggtgaggtggcacatggctgaaatcccagcacttaggaagctgagacaagaggattaatgtttgaggacagaccctgtctcaaacaaatgagtagtcctagatgtttagtctgtagatatcctacaatttattttactttcttgtagatacttgttttgccgtaattgtgttgtaatgtgaatattaaaaatttgacttgagaagatggccaaattcttgaaatgggtgagggtaattgccctaagcctggtgacccaagtttcatcctagaaccatttaaaaggaaggagagaactgacctccacccaccactctccatatgtgcagacccctccctccatatcatgtacacaacaaatgactgtttttaaagacttgatttgtacatttcagaatatatcagatcttgctaaattcttcagaaagggtgtggtatagtttctactcacatactcagtattttgcactattaatttaactttttttgaggcagaacttggatagccattctgctcttgaaggtcaaaagtcttgctgcctcggccttgtcagtgctgtggtcacaggcaggagcctaagtgtggttggatgccttttcatagtgctcgccagttcttgcctcagttccaggctctgttttgattgctgcctttctcttaattttgaattctttataatattggctttgttaaatgtctgtgtagttcatttatcttttgaactttgtatataaaatattactgtaaagaacttggacattctaggaagccagttaaactagagcttgctctctcctgtttttaatatattctttaaaaggcctttcctagtttcatgaatataaaaaccgcttcctgtcttgccatctgttagaagtcagcaagctggtctacaggccaagtttggttcctttaaaatagataaagttgctgttcagttaagagtattgccttgtggctattttcctactagcgtggcagaattaactagatttatatgaccaagaaagcctaagttttgtactgtggccttttatagtaacagattgttggcccatactttagaatatttatgggtgtgttttgttttttttttaagtgatgttttgtttaccataaatactgagtaattggttttttaattccagaatagaaatctggctgttaacatacattcaagttctagaagatctgtcttactcctaaattctgttccgtaaacaacatggtgataattggtgaggttttatattagaggtggttagtggagttgctaagagcattgaataagagactcggttataggtctgttcttggctctggcacgtggcttatatggtggctgctgtacccacagtatgttgtcatttgtaaagtactagagatggactcaatgatcatgaagactacttccagccggcattttaaactctagtttaaaaatgatatgccagttaatttctgtgacaaatgtgagttgtctattaaaatctgtgggaaaacggtaagtaaaattaaggcctggtgttgtagaggtaggactctagaatacttttactacgttttttataactagttttatatacaaaactctaagggaagttttataataacatgaatttaatataggtttagttttttgtttttgtttttttattgttttagagtagttttaggaattttgattttcatgtttttagatctctgaaagttatcagaaacatttttcagtaaatatatatacttttaattttgttatgtaaataaatatactttaaattgaaatttgaagttggaaaatgtaatgtaacttttttctctcagaaggatttgattataacgaagaacagcgatatgactgtaaaggaggcgaactctttgggaatcagcgaagatttccaggacaccttttttgggatttcaaggtataactaaaagtgaaaaattagaaattaggcattaagtacttatccactaagtgtggatttttagtatgtcgtgacgtgtagcacacataagtccacttgcttgtttttaccatcttcaaaaataatttgaatgctgggcggtggtgactcacgtctttaatcccagcacttgggaggcagaggcaggcggatttctgagttccaggacagccagggatacacagagaaaccctgtctcagaaaaaaaaaaccaaacaaacaaacaaaaaaataaataaataaaataatttgaagtaatttttggtagaaccaagtaaaatcattagctgctatttaagaagaagaacaagcaaatggaattatactaatcactttttacttctgtttatggtaacaacttaagaaattctaaccatttcactgtgtgaattgaaaagtacagttgcctaaagagataattttaattatcacttcaacagataaacatcttaggtgaaaaggacgatacaccagtacatttctgtgacaaatgtggactgcctattaaagtctatgggagaatggtaaggacaactaagattttttttaataactaattttataacataataatgtacaaaaaagctaggggaagtttaataataccatgaatttagtataattattcttcttactgttttagaatagtttcaggagaaacatggtaagataaaacacatttagagttctttttcaggagctttttacttgcagggactattttagcattgataggttcacgtatctgaaaatagaagcaggtaccaggcaagggggggatagtcttctagtcccagcattctggaagttgaggcagaaggatcgtaagatcaagggttgcctcgggtacatcagagtgtaaggcaatctgagcggaacatgagatccttctccagaaagaaaaagcagagtgttagcagatggacagatggacatgtatttattggaaaaagagccaaagttttcaaaacattttcaaaaacttgggattaaaaatggttgctgggcagtgatggagcatgccacccactttaatgcctcatttaatcccagcactcagaaggcagagataagtgaattgttccaagacagccaaggctaagcagagaaaccctgccttgaaaaaccagatagatagatagatagatagatagatagatagatagatagatagatagatagatagatagagatagatagacagacagacagacagacagacagacagactccctcccttcctccctccctccctccctcctagctgcttctggtatatagtcttaataagttttcatttaactcctatgtgcctcctgttggtagatcactgtactgacaattagtattgaaaatttctaatttgttctaggatgcttaactatgatatttttgcctacagattccatgcaagcatgtcttttgctatgactgtgctattttacatgaaaaaaaaggagataagatgtgcccagggtaagatatgatcatctttagatgttctagtagtagtggcttataagcaagatgggttaaaggttttggagtaatgggactagacaaggatgcaaacgtgctggctgagccactctgtgtgaacctggagttagctttccccttctctggaagatggagctagccattgtcagttcattcagagtagctgaaatgatgacatctctgggaacagtgttggacagcagagcggtttcttgttttctcttttgtgtgtgtctggcacacctggaagcaagtatagcgtggtttgctgattgagaacaacctctttccaaagtgagaattaacatcttttattattaattgtatgtgaataatgtggcgggtggtatgagcatgtgccagggtcagaaggcaacttggtggagtagttctctccttccaacttcacctatgctcaggggatggaacttagaagagcaggcttgcatagaaagcactttacctgctgagctgtctcactggccccaggattagaatggttgaggtcaggtccccatttgactattgatcagctatgtggtacaagtggctttatagctatcggctccctgtgttctttttaagatgaagtaaggattaatgaacagtagaattggcatataataaacactactattcctgttttccaataacccaaacaggtgtgttttgggtgataacgaacgacatcatgatagactcgaagttatacatcatggtatctgtcttgggatagctctataataaagtgaaaatttatattaatttggaacccctgataagaaagccttgagaaaaatggagtgaaactttggattagctcaagggtttccagatcctctaaacctaaaattgaaagtaccccaaggaacaccattgattgttaacaaaactataaacaactgtaagaaaagatttcccctctgtggtgcaggatatgggctttgctaagaaaaaaagggggtgatttgttaatgacccaatgacaactgattttcttggtatatttcattaggtttttaaagttatagattatgaaatatatactgtgtttaaaagatactactatatgttctatagagttataattcagaagaatataaaatttggaagtatatattgtagcctttgttgaagtatttctctaatgcctttcccagcccagtgttgtgcattagcttaatataacatgtgattgttccattaagataaagaattaaaatgtaatgcaacattaaatgtagtgaacattaaaagattctctcttttacatagattttttttttaatttatttacctatattttatgtgcataggtgttctgcctgcatgcctgtctgtgtgagagtgtcagatcttggagttaacagacagttgtgagctgccatgtgggtgctgggatttgaacccaggtcctctggaagagcattcagtgcccttaactgccaagccatatctccagcccatagaggtttcactattactatttaaaagtgcaatttagttttcaggtaactaaatgtgttctagtatgcacttcaccagtgtagtctttagctatctagagagaaacctgtcttaattgtcaaaccaagggcaggaaataaagttaccaaccagaattaatttaaatagtatatgctactgcttttgggcatcatgcaaaagaaaagaccttaccctatttagcatggatatgtttctgactgtgtagtaattagatggctgaaaagcaagaaatgtgcaaagtggccacaaattagaagcaccctagctcctacaaggaaaagagacaactcccatggttgtaaatgatagatcctttgctttgtcattcttctatgtaaatcatactatagttagagaatattaatgagctgtaagtattgggaaatagaaggtctcttaagaaattctattttggtgtttagagttctgaggtaaaaatagtctctggttggtagagatgtcgatgattagtttctgatacaaatagaaaatgttagaggtccactaacagtaattcaatactcactgttaactttgcaagtatattatattttaaattaaagcttaaattaaatgtgctgtttgtgttttggctttagtaaatcatttttttcttcctgtttagatgtagtgatcctgtgcagcggattgagcagtgcacacgaggttctctctttatgtgtagcattgttcaaggatgcaagagaacatatctgtctcagagagacttacaagctcatatcaaccatcgccatatgagaactggaaagcccgttacccgtgcttcacttgagaatgttcatcctcctattgcccccccaccaactgacatccccgatcggttcataatgccaccagacaagcatcatatgagccatattcctccaaagcagcacatcatgatgccaccgcctcctctgcagcatgtgccacatgagcactataatcagccacatgaggatattcgtgctcctccggcagaattgtccatggctccacctccacctcgttcggtcagtcaggaaacctttcgtatttcaacaagaaaacacagcaatttaataacggtccctattcaggatgactccagttcaggtgctagagaaccaccacctcctgccccagcacctgctcatcaccatcctgaatatcagggtcagcccgtggtatctcaccctcatcatattatgcctccacagcaacattacgcaccacccccacctcctccaccaccaataagccatccaatgccacaccctccccaggctgcaggtactcctcacttggtatatagccaagctccacctccaccaatgacctctgctccacccccaataacccctccccctggacatattattgcccagatgccaccttatatgaatcatcctcctccaggaccccctccacctcagcatggtggtccacctgtaactgcaccccctcctcaccattacaatcctaactctttaccccagtttactgaagaccaaggaactctgagccctccatttacacaaccaggaggaatgagtcctggtatatggcctgcaccaagagggccacctcctcctccacgaatgcagggcccgccttctcaaaccccactacctggaccgcatcatccagatcaaacaagatacagaccgtattaccagtgatcatagtgttttgaactgaagatatgacaaggaaaaaaaagattagtcaatcttaattgacctttgactgtggaaggaaaactacctcttttgaggtagctattaacacaagtcttgtctctcaaaatggttttaatctgactaggattgctttcaagtactattctgtagtgcagataagtggcttggttgagcacaattctatcttaactgttactttgatgtgataaattttcccaaaacgaccatttgtaaaaaattgaaaaaaaattcactgttccactttgagaaatactgactttattaaacccaatgtttagttttcttgtgatgcattttgttaacctgtgtaaaagaattaaatttcaaaatggttgtaaaaatgctatttttatgtgaatttaagtgcagccatatcattttttaacccatattttaccactaattttccaaggttaaaatcctaaaagtaaaaatctactaaatcgttaccaggcagactgttaaatgtagggaattattcacactttaggcactgaaagttcaaagtgtagttctgtaatacggttcactcggatgccttttcacagcagctgcagatcatcagcgtttctgtaactgtgcttggctggcatgtctccaggtagtgtgtaattgggaaaccgacctgctctacaggctctaagctgccagtgagtgctgttctcattgacgctttttctgagtggctacaatcacataacttgtcacacttaaaggtcttaagttacattattttataggactgtttaaagttgttattggatgaaatgtgctctctgttcactgtcttaacctacatgtttggggctgactaggctttatttaaatctcctttttctcagtttgattctgtgttttagtgcatagtgtgttcttatttatggaattacacactgcagtttgaatgatgtggaggaatctgactaatgtattagcagacggtgttccttgtagtcacaagctagcatgtactcgggtttttgtggctgtggtgagtttttcctctaagttgaaattttaaaactatcatttcttttattggtaaaacagtcaaaaattggaacaatttactgtcgaatcaatagtaaggacaaccagataattttgaattggacagaagaaaagtcatggttagattgtgaatttcagtgccatgtaaggtgcctttagagtcagtgtttgcattataggggcttgttacagtccattggagatgaccactcagtttatacatatttctaagtcagcatccttaggatattatcgtatatcctttggattgactaaactcttgtgaagcttttcttcccctttaaaatggtgcataatataaacatggtgtgtagtgtgcagataacatttattagatagtttgtagtatataaatttagaacattggtttttgacaaggggtatactgattgctaattaaccattttattctgtcaggtacaggaaaacattctcatggtggatgatcagatacaaaatcatttctgaactttcagaagaaataatgtacatggccattcatccttggctggccagaaataactaatgcagttttttcttgagcaaataattttattttcacatgtagcattttgagaatctggtttgctcatgcactatttctagtgagaaattcttgttattagaagcatggacgtgaaatagtgtgacatgtggtgagtgtttctgtcattactgtaggtacttggactggtgcaaacttgattctttttcatgcccctgtttaggagctattaaatattactgttaaaatccaaataacccctttgtttcatgtagttagaaaatagccagattcatgtaagagctttttaactatttatgagaagctcttatattgagatttcctggggttaagtgtggtaagaaaccacttagcctgtattttggaccaaaaaaatcagtatcatgaaaaaaaaaaatcccacattatgagaattcttgtaggctttaaaaaacaatgtaaaaaccattatgctgggaggcaggccagatgaatgttttgtaatagaattttaattgttagacttcagttcatcagttaattgtttgaatgagggtgggtgggtagacagataacaagattattattaagtgtttctgttcttaaggaaaaagatgtgaatcccagcacatttcagggaagccttcgaagctatctatgatggacataagtctaaatgtatgtatgtttcattaattgctcttaagactactgaggtggcagtttaattctttaaaacaataaaatggaagcataaatactattttgcctagatgagtctttaaacctaatgatgacatatttgggagactgcagaactttccatggttctaaagtaaaattagattcaccttttaaacacttataagcaaaaagttggctcgtgtatttctttggtatatttgttcagagtttgtttcaaatactttatcagtatttggaggaagatctgtttttaagatggtaaagagctatactcatttttccctgtaaaagctacttttccaaagtagtgtaaatactagtcagatataatggaagtataaatagaaaagattatttttgccattcttaaatagtggctgtttgctgtgagaggcacacagaactgcttaaaggcacacagattttagaaaaggactcagataatttaacattgaaagtacatgaaaattgcaagtacctaaaacaaaaacgtttctcagattagccatcaaaggtatcagacaaaggaggttttatactcaaaaatattctggttgaaataaatttatttttatttgctggcttataatttgttaaaatctggcctaggaagtaagcagaatttacttataatagttgtacaatctaataaagcagtactggacatatcaagattagagaggagtgccattctgaagcacccctaataaaaacagacttagctttaaaaatctcagtgtctccccacttatgcccaaaggacatactagttttcaagtttcacagtctcatctcagttttcagacataaatgataggattgcaacacacatagtacagttgagttgtctcacacatgggcagggtcttcctatgggagaagcaatcttcctaaaatgttatgtgtcctaaacacatcttgtttccattctaggtagtaggcactgtctgtcctgttgcatttaaggttatattttttaagctgcctttaaaattgtccttaatttgctttctttcatatttaaaagccatgcccccttttacttccaaaacattattattattgttattattattatttaagtcatagaaaaaataggtaaaaggtaagatccccactgcacccccccccccaaggctatcatggtggtcagcttctcctgatgggtagttaacatctaattttacttatgactcttaacagctaagtaggctccattgtagctgcccgcctgttctcatgctatgatcaggaatctgcctgtgaatgctgaaagttctgttccccatgtggttcttgaacaatcaataaagatgccagtggccaatgactgggcagaagaggcaggatttccaggttcctgcaggtaggctaggagacccaggaggaaagggtatttgtcatgcttcagagggaaagtaaccagtttttctaattttcctacccccttagagaatatctcattgcccctattcaacaagaagaaagctatggagagtggtcagcccaattccctgggtttgggcatctggtaatggttattttacaaattatagatgagttgttattttaaaggataatttggaaatggtcatagttttgaacagagaagagatagattactaaattttattcttgaacaaaacattgtgtagccataatcttacattgataaaaaaaatctttgtaattgatacaaagttaaagttacaatttcttaaatcggtacagaaattatatattgatatagaattaaggttttcagattgataaaaatctgtatatcgatacaaaatttaaaattaacattgttactcttagataggcattatgcaacttatttaagaatacaaggctgtgactcagtccttctaatagctgccttacaaactgttcaggatgatgaagtagtgcaagttaggggctagacagtaaactccccgtcatgttagcttgtaatttaattataataaagtgttttcagtttattcaagtagtaatggcaaagaggaacagttcagagatgcttgacttagtcttcaaaaccatcagaaatccgcagactgtgacatctagtgttatctcttttgactatgagacatgtttgctcttgacagcttcctggtcgatcatctttacctccaggcaagattgcttattgtagtaaggtagccactagacggaaattgcttatatcatttacagacaatatactgtccaaaaaggacaaataggtgggatagttgactactaagctctgccaagacagagtaaactagttcttcatatttcctgcttcacaaattgtctgccagatggttctgggccagaaggctgaagacagatgctccaatgttataagaaattaggagctgtccaggtagtcagctatctctatagttgtttaagttttggaagctatgtttgatgctccattcatatatgtatgtgtatatacatgtacacacatacacagataatatttaattctcaagatttctgatgtggttgaagactagttatagtctcataatcaaactcaagttgtttaacattaagagagaggttatagagtgaaagacatggtttttaggtggtgttacaggcaaaaaaaaaacctaaacaattcagggataaaattataacaagaaattataatttgatttaaattataatttaatctaaattataattaagttaggagtgatgatagaatactttaattgacaaatatgatggtctagatattgtatatcatactttgtaatttacatgatttagttttgttcaatttatgtgtgagaagagttttaattggacggaaaaggtgaggttagggagtcattctgatgctatgatcaagaatctacctgtgaacactgaaggtcctgtttcccaattagttcttgatcaagcaataaagatgcagtggctaatggctgagcagaagaggcaggaattccaggttcctgcaggcaagctgggagacacaggaggaagaaaaggtatttgtcatgcatccagtgtagagagaaccatcagccatgtgagatcttgggtggagaggccattggccacttcccctattgggccttgagtagctggtgggaaataagaaacaactaagctgagggagggcagatttcaggtgctgagcaaggagaaggtaactgggcaactaaagttgagggcaggtttattgttgagcaaggagtaaagggaagggcacactagctgtgggaggcttggaagagcctagccactgagccacaaggccggttaaaaatgagctaacgtgtgtgtgtgtgtgtgtgtgtgtgtgtgtgtgtgtgtgtgtgtgtgtctttcatccaagaatccaagaaaccagggctatggctgagtgtggtccaccaagaacttaaagcaaaatagtagaaactacacagaaccctccatgatctagaaaacattctaatccctgctgaatgtatttcataagccatattcattaattttatatactgagctatgtggcacataaaggttcatttctggaagtatttactcactagacagcattaagctcatgggatgcacagtcttcagagactaccaattataagtattaaattatgtaccatgccagatgtgtgtcagaatcctgtgggaaagccagttagcatacctgggtaggttgtaacttagcagtaatggcattgaaaaaacagcatttgagctaagattttaagtaggtgaaagtcatgttgagtgggagcagagttttacaaactgcactgtaaagtaaaagacttcgtgggggattttgcttggctcattttagtaatagatgagtagaataaatgaaggtgaggttcagggcaggactggctcataacacttggctagcattcacaaactcatactgtttggcctccaagtcttgacaagaaactcaagaaaaagttaatagcaataaggaccttattctagtgacaagaaaagcctttgtggccttccaaatagaggaataagatgagtgacctgccttttgtgaaaggattagttattctggctgtatgttgggaaagactagtgaggcaaatattgaagcagaaaccagtcagggttttagtaattatactagggatgatggtagcattgcaggtattaactgggtaacctgaggacgtgtgtgtgtgtgtgtgtgtgtgtgtgtgtgtgtacagaaaagtgaatacctgcagtgttagatgtgggtacataaagaacttataaagtagatatggtccctgctatttagcagcttacattctaaatcttttgatatataagtatttgttttcaatacttagtggtcagaaaaactatttcacccttaaaaatgaattcccaggaatggagagatggctcagttaaagatcattggctgctctttcagatgactcaggtttggtaccataaccccactcccaagggctctaatgctctcttctggcctctgtgtgctccaggtgcacagatgtacatgcagccaaaacacccatacacagatttaaaaaaatatatattaccagattataaacacaaaagtaaaattacaaaaataacataattcataatagctttgcaggctgtgtttatttgtacagtgctaagttagtaattatggaacaaacacatgtacctatactatttctgagttaggtcctacctataatcagtttttagacattttaatttcttttggggagtaatgtttcccaaaactttataaagtgtagactgtacagtcagattgtctgacaacttctgcaacagtatcgctttccctctttgaatctagtttgctttcctaaatgtgaagctgagctggggtaagaggaggatagtacactcctacactcccagtgcttggaagatgaggcaagaaaatcaggagatgaagggcatcctcagccacacggttccagtccagcctaggatgcaagaatcctcatctctgcaagtaaataaactgaatgggggtgtagtttagaggcagtttgtaatgagggtcagaactcagtccctggccccaagaatcttaatttgcttagatttttttgagaattaaaggcttcagtgttgaacagattctagtcgggatttctttgtcagctctttgtgggcaggtagctgcgaggagagaagcccagactcgcttggtctcttcgggcctgagcggaatggtgagtgtcaagcaaattgagaagaaccacatggggccaggagtcttatggaagcaggaactccatttaatgtggcagcaatttacttatatagacagggcaaggaggtggggatagaagtatggggtgagatgacgaggggtgtgagatgatctcacggggcctataacaaattgatacattagcggtaactaggcagaggcagtctcattcaggtcagtaggtagtgcggagtcattctcaagtgggaacgaatgacaggtcttgaaaatcgtgccaggctcgggtttgtccaaaccaaggccaaataaggcccaacatttcctgacagatttttgttttgttttctccagagcacggagaatagagttgtcagtcacagaggagaaaagatgaaaaatcagatctgcagggaagtttcaatttgatgaaatccatggaaatgcttaaaaaaaggaattcttcctttcttggttcacacattgtagagtcaagctccagcccaaaacgtttacaaatgatatgctttgctgttaggcaacactgtttaccaaagctaatttataaaataattattagggaggccaggcctcagctaatgtcttcatttgagtaatgtatctgcccccagctctttggtctcccttttgatgttgctctacttttttgaaattttctttctgcctctactaacatagtattttaacctctccctgatcaggggtgagatatctgtgctgatttcagcactggctctggagcagacaagtcgaggtacaggtccataaatttctatatcttagaggagagaaggaacaactaagaatgagttccagggcaggaggagtggctcagcagataagagcactgactgctcttctgagggtcctgagttcaaaccccagcaaccacatggtggctcacaaccacctgtaatgagatctgacaccctcttctggtgcatctgaagtttaataataacaaatctttgagcctgatcaagcagggattctcagagtgggcttgacttgagcgagcagaggtcctaaaaacaaaattcaatccccaacaatcacatgaaggcttacaaccatctgtacagctgtatacagtatactcgtatacataaaataaatctttttttttttaagatttatttatttattatatgtaagtacactgtagctgtcttcagacactccagaagagggcgtcagatcttgttacagatggttgtgagccaccatgtggttgctgggatttgaactccagaccttcggaagagcagtcgggtgctcttacccactgagccatctcaccagccccttttttttttttttttttttttttttaagagtgagttccatgaggctgttgagatgtcaaggttagctgtgttatatgatataggcaccagatctgagcagctgtgtctgcccctggtgatttccatagcaagaatgtaggcagcaccattgcctggcatgatattaccatttgatgggaacttgaagcttttgtgcaacaaatgttctatcctgagagttacaggcacacacatcttaaaatagcatacgcgtcgcataaggtgatcatgactctaaagcttaataataaaaattgctgtttctatgggttttgtttgtttgtttgttttgttttgttttggtaaaggcactatttaaataactttattcggcatttttgtactttaagtctgatagacaagcctttctggaccgtctcagggaaggatggaatgatactttgacaggaagtgtttagaggccagtctagaaaaatggcacagttctctctacctattcaacattgtacttgaagccctagccagagcaattcaacaacaaaaggagatcaaggggatacaaattggaaaggaagaagtcaaaatatcactatttgcagatgatatgatagtatatatatatatatgtgaccctaaaaattccaccggagaactcctaaacctgataaacagcttcagtgcagtagctggatataaaattaactcaaacaaataaatggcctttctctacacaaaggataaacgggctgagaaagagcttagggaaacaacgcccttcacaatagtcacaaataatataaaatacctcagtgtgactctaactaaggaagtgaaagatctgtatgataagaacttcaagtctctgaagaaagaaattgaaaaagatctcaggagatggaaagatctccatgagatccatgctcatggattggcaggatcaatatagtaaaaatggctatcttgccaaaagcaatctacagattcaatgcaatccacatcaaaatttaattcttcactgagctagaaagggcaatttgcaaattcatctggaataacaaaaaacctaggatagcaaaaactattctcaaggataaaagaactctggtagaatcaccatgcctgacctcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcttgtgctgtaagatcagaattgacaaatgggacctcataaaattgcaacacttctgtaaggtaaaagacactgtcaataagacaaaaaggccaccaacagattgggaaaggatctttaccaatcctgaatcagataggggactaatatccaatatatacaaagagctcaagaaactggactccagaaattcaaataaccccattaaaaaaatggggtacagagctaaacaaagaattctcacctgaggaataccaaatggctgagagacacctaaaaaaatgttcaacatccttaatcatcagggaaatgcaaatcaaaacaaccctgagattccacctcacaccagtcagaatggctaagatcaaaaattcaggtgacagcagatgctggtgaggatgtggagaaagagggacactcttccattgctggtgggattgaaagctgtacaaccactctaaaagttactctgacagttctcagaaaattggacatagtaccaccgggaagatccagcaatacctctcctgggcatatacccagaagatgctccaactgataaaaaggacacatgttccactagttcatagcagccttatttataatagccagaagctggaaagaacccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1184 - DNA, 2988 bp, Mus musculus
acaatgagttacaaggcactaatagttctggatccttgggtggtcttgatgttcgcagaagaatccctataaagctcatctccaaacaagccagcaaagttaagccggcacctcggactcaaaggactgtcagcaggatgcccgcaaaggccccgcaaggtgatgaagaaggatttgattataacgaagaacagcgatatgactgtaaaggaggcgaactctttgggaatcagcgaagatttccaggacaccttttttgggatttcaagataaacatcttaggtgaaaaggacgatacaccagtacatttctgtgacaaatgtggactgcctattaaagtctatgggagaatgattccatgcaagcatgtcttttgctatgactgtgctattttacatgaaaaaaaaggagataagatgtgcccaggatgtagtgatcctgtgcagcggattgagcagtgcacacgaggttctctctttatgtgtagcattgttcaaggatgcaagagaacatatctgtctcagagagacttacaagctcatatcaaccatcgccatatgagaactggaaagcccgttacccgtgcttcacttgagaatgttcatcctcctattgcccccccaccaactgacatccccgatcggttcataatgccaccagacaagcatcatatgagccatattcctccaaagcagcacatcatgatgccaccgcctcctctgcagcatgtgccacatgagcactataatcagccacatgaggatattcgtgctcctccggcagaattgtccatggctccacctccacctcgttcggtcagtcaggaaacctttcgtatttcaacaagaaaacacagcaatttaataacggtccctattcaggatgactccagttcaggtgctagagaaccaccacctcctgccccagcacctgctcatcaccatcctgaatatcagggtcagcccgtggtatctcaccctcatcatattatgcctccacagcaacattacgcaccacccccacctcctccaccaccaataagccatccaatgccacaccctccccaggctgcaggtactcctcacttggtatatagccaagctccacctccaccaatgacctctgctccacccccaataacccctccccctggacatattattgcccagatgccaccttatatgaatcatcctcctccaggaccccctccacctcagcatggtggtccacctgtaactgcaccccctcctcaccattacaatcctaactctttaccccagtttactgaagaccaaggaactctgagccctccatttacacaaccaggaggaatgagtcctggtatatggcctgcaccaagagggccacctcctcctccacgaatgcagggcccgccttctcaaaccccactacctggaccgcatcatccagatcaaacaagatacagaccgtattaccagtgatcatagtgttttgaactgaagatatgacaaggaaaaaaaagattagtcaatcttaattgacctttgactgtggaaggaaaactacctcttttgaggtagctattaacacaagtcttgtctctcaaaatggttttaatctgactaggattgctttcaagtactattctgtagtgcagataagtggcttggttgagcacaattctatcttaactgttactttgatgtgataaattttcccaaaacgaccatttgtaaaaaattgaaaaaaaattcactgttccactttgagaaatactgactttattaaacccaatgtttagttttcttgtgatgcattttgttaacctgtgtaaaagaattaaatttcaaaatggttgtaaaaatgctatttttatgtgaatttaagtgcagccatatcattttttaacccatattttaccactaattttccaaggttaaaatcctaaaagtaaaaatctactaaatcgttaccaggcagactgttaaatgtagggaattattcacactttaggcactgaaagttcaaagtgtagttctgtaatacggttcactcggatgccttttcacagcagctgcagatcatcagcgtttctgtaactgtgcttggctggcatgtctccaggtagtgtgtaattgggaaaccgacctgctctacaggctctaagctgccagtgagtgctgttctcattgacgctttttctgagtggctacaatcacataacttgtcacacttaaaggtcttaagttacattattttataggactgtttaaagttgttattggatgaaatgtgctctctgttcactgtcttaacctacatgtttggggctgactaggctttatttaaatctcctttttctcagtttgattctgtgttttagtgcatagtgtgttcttatttatggaattacacactgcagtttgaatgatgtggaggaatctgactaatgtattagcagacggtgttccttgtagtcacaagctagcatgtactcgggtttttgtggctgtggtgagtttttcctctaagttgaaattttaaaactatcatttcttttattggtaaaacagtcaaaaattggaacaatttactgtcgaatcaatagtaaggacaaccagataattttgaattggacagaagaaaagtcatggttagattgtgaatttcagtgccatgtaaggtgcctttagagtcagtgtttgcattataggggcttgttacagtccattggagatgaccactcagtttatacatatttctaagtcagcatccttaggatattatcgtatatcctttggattgactaaactcttgtgaagcttttcttcccctttaaaatggtgcataatataaacatggtgtgtagtgtgcagataacatttattagatagtttgtagtatataaatttagaacattggtttttgacaaggggtatactgattgctaattaaccattttattctgtcaggtacaggaaaacattctcatggtggatgatcaga

SEQ ID NO: 1185 - protein, 486 aa, Mus musculus
NELQGTNSSGSLGGLDVRRRIPIKLISKQASKVKPAPRTQRTVSRMPAKAPQGDEEGFDYNEEQRYDCKGGELFGNQRRFPGHLFWDFKINILGEKDDTPVHFCDKCGLPIKVYGRMIPCKHVFCYDCAILHEKKGDKMCPGCSDPVQRIEQCTRGSLFMCSIVQGCKRTYLSQRDLQAHINHRHMRTGKPVTRASLENVHPPIAPPPTDIPDRFIMPPDKHHMSHIPPKQHIMMPPPPLQHVPHEHYNQPHEDIRAPPAELSMAPPPPRSVSQETFRISTRKHSNLITVPIQDDSSSGAREPPPPAPAPAHHHPEYQGQPVVSHPHHIMPPQQHYAPPPPPPPPISHPMPHPPQAAGTPHLVYSQAPPPPMTSAPPPITPPPGHIIAQMPPYMNHPPPGPPPPQHGGPPVTAPPPHHYNPNSLPQFTEDQGTLSPPFTQPGGMSPGIWPAPRGPPPPPRMQGPPSQTPLPGPHHPDQTRYRPYYQ

SEQ ID NO: 1186 - DNA, 35680 bp, Homo sapiens
taagtagggacaccatttaatgttgcagctcagggagttaaaaaggttctaatagtttattttcttggttagctaaaatatggattaaaagatggtccactgtgagcaagctggaaatgcctgatctctcttggtttaatgtagaggaagggatcccaaggcttagggagactgggatggtggagtggattagtcactttagacctactcatcccacctgagagggtccagaagatatatccttgaccaatgccttgcaaaatatatttgggagggcagcacctgcatctttgaagagccctgtaattgctcttttctgtatgtcagagctaacagtgggaaccacagtcactcaactacaaaatttaaatacaatgggaataactggatcccaaggtggcaggggcaaagtagcagcactcaactgtaaaaggcagggtgggcatagctactgtaatggaaagcagaggcaaagtggcaatcagaatagtctgattcatgtagagctctggcattggctaattaatcacagtgctcctagaagtgaaattgataggaagcctactgcattcctacttaatttatataagcagaaaacttctaagtcaaatggataaaatactaatttaaattataaaaacagagaatcatgccccctcaattaatttccagacatgagccagtttacagacccagaaccccttgaatgaaggggaggctgggtccccttgatgaaagaccccactacattactgacagtatctttctcccatccttccccaaggagacttcttgccttttaccaaggtaactgtatcttggggaaagggaaatgatcagacacttcagggactactggacactagctctgagctgacgttgattccaggggaccgaaaacatcattgttgtcctccagttaaattaattaattaaataaattaaattaattaccagtcaggtaattaatggagttttagctcaggtccaacttacagtgggtccagtgtgtccccaaactcatcttatgattatttccccagtgccagaatgcataattggcatagacatacttagcagctggcagaacccccatattggctccctgactggtagggtgagggctattatggtgggaaaggctaaatggaagccattagagctgcctctatctagaaaaatagtaaataaaaaacaatatcgcatccctggagggattgctgagattagtgccaccatcaaggacttcaaagatgcaggggtggtaattcccaccatatccctgttcaactctcccatttggcctgtgcagaagaaagatggatcttggagaatggcagtggattaccataagcttaacccagtggtaactccaactggagctgctgtaccaggtttcattgcttgagcaaattaacacatctccttgtaccttgtatgcagccattgacttggtaaatgcctttttctctatgcctgtccataaggctcactagaagcaatttgccttcagctggcaaggccagcaatatccctttactgtcctacctcagggatatatctactctccagttttgtgtcataatcttattcagagagaccttgatcacttttcgcttccacaagatatcacgctggtccattacattaatgacattatgctgattgaatccagtgagtgagaagtagcaaacacactggacttactggtgagatatttgcatgccagaggaccagaaataaattcaactacaattcaggaatcttctacctcagcaaaatttctaggggtccagtggtgtggggcctatcgagatattccttctaaagtgaaggataagttgcttcatttggcccctcctacaaccaagaaagaggcacaatgcctagtgggcctatttggattttgggggcaacacatttctcatttgggtgtgttactccagcccatttattgagtgacccaaaaggctgccagttttgagtagggtccagaacaggagaaggctctgcaacaggtccaggttgctgtgcaagctgctctgccacttgagccatatgacccagcagatccaatgggtgcttgaggtgtcagtagctgatagggatgcagtttggggcccttggcaggccctcataggtgaataacagcagaggcctctaggatttttgagcaaggccctgccatcttctgcagataactactctccttttgagagacatatcttggcctgttactaggctttggtggaaactgaatgtttgactaagggtcatcaagtcatcatgcaacctgaattgcctatcatgaactgggtactttctgacccatctagctataaagtgggtcctgcacagcagcattccatcatcaagtggaagtggtatatacgtgactaggcttgagcaggtcctaaaggcacaagcaagttacatgagaaagtgcctcgaatgcccatggtcaccaatcctgccaccctgccttctctcctccagcttgcaccaatggcctcatggggaattccctatgatcagttgacagaggaagagaagactagggcctggttcacagatgtttctgcatggtatgcaggaaccacccaaaagtggacagctgcagcactacagcccctttctaagacatccccgaaggacagtggtgaagggaaatcttcctggagggcagaactttgagcagtgcacccggttgtgcactttgcatggaaggagaaatggccagatgtgtgattatatactgctgagaccagcttggtcagggagaccccaacccagcggcgctagaggaattaaagacacacacacagaaatatagaggtgtaaagtgggaaatcaggggtctcacagccgtcagagctgagagcctagagcagagatttacccatgtatttattaacagcaagccagtcattaggattgtttctatagatatttgattaattaaaagtgtcccttatgggaaacgaagggatgagccaaaataaaggggtgggtttggctagttatctgcagcaggaacatgcccttaaggcacagatcactcatgctattgtttgtggtttaagaacacctttaagcggttttctgccctgggtgggccaggtgttctttgccctcattctggtaaacccacaaccttccagcatgggcgttatggccatcatgaacatgtcacagtgctgcagagattttgtttatggccagttttggggccagtttatggccagattttggggggcttgttcccaacaatatactgattcatgggctgtagccaatggtttggctggatggtcagggacttgaaagaagcatgattggaaaattggtgacaaagaaatctggggaagaggtatgtggatggacctctctgaggggtaaaaaacagtgaagatatttgtaacccatgtgagtgctcaccagtgggtaacctcagcataggagaattttaataatcaagcggataggatgacccacttgttctgtagacacccctcagcctctttccccagccacccctgccatcgcccaatgggcccatgaacaaagtggccatggtggcagggatggaggttatgcatggactcagcaacatggacttccactcaccaaggctaacctagctgcggccactgctgagtgcccaatttgccagcagcagagaccaacgctgagccctcaatatggcaccattcctcagggtgatcagccagttacctggtggcagtttgattatattggacctcttaaatcatagaaagagcagaggtttgtcctcactggaacagatacttactctggatatgggtttgcctatcctgcatgcaatgcttctgccaagatgaccatccatggactcatggcatgccttatccactgtcacgttattccacacagcattgcctctgaccaagagactccctttacagctaaagaagtgtggcagtgggctcatgctcatggaattcactcttcttaccatgttccccattaccctgaagcaccgttctatcaatagaacggtggaatggccttttgaagtcacaatgccaactaggtgacagtactttgcagggctggggcaaagtcctccagaaagccatggatgctctgaagcagcgtccaatatatggtactgtttctcccatagccaggattcacaggtccaggaatcaaagggtggaaatggaagtggcaccactcaccatcacccctagcgatctactagtaaaatttttgcttcctgttcctgcaacattacgttctgctggcttagaggtcttagttccagagggaggaacactgccaccaggagacacaatgattccattaaactggaagttaagattgctacctggacactttgggctcctattacctttaagtcaacaggctaagaagggagttacagtgttggctggggtgactgacctggactatcaagacaaaatcagtctactactccacaacagaggcagggaagagtacacatggaatacaggagatccattagggtgtctcttagtattaccatgccctgtgattaagattaacaggaaactacaacagcgcaatccaggcgggactacaaatggcctagacacttcaggaatgaaggtttgggtcactccaccaggaaaaaaccatgacctcctgaggtgcctgctgaagccaaatggaatacagaacggacagtagaagagggtagtcatcagtaccagctacgaccacatgaccagctgcagacacaaggactgtaattgtcatgagtatttcttccttcttttgttaaaaacatgtttgtgcatgtatacacttgtactaagaaaatatctccattttatttcctttttctgttaccatgtgacataagatttattgacttcacatcagcatttaaatattaactttatgtaatagtatttgggtaggagattggtgcgtttccgtttgtacaaaggatggttttattatgttagatgtaattatgaccttattattgtctttatttgaagatgatgtgtgatctcaggagatgtgtatgggttcaagctgacaagtagtagacttatgatggttagtgctgagggtcaacttgattgaaggatgcaaaatattgatcctgggtgtgtctgtgagggtgttgccaaaggagattaacatttgagtcagtgggctgggaaaggcagacccacacttaatctgggtgggcaccatctgatcagctgccagggtggttagaatatataaagcaggcagaaaaatgtgaaaagacaagactagcctagcctcccagcctagatctttctcccgtgctggatgcttcctaccctcaaacatcggattccaagttcttgttttggggcttggactggctctccttcctcctcagcttacagatggcctattgtgagaccttgtgattgtgtgagttaatatttaaagtcccctttaataataataggatatttaataatttaataataataggatctatctatcctattagttctgtccctctagagaaccctgaccaatacaaaaagctcttcaaaacatcatgggagctataaagcagtggttttcaaacttgaattataaccaattagtgcactttgacattattttagtgtattataaccaacattttttttaaagggacagaataaaaatagcagagagaactgcatatagaaagggtaagtatagtttcatgacacttacatatatgcttaggtgttgtgagtttatgtactggactatgatgtagaatgtatttctgacagaaacatttatttaacagtaacaggatctacttacaaaccaagtggaccaggtgttttagtctgtttgtactgctgtaacaaaatacctgagactgcgtaatttataaacaataaaaatttatttcttacagttctggaggctgggaagtccatgatcaaggtgtcagcagatttagtgtcttgtgagggttctctgcttccgagatgagcaccctgttgcttatatactggaagggatgaatgctctgtcctcacatggctcacaggcagctctctgaggactctaacggcaataccattcatgacagcaaagccctcacagctaaatcacttcccaaaaggccccacctcttaatatcaccaccttggggtttaagttccaacatatgaattttggaggaataccttcattcaaaccatagcaccaaggaaggctgaaagcctttttcaactggcatggagtggcagctgaggttagggtcaggggcccttgaacaaaagccttcttaagtttaggaaacaatatacagactaattgcttactacagagcagtttaataccctaagcattcttttaggagtgaactggaggcaattatattagcaaagaagctgtagggagggacaggtctatccagctcaaaggatatccacaacaaaattttccttctcagaaaagaaggaaggctgcaggacctctctagatcaaaaggttccttttcaaatgagtacatatattgccaggcctcaacgagaatgaatctccttcgagacaggaacgggacaatgccttcaatcagcaacattctgtttttacagtctatttccctcttattctctgaatctgcctcttgcccagtttttgatggtgtttgaaaagctggctgccatagcttgataaggcatatatctaaccaggatattttactgccttttccatttctgcttatcaaacgtattaacatatactggacactacctggatccgttttttttttttactaacaattcattcatacttcatggcattttggctatcataggtatcgctggcttcctggtcaattgttcttggtctaggtgtaatagtattacactttaattctgactgattgttcatcaactgattcatctccccaccccaagttaagatttgctcattgtttttgaatatattttgctggattatattgtttctatgaatatattatgctgggttttgttaaatgctctatttctttactgttactctgaaatcttactttttcaaggtgctccataataacttatttttttagaactcccaaacatggatcaacagtacaaataaagctcttcactgtcctctatagaaaccatacaattctcacatctgtgcccttgcttttctctgtgtgatatgccttttattgctctcctcctctccaaattttatccattcacataaggctcagcttaaatccctccataaagctaacctaactactctcagtcccactactttatctaaatgtaagtagcactgaatttcctctcaacacttagaactaaattatatagatcttcacatatttcttaaaatgatatcctgtaggatccttgaagtaggggccattatttatacagcttttgccttatgcagtcctaggcaggcactcagtgggatacagttgaaagagtgttaggagatgaaggtttttgtccttacttggtactgaggagtccgtaacaggctattggggaaaacaagctctctgatacccctcttacttttctcatagcataaacagtaactatgtaaatgggaggctatcaaaacatcttggagaccactaccttataattcataggtagtagatggtcttgccagtaagataaaaaggtgcacctcagtgcttcagactgcccattacagtaagttttcacttttataaaccttaggtcagcacctaaactatatatagcttatatataagcaatataaaccttatgctctataaataaatattaatggcaactcttgataaagaaattgtgactggttacagcacgctggtcgctgaaaagagatactagagggcagtaataaaacataggtaaagaaattaatttatcacactgctactgcattggtaattcaaggcaaccacaattaagggggtaaatacagaccacagatgctaaagcaatgcctgaaagtaagagatgtcaaatcaaatcaaacaaatgtttaacattttatcagatctaaaataagtacatcttctctcagtaaattttcttgatgcaccataaaatgccaacaaaacttctaacttacaggttaaattatataaaatacaatttgaaagctctttttaattctaattatttaaatattagcatcagcagacattaataatactattctgaacctggatttccatgaatctgaaggttaaccgttagctgataggctaagtatgatagaacaaaaaaatcaaagccagtggtggtgatgagcatctgtagtcccaactactccggaggctgaggcataaggaccccttgagcccgggagtccaaggatgcagtgagctatgattctgccattgtgttccagtttgggctgccccatctctaaaaaaaatttttttaatatgaaaaagaagtactttctaagtgaaaactttaaaaaaaaaaaaaacccaaattggtgaaaaatgcctgactatatcaacactgtatttagaaaaatagggaggtatgggaaaaaggttaggcaagccccaatgcccaaaacaataatcccagaaactgaaagcatcttgaaaaccacctagcaatacagaactttacatttaaaaaaagcaggggtaattttgattcacaaatgtccttagttgtgaatgtacctaaaaacttgtttataaagctgcatatatagagcagaaaaatcttttacaagatctcaggaaaataatcaccaaataacatggcgcacttaaatcgcactgatcatcacagcatgattcacaaataataccgtacaactacaaagatataacacatcgctacacatactttatttgcaattcagtaccatgaaaacatttctctaagaggtcaatgtaataatcttttattgatataggaactctggcactgaaagcttgaataacccaaggtaatgatgtcgtcaccaagggaggacaagaatagaacccaaatcccttgactcccaagcttgtgttttccattaattgtgctcctttctattcatccaagagcatcaagtgtaaaaggctggagaaaggagtggacacaaatgagccaagtccgcaaggtggagactgcactgaaggtcctaggaatcgccccttggcactttccttttgtgttggctgaggaagatgaaagcagcaacaaccacaaactcctgggaccaagaactggaactaggtactgcttgttgtggtaactctcttcctcattttaggcctttcctttttaacctctccttccggccaagccttcgcgctctcttcccctccctcggtttctatccgctcccgttagctccactccgcacattcctgcaaggtgtccccgttaagaggaggcagctgcgccgcactggctctccaccctccatccggccctggcgcccagtcgtcaggtgttcgagaggttcgtagcgtcacaagcgctctccctagaaagtgagtggcagtcaagcattataaacgtgtttcaactgtaaagagacttaagagatgggaaccggggcatataccaagttagctctgcgtgggtctaggtagctcgtcacgacaaagcaaaatttagacaagcgttgagactttccttctagctccgagtttcacagctccgccatcccctgagcaacctcccactggagggcgccttccggagcgcgcgtgtttacacttttgctacaccaggcggaggaaacaagcgctcgctgaccccgggggattccaaaccgttactccgcccgccggggtggggccagcgcaacggccgagcctgcgcagccagccggctccgggggccccgcgcactacaagtcccagaaggcagctctccgcggggcgggcagtcgccttatctgcttctggctcatttttaccactgctctccccttccccggtccccctggtgtcctttccacagttaaaggctactttctcttgaagcacatgaggagaagccttagcaacctcaataccgaagttcttcgcgcgctcgctctttctgcctccgcccgaactatgcctgagtccctcacaggagttgggtagtagaggcgagagaaggaagtctttgcaggccaaaattgggacaacctgcttggacttccgcctcccggcctccggaaggcagtgcgcacgcgctcgctgcgactccggcgcggttgacttccgctcccactgtgctctgcgagccgaatcatggatcacactggtaaggaggcggaggcagtgggggtcccggttccaagcccccttggccggcctggggctggtcgcacagcaggcaaaagggattatgctcgccccacaacactagggtgtggcagtgagaagaaatctcacagatgccttcctgtgcccggcaggggcctgcggtttcctggcctaccgtctggtgtggtacctacctcctccgtgccggcaacaaccgctcctactctggttctgctgagctccgagcccggaccagtgggcgatgtaggccttcgggaagggagagccccggctctgttttatttagcccagctgctctggcctacgttatggagactggcgggtagattgcggtctccgagtcgcggaatcctctttacgctgggagtggacgggcgagaatgggttggagacttcctgctgtctcagtcagctttgggcgggtgctgcagtggtcaccccctgtcgtctctccgatcctttatggactagaggggtgaaagaagggagtctgatagagtttttggaatcaaactcggagcagtttttctacctaaaccaaaagcatgccccgcgcttcggctgaggtccttactcatcatttgagggtatttacaaagaggagtttaaaatcaaggcattctcatacttttctccaagtaagagtggctccaccctttgttatgtattttctggcttttgcttctttgtggttcttggatattgaatgagtgctcttggagttatgtgccccatacatttatagcgaccgtatcacaaatagagaaaaaaaggctttttcttgagtattgagttgtcctcactcatcagatatctacttggttatataattaggtgtgtatgtttatttatgtaggtgtgtatgtttatttatgcaagatacatgcagatatctataggtcgggagatggaagatggaatggtaaacgagacggaccaggtccgtgatagaacttctgttttatggaggaacacagacaatacgttctttttttttaaatttattatttttttaatgtttgcggattattttgaagaaaataaacgagtgctgtggagagattcataggacgaaatttcagagagggttgttaggaatggtctttgtggaagctaagatctgatggatgagaagaacccagccctgggaaaaaagcaagaggaagagcatttccagcaagtgcgaaggcactgaggtaggaagatacagtgaagtcagctgcagcctcctaatagccagagggtaggagtcctgaagtgagattggaaaggagggcagcaggcacatcattcaggtcattgaaagccgtggtaaacgtttgaattttaatttaagtgaatatgaagccattgaacagaagtggaggaggaacacagtctcttaaaaaatacaataggctgttctatgaagaatggtgtaagagagggaggtaagaatgatggaaaatagctgattgcagtagacgggaagggaaggttggtttggtgaaaatgaaggagaatgggcagcttcagtaaatactctggtggtgtttgaaggaatgtgagagaaaggagaaatgcctaggcttttggtttgagcaactaggtagggtccattattgagttgaggaaaacttggggcagaaaacaatctttttttgtagaggtgagacgggaatttgggaacaagtgtttggtcttggactgctagtgtgagataactactgagacacaggagagatgccaagtggagatgagaggaaagatctgcactgaaaatacgtatttggaagttagtacctttatttatagctggtattttaaagcatgaggacagatgagaccacttaagaagggtgtgttcagaggagaagccggcctagaacgaggctgtaaagaattccagtgtttgggaatttatagagttgaaactgggattttgatgttagaatagcaaacattcaactttaggaaagtaattcttatttgagcccactactggaattatgagtcaagttcctgccatagtttagaggctattatgttaggaaatcataataggggtgagtgtaaagagtgtttattatcttaattcttgaagtttagagattgcctaaggaagtaaaactcatcttaacatgaaaatactcacgaatgagctgaccacttaaaaaattagttccttctcagatgtcccttctgcttaacactagcttcttacctattttatttttttaaatgaatcaatctctttgatgtttagtatcagaagacagtatcaaatactgtgcactgattgtgaaataaaattataaaccttgtagaagattctggttttcatgaaattcgtaaacatgaatttgataattgtttaaatcacaaaggctttgacaaatgaggaaatgccacttagctagataattgaagaatcatgacaggataggcatctcaaaagaataattgtaatattaaaggattaagaggtccttggggaaacagatgaaacccttgaacattatgcaaaaatgacccattttatgatcataccgaaacattcaaatgtgaaaatgaaggtgttctaatagaatcttgccagaaaaattactccaaggggctccccattaacactggatttattctttggtcattctaagaattagcacttctgtaactgtatcccagattttgtaaaagatcccagattttgtaaaatatttattggttctttttattcaagataaaaaatccccaatcttttttaaactatatgatatggaagtgttgtgcctttttaaagtgaatttatctgaagtggccagtagtccttagtcactttctatgtaatatctaagaaatttttgttgttaaggactttataatttgttactgtattcaaaaggaaatagtgctttatgctctgattcttaatttaaaaacaacaaaaagcaaaaaagtcccaaagaaacccagaatgttatcattattaaatgctgtacctcatgaacttgaatctgtgaagcagagtgggaagggccagccagctcttgaaagtggtagactatgcaagcaacagtagagacctcaagtgttcaggatggtgtgaaaaggacttgtaatgaagtgttggtattttcattattcacaaaggtaaaacgattaaaccattttgatatttgaatatttaatatttgagggacagcattgaactgattatatgtctacaacgacttgctttttagttcattggaatgtcaggaatactttttgagcaaggaaaaaagtcattcatatttcttttggccaatgcattgcttgtaagtacttttacatacataagcaactacaatgaaaacagatcaaatacattaatcagcttgtgagtctatttaatgaagtgttgaaagctgatcaagttgggttaaccctaactcaagattctagctaaccatgtaattccacccctctttgttttaggattagctgttataagagtagtaagtagattaaaataatcgttatggacccatttttaattttgtttggtattttgttcagaaaaagtgcaaatgaatgtgaacttattgtgtgtctgtaatcctagtagccttggaggccattggtactagcttactacttccaaatttggctttgctgaatttaatgtggatggtttggctatcagtcttgactgtaatatttcctgcaggggcagttatacaaccttgttcaataacttgtcatgtttaaaacactacaaattaaaaaatacgttatttgtatttcctattttaagcattttccttctttagtaggtcaagttaaatattttctgtattatatattttcatctacttgaaaaaaggtaactcttaagctttagatggagtcagttctatgaaataatactcctgttactcatgggacaagaattaatttattctatagacaataacaagcaaagactccagggactagaaagtgacacttgtttagacctagttgtagtataggaactttgcatcctcttaaattataattttccattacagtgctgactaagaactcagtcacatgttatagcacaaatacattattgcatgtttttactactaaatggtataatgatttttactatatttctgaatgatttttagaataattattttgcgcttaaggaataatcacatttcttaacttcattttcaaacgcattgtttaattttgccttcatcagtattagtaagttcagtttactaaatttattttctgctttgcatgcttgacgatcagacatggagacagggatggttttcgttctttttctccttcttactctttttcttttaaaaaattctcttgtagttcaagacaatggttcttgggttcattaatggtttcatgtttctgtaaacttctctggaattatatgaaaaattttattcacttttctagggagaggtcctataacttttatcaatttcttaaaggattctgtatctcaaaaggggttaaaaagcattgccttaagtgttgatccaaaataaataaaattagcagttaaacttaatgtaatattgaaaatcagaacccagatctttaaccttgataatgttaggtatggtgttttaatacctgtggcagaataatctttaaaaagaaaaactaaaagaaattacaacttttttttcctaacacagacaatgagttacaaggcactaatagttctggatccttgggtggtcttgatgttcgcagacgaattcctataaagctcatctccaaacaagcaaacaaagcgaaacctgcaccgcgaactcaaagaactataaacaggatgcctgcaaaggctccacctggtgatgaaggtaatttgtttaactaataggtccaacactctttctgttttatctgattgcttcggacagtctgtgtgatcttatagctacctctttttgtcttacatattctattcattcttcaaccttcttgtttgacttctcattgtagcacattgtatttttattttcctttataaatattttttgatttggttccttttgttgttgaaagcaatactgcccattgttcagtaatctcaacagtattgcagaaagcataacattaaaagtaaaatccttctatccaaagataatccctgttgacttttttatacaaaagtattaattttttatgtgtagttgccattttttcatgtaatatgcatttgagatttttttcttatcagtacttacagatgtacctcattaaaaaaataggtttgggtatttatagatataccataatttatttaacagtttttccagttttttctgttacaaaaaacattgcaccaaatattcttggacatacagtttagtatgtatactttgtagaatttgtactttgcacagatttggccttttttttttttttaagagcaatttgacagtacttgtcaaactctaaaatccacagtatctgtcaagttttaaaatatccaaatttgtagttttaaaggctttggaattaaaaaaataataataaaaaggtatgttagtttttactcccatacaccaatactgagtactagaaaccttttaaaatttttgttttgatgtaaatttattttaattatgaaagagtgtatattttttcatagtattgaccattcttgtttagatcctttcttctgagttctttgtaaattaatagggtttttgttatatgttatgtatgtgcgtgtgtgtatatatatttttttgtttgtttgtttgtttgtttttgtttttttgagactgagtcttactctgttgcctgggctggaatgcagtggtgggatcatggcttgatattccaggctcaagtgatctttccacctcagtctcctgaggagctgggactacaggtgcaccccacctgcctggctaattttttatatttaatttttgtagtcatggggtcttgctatgttgcccaggctggttttgaactcctggactcaacagtcctcttgccttagcctcccaaggtgctgggattacaggcgtgagccactgtgcctggcctatattgtatatattcttcatttgtcttttgaattttgtatacaaaatatttattgcagagaatctttttttttttgagacagagtcttgcgctgtcacccaggctggagtgcagtggcgggatctcggctcactgcaagctctgcctcccaggttcatgccattctcctgcctcagcctcccgagtagctgggactacaggtgcccgccaccacgcccagctaatttttgtatttttagtggagacggggtttcactgtgttagccaggatggtctcgatctcctgacctcatgatccgcccgcatcggcctcccaaagtgctgggattatagttattgcagagaatcttgaagattctatatagtcagatatccagtctttgcttttatgacttctgggttttgtgacattatttgaaaggccttcccctatttcaccagtataaaagagtttttccatcttacccttgattacaggttagcaaactatgtctgtgggccaaatgtagccctgtttttataaacaattttattggaacacagctatgctcattcatttaagtattatctatgggggctttcacactataatggtagagttgagtaattgtgattgagaccatatggtccacaaagcgtaaatatttactatttagcatttcacagaaaaagttcactgatactgctttagaacatttatggttattaaggggaaaaaaggtggggtctggcttttttttttttccctcgaaacattgtcccaactcttttccttgctgaatagggattttactgttatcatatatatgttaaagcagcagtccctaatctttttggcaccaggactggtttcgtggaagacagtttttccacaggtggagagtgatggcagggtgcggggagtggtttcgggatgcaactgttgcattagttagattcttgtaaggagcaccaacctagatccctctcttgcacggttcacaatagggtttgcgttcctatgagaatctaatgaggctgctgatctgacgggaggcggaggcagaggtcaagtggtaatgctccctagcccttccctcacctcctgctgtgtggccgcattcctaacaggccaagggtactggtccaaggcctgggagttggggacccctgtattaaaagtatttttttgtatttctggactttctgttctattccagcaatttgtctgtatttattttgtagaatcaaactgctttagttacaacatatgttatggtttcttttatcgtagggttcctctgccatctaaacaagtatatttcaagtcaaaatgttagaaatcgtgttagtaataacctagggctgctgttgcactacctctaatttagggtcactcctgctttggctttgtttaaaaaaatagttttttaaaacaacacgttagtgtacaaataattctttaatagttcaaacaatgcagaaaagccaaaatccttttctctcctttccctctcggattttggagtaaaataagtttgtttttgattgttgttttcctaggcatcaatcaaaatatatatagtttaatgatgggagtacaggtggaactactctgaaaaatgataatgtgctcctaatttccttggctgttatctcaataattttctggtttgaaaaattgagtttctgccaggtgtggtggctcacgcctgttttcccagcactttgggaggctgagacgggcgggtcatgaggtcaggagattgagaccatcctggctaacacagtgaaacctcgtctctactaaaaatacaaaaaattagctgggtgtggtggcgggtgcctgtagtcccagctactcgggaggccgaggcaggagaatggcatgaacctgggaggtggagcttgcagtgagcggagattgcgccactgcactccaacctgggcgacagagtgagactctgtctcaaaaaaaaaaaaaaaaaagaaaaattaattgagtttccttattttgaattttagatcacaccagcttttctaaggtgtaaatgggtgatataggagcctaggaacactcaggtgtaacttataagagcatcctgactttggattatacattcgtattggcagtaattaaatagcagtacactgaagtgtctatcagcttcaaaaacttcttgcatcattgtttgtgtgttaatgtgaatgtgtctctctgtgtgtgtgtgtgtgtgtctgtgtctgtgtataggtgctgtaatttagtcatgtgggtaaagttaaaacttgtgtgcttggctactctgtttaccagttctagggccaaaagagtcgtgagaagcctggctccttggagggatatatttgtctgctcagctttactttaggtaattggattctacctagaattcccatcagactgttgattggttttctgttcttttgtaggagttgagaagattgccatcaactttttaattaggccagagaaattgagcccctttcatcttcatatatcttaagtttattgatattgataaatgcattgtaggaaaggatacatgagaatacgatatggctcctgttgtttgggtaattaatcagggagtggttttaattgacaggatgaaatatgaatatgttaaagtgtctaaatcactcattttagggctaaagaagaggataacttgtttgctaataaaatcgatagaatgctttatgttttcattatgctattggcaataaaatcagtctcttagcataccatttttgtagctagactagaataaatggtgatcaatatcttaaaaatttgtgcaacaagcatgatcatcagtaaagttttacattagaaatagtttcatgaattgataagagcatttgaatgggagtcaagagatctgaggtctgttcctggctttgccacttatcttctatatgttgagttatgagtctccatacagtaatattctcaataatgaagtaaaagagttggactagatcaccaagatcacttctaactgatgttttaaagtaatcttgattgtcttattcttagaaaagctttgaaaggcatcagatgagctttttagtgaaaaggtctattttgccatgtatatgtgcttccaaaatgaaatttgagatttggaaagttaatgggcaatactttttttttctcagaaggatttgattataatgaagaagaacggtatgactgtaaagggggtgagctgtttgcaaatcagcgaagatttcctggacaccttttttgggactttcaggtataattaaaaatgaaaaattgtattataacaataaaatattttaagtattaaatacttaaaatgttttattggagtaatgcacagtacattaagaatattatgaacttataactatgattttcagcacatacaaatcatttgttaatactctattttcaagaataatttgaagtaattttcagtaaaatcaataactgttaacactaagaagaaaaactaatggtatcacaactaatggtggggaataaatggagattataccaagaggcttctatttctaattgttttaacaacttttataaaatattgaccaattcattgtgtagatacaatctttagaattgtgtaagaaggtaattttaattatatcatttcaacagataaacatcttaggtgaaaaggatgatacaccagttcatttctgtgacaagtgtggattgcctattaaaatctatgggagaatggtaagtataattaaatattgtttttgtaagtaagcatttgcatagaggtggggttctgaaatttagataggtttatcattgtttaatgactaagtttgcaaaattttaaataagtatgaaataactaagggaagtattggaatactatgaatttaatatgattatcttgacaaattgttgaattcttataaaatattaaataaaactgaaaattagaataatttctgaaaactaattcctttggagtgtttgataccagtgaatttacagttattctagtttattaaggaaatttttgtttcttaataaatagaacaaaactgcttatttttgaaggccacaattttttacataaaactgcattaataatatttataatttctctttttttcctgaggctcagagaggcttaatagtaattattatttctgaaaattgaattataatcattaaaaaaattttacaatcctaactgtaattttatagtaattttcacatttcttccctccaaaaaagatagttttgcatttgcctttagaaaaaaaaaattgaattcaataacatacctgtgatggtagatggcatggattatgcagtgttgctttgctgaacatcatagtaaagaaatagtaacaggctgtgaatttaaaaatgtgcttctaacatcatttaatgtatccttctgattgatttttagatttttattagttaattaacttgaaactaccagaggaagatgctgcttacgttaaatataggacatacttgttattttactgcattggaatagtttcaggagaaacaagattaaaaaaaaaacacacataattaaaagtattcttcaggagtttttgacctgcagggggctgggtgtggtggctcacacctataatcccagggctttgggaggctgaggtgggaggattgccagaggccaggagtttgggaccagcctggacaatttagtgagaccctgtctgtacaataaaataaaataattagcctgctgtggtggcacacacctgtgttcctcgctattctggaggctgaggtgggaacatcagccaggagtttgaggttacagtgagctgtgatcacaccactggactccagcctgggcaacagagcaagatctgtttcttaaaaaaaaggaaaaaaacgtgtggggaccatgggtgaaatttatagggtttacacctccagaaagtataagcaaatgcatgtgtgtacatttattgggaaaagagccatagtttttgtcatgttctcaaaaggctttgtgattgaaaaaggttattataattagtacttaataaatgttcattttaacaggtattctcaagtgtcttctaagccttatgtataggttactatatatatatattttaaaaatattataagttctaatatgcttaactgtaatatgtctttgtttacagattccatgcaagcatgttttttgctatgactgtgctattttacatgaaaaaaagggagataagatgtgtccagggtaagataagattatcattaccttttttaaataataaagttttagtgcaatgatttataagttggattaaaggttagggagtgatgtaaatcaggcaggagatgaaacatacagacatggctaatctttttctgtgagcccagcttgtgttaggtttctctttaatatagggcaaggtagccactatcagtcaactcaaattggtcaaaatgaaatctgtttgccattatagaagtattattataaacaaaaaagttactttttttaatgggacattaaagaagtattaagatatattgagagcaaagactccagaattagaattcctgggttcgaatccttgttctgctatttattagctgttttactgtcataggctattctttattgataaaatgagactgataatagtacctacctccttgaggtatttttaggattaaatgaggttttatatatatataacatatgtacacagatacatatatatagtagctggcatatagtaagcactgtatatataagctcttgttactttcaaatctgattattgtatttggagtatatcttagaacaccatcattacatagtctcaaacaagttataaaaagctaggtccattttgggatggtcttgaagaaaacagaataagaatttttatatcagttcagaatcgttgataaggaaggcttaagaaagaatgaaagatacttgcttggagtagccataggcttcttagatcacttataacctgtgcttaaagctataccaagatttgtggtattgattgataacaaagctgtggacacttgtcagcaatgattcccttttatggtgtaggaaaatttgacgtcaccaggagagaaaggggtgatttattaacagctcagtgacaactaattctcttggcatgtttttattagcattttaaagtaacagattataacatttgttctatgaatttaaaaaatattttgtttatagaattataattcagaagaattaagacattagaaatacatatcacttgttttttgggtgttttctctcaggcctaatttttcagcatggtatacattcattttaagttacatagtaaatttaattgcttcatcgggataaaggatttcagatgtgataaaacattatttagaggacttttaaaggtttcctcttttgtataagtattaaaaggaaattaaaaggtacttattgtttaaagaaattacttcccaaggtactaaatgtaactaatgtactgaatattctaatgtactaaccttactaatggacttaaatgtaacaaagtactaaatgtcacacctcacttatgtggtccttagtagcaattttaggacagaagcctatctggattaacagacccagatcaggaagtgaagaaatggcagtcagagttaaacagtatatattactgttcttaagcaccacccaagagaaagtgcttcacatcttgttaaggtggagatagttcggagtttacagtgaactagaagcaaaaagtgtgccagatggccactaaagggaagcataataacatcaataaggagtgccagccttatagtaaggatggaaagatagacacaactcaaaatcaagagtatagagccatttagtatagtgtcaaatgacctgacacacatattcaatgataattgcttatatatgtacacacacatatatttatatatagtgcttaattggggattaaatactgtcactttcattgtttcatttgatattaatattcttttaggtaatatgaaatagatataaaaacattgtgaagtaggtagatactttaacctcattgtataaatgaagaaacaaactcaaaaatggttcaatgacttcaaattactgagccaataccagatcccaagatcttcagattcctatttcagtcctctttccccactgtgtcaagaaagctgtaatggcaattatggattaaatatggtaaatgaaaaatagttataattttgaccctgagtttttaagaaaatgttaagttaaatttagtgctcacaaattagaaagttagcaaagtgtaaatttgtctgacagttcagaaaaaacccttctttaaaggacttttagtagtcaaggcttggattgaaattgtttgtttaatgttaagaaccctaatgatgaggctgatgttacttgttgtagtccttgcaatgtcttctacttactgttttccacttagtattatttgctcaacaaacagttatcactcaataataccatactagtttgaattccatgattgtaagtaatctacccgttggtttttttcttgctgggttttttggcaaatggatgcagaaggtacaattgtttgagaaaactggataaattctaggccttgggaagaatgaggtctcttcttgaaacataccgtttgatattaggagttctgaagttgacagaaatgcctatcttaatggctaacagacaacaaagtagggaagattaaaggtttgcgtagaataactgtaacttctaattgtggacttttgctatgttttatgtaacagtcaaattttaaaaacaagcatatttttgaaaattacataattttttgtattctcttttagtaaatcacatttctttcccttctaatttagctgtagtgatcctgtgcagcgaattgagcagtgtacacgaggttctctcttcatgtgtagcattgttcaagggtgcaagagaacatatttgtctcagagagacttacaggctcatatcaaccatcgccatatgagagctggaaaacctgttacccgtgcttcacttgaaaatgttcatcctcctattgccccaccaccaactgaaatccctgagcgttttataatgccaccagacaagcaccatatgagccatattccgccaaagcagcacatcatgatgccaccacctcctttgcaacatgtgccacatgagcactataatcagccacatgaggatattcgtgctcctccagcagaattgtccatggctccacctccacctcgatcggtcagtcaggaaacctttcgtatttcaacaagaaaacacagcaatttaataaccgtccctattcaggatgactcaaattcaggtgctagagaaccaccacctcctgccccagcacctgctcaccatcatcctgaatatcagggtcaaccagtggtatcgcaccctcatcatattatgcctccacagcaacattatgcaccacccccacctcctccaccaccaataagccatccaatgccacatcctccccaggctgcaggtactcctcacttggtatatagccaagctccacctccaccaatgacctctgctccaccaccaataacccctccccctggacatattattgcccagatgccaccttatatgaatcatcctcctccaggacctcccccacctcaacatggtggtccacctgtaactgcaccccctcctcaccattataatcctaactcattaccccagttcactgaagatcaaggaactctgagccctccatttacacaaccagggggaatgagtcctggtatatggcctgcaccaagagggccaccaccacctccacgattgcagggtccgccttctcaaaccccacttcctggaccacatcatccagatcagacaagatatagaccgtattaccaatgataatagtattttgaatggaagatatgagggggaaaaaaacttatgtgtagtcaatcttttaagctttgactgttttgggaaggaagagtacctcttatcgaggtagtataaaacacatagggtcttgtttcttaaaatggttttaaatcttgaccttaagattgatttcaagtaccatactgtagtacagataagtggctcagttgagcacagctatattttaacatctctttgttcccctagtttagtaaattgacccagaggtgaccatttgtaaaaaatttgaaaaaatttttcattgttttacttcaaaagtattgttttgttaaacccaacgtttagtttttcttgtgatacattttgttaacctgtgtaaaaggattaaatttcaatatggttgtaaaaatgctatttttatgtgaatttaagtgcagccacatactgttttttaaaccatatgttttaccactaatttcccaaagttataataaaatcctgaaagtaaaaatctactagaatttgctgtaaggcagactgttaaatgatagagaattatttcacattttaggcactgaaatgttgaggtttcgaggtatagtaagtatacaatgcacttcacttggatgccttttcatttttaggcagcctcaggagcaccaaaatacattggaattctagtactaagatatatttgttcgtaatgttaaaagacattactaattatttggaaagagatggccaaaataatcaactctacaggcttcaagctggtgggggaatgctgttactcattaatgcttttttactgaatggtcggaatcacatatgcaccacacatactgatcttaagtaacattattttatagaactgtttaaatgggtttaaatggtgttctttagatgaaatgtgttctgttttgttcattgtcttaaactgaatagggctgaataggctttatgtaattcttcatttcatggtagagtttgatgctgtgtttaagtgggttcttgtttataggattttcaactacagtttgaatgccatggaggaatttgaataatatattaatgaaggacatattcttgtaatcacaaatttgcatttgctcaggtttcattgctgtgtgataggatttttcctctaacttgaaatttaaaaacttttatttcctattccttttgtcggtaaagcagtctgaatttggaacattttatcatggagtcaacagtgaagactaccagataattttgtattggagaagaggaaataacagctaaattgtggatttcagtgctttacatggtgcctttcgagtcagcttttacattataggggcttgttatagtttagctaagatgaccacttaacagtttatacagaactcatatgtataaatcaacattcttaggatattatttatatcctttgaataaatccctgtgaagtttttcctccccactaaaatggtgcataataaaacatgaaatatgtagtatgcagatatcatttattagatagtttgtagtgtatacatttagaacatacttcttttgacaaagggtgatctgattgctaatttaccattttattctgtcaggtacaggtgaaacaaattctcatcttgaatgatcagatgcaaaatcatttctgaaccctagagcagaagttagaaataacaaaatggccgtttcaaccttgactggccaaaaataactaataaacttttttaagtcaggcaagtgattttctacatttagcagtttgaaagtccagtgttaatgcaatatttctagtgagaagtgcttgttattaaaagcatgggagtgatagtgtgaaatggtggtgagtgcttctatcatattactgtaggtacttggactggtgcaaacttgattccttttcatccccctgtttaggagctattaaaatattactgttaaaaatccaaaccattctttgttccatgtaataagaaaatagccaaaatcactttagagcttctcaactatttatgaagagctatcctgcttttattgaaagtcactagagttgaatgtggtaagaaaccacttagcctatgtattggacgagaaaatcagtatcatgataaaattttgaattaagagaacccttgtagagtttttaaaaaatgatttattttcaattaggtttaagaaatctatgttatgcagggaggcatatcagatgaatgttgtagcagacaaaagttttaaatcgtgttagacttgaattcatcaattgtttgaatgagggtgggtgggtagaaggataacaaaattactgttagtgtttctttccttacggaaaaagatgtgaatcccagccttatttcagggaagcctttgaagctatgatggacataagtctaaattaaatgtatgtatgtttcattatattgctcttaagactactgaggtggcagtttaattcttaaaaacaataaaatggaagcataaatactattttgcctagatgaatttttatgttttggcacatctgggagaatgcagaattttccatgtttatattgatacaactttctacagtaaaagtaagttcacttctaaaagattaaaaccatcaagttgaatgtcatatttcttcattggcatgtttattcagagtataatacagtatttggggaaatatctgttgcaaagactgtaagaaactatattcattttgccttgtaaaaactacttgctcaaaattatcatgtaaatactaattagataccactgaaatgtaaatggaagagatatttgaacatatcttttaaagtcagtaagaggctgtatgaagtataccgaactgctgaaggctttgttctgactaatatattggaagagtatcttttgtaatctttttgggaaaactctacagttccgtctttcattttttgaaaatgccccatattatgagtacatgaaaaaagtgcatgagtactcaaagatatttcttcattagattagccgtcaaattagtatgttgatgttaagcatatataaacatactatattctgactgaagtggacttactcttcatactaatataaacatactatattctgattgaagtggacttactactcttcactggtttgtaatttgctaaattatggcctagaaaccaatcagtttgcttaatacagtatatgtgtaatcaaagcagtatcagatacactaggcttaacgagaagtggagataagccaggtaaaatacttggcagtgatgctaataaaacctaatttggatttttaaacaccttgttttgattcatgtcccttcagttttccatcattgagggaaaaagttttaaggcagaattcttaacactttagtgcttaattttcccacatccccatctttaaaaattttgtattttttggcactgtagaagcacaggattgaaacgaacaataataagtcatgggtttagttctccaaattgggtaggacttctttaaaaaaaatttattcacttaaaaatgttaaaacttttttttttttggtaaaaggattattctgactgtgtgataagacaaaggaggctaagatggaagcagagggaccagttagtagggtgttttaataatttacacaagagatgatggtggtaacattacaggtatcaagaagtgggaagtgggtgacttgtggaaggatatacataaagatacatatatatgaattattgatttataaagttaaatacctattatatatgttagatgtgggtgtatgataatgaacaaaatagatggtctctgccctttaggagcttacattctaacttacttaggaattgttcttgatagtcgtctttaaattttcttcaaaaattttccttatattcaaagtattgtggccaggacataaatcttaatgtttaaaaatacattaccaaaatacatacaaaaccatgagagaaaatgtatttaattctgaacattactatttcctagcagcttttctggatataattgtacaatgctaaattagtgagtttggaacaaatctgtggaatgcacttataattattcctgagtttagtcctatcttgtaatcagtttttatttaggttttaatttcttttgagaagtgatgttttctaatatttaaaagcctgggttgtatagagttagactgtccagacagatttctggctttaccacctgtgactatctaatttagactagttacttgctctttgagtcttcatttactttgtttttttaaaaaataggggaaatcttagtactgacattattggggactcttttgacagttaaatgactatattttaaaaagagagtcagtaggatttcctggtggattttttggcttgatcagcttaagaaaaatggagttgtcattaactgaggtagaaaaaatgctggtagagcagattaggggaagatcagcagatcagccttgacatgttgaaatccagaggaagatgctagaaacatgaattaaatatccctcttttatattcttgttcatgcagtgtagggtcagccatttaaaaaatttcatttacatttctaagtggtaagttcctgtgtttagacaaaaatatgtatcaagtgcttaaataacttacaaaataattttaaagatacactgctcaacatgtattactttcacactttatgaatttctgtaatgtatttgtctcttcacaagttgttctgtctcccagttgcctcctctcccctccaatcttgttctggtttatatacgtttatttttatcttccaacatggtctcttgacttcttcctaaattagggatcagattttggtactaggaaatttccaatatgtgctctgaggcaggcaagtagaggctcagccccatgtattcccattactagaagcatacccaaccttagtggcctacaagaaagaaaacatttaaggataaggataagtaaacctctaaggtgttaaggttgaatgtactgtgatgtgggcacaagaattggagtgcttgtgcttgtttcttgagttttttgtttttgtttggtttggtttggtttggttggcaagaagagtgcagagggcacctttgcttgggaagatggagacctcagcgacaatcctatatataaggcatttgcctcaacttcaagccaaatgattgagtaaataggctcctgttttcaatttcgacttcctactctttttagaggagaagttcttaacccaagatttgtgaggcattttatatgtaaattgtgtgtgtgtgtgtgtgtgtgtgtgtgtgtgtgtgtgtgtgtgtgtgtattttttcccccaaagtccatagggtgtatgagactctataaggagtccatgactcagaaagttaaacactactataaagagtgctgtggccgggcacaatggctcacacctgtaatcccagcactttgggagtccgaggcaggaggattgcttgaggtcaggagtttgagacagcatgggcaacatagatcgtgtctctacaaaaaaatgggaagattaaagagtgctgatattctacttttaagattggctgtgtaaataacctttatcttacctttgtgtatgtagttttaagtccaatagacaaaccctctcaaagacactaccagagagtggaaaggtactttgacaacaatgttgagaggtaagatctaaaacagttggggcagcttttcccattgacaaagttgtttgatgtttaataaagggcgttgaatatttttctgttggtgctgatgtttaatttctaactattacataaatacaaatttgcaccaagagccatgccagtggaaaaagagaagcaggtgtgctgaatctcctccagataaattgagctctagagctgttattctgccctgtgagttacaaataataaccagcagtgaaaaaagaagagagtcatactacttcctgccatctgtttttcttcttcccactgagacccggaagaattggctacccatcttttcttttcaccttccttgctttctcattttttagcttgtatagttttcatactaaatctatataggtacagatattacattagaaggattgtgtttaaaatctggataggaggttggatgctttaaaaaactggtaatcataaaatctgagcaaagaagcctgattacaggggttctgttagaagattctcatgtagcaggtttccagccagaccactatataacaggacccacagcaagcatgtttcagaaagctaacaaatttaacaaaacaagacacatccactgtacaactgattttttaatggaaatatattaatatgacctgtataaattatgagattcaaaacagtggcgccactatactgctaaacctatgcatgaaggtagtgactaggatggaaatctgtcagtgctacaaaaatatgtatgaacaaaataattttcaccctttgataaagctacaagatataaaatttagaatacttatataatttcatactagatatgtgaaaaatatgccatgctagaaccatcttgttccaaagtttgaaacatattctgtcaaaaatactcttcgtacaatgtatgaacttatcaataactttctgggtataaagttgtttttatgtcatagtcagatgaagatccttctgaattatatgttgattagaattttgtttcaactggcacctggaagaagacagaaagttcttgttttaaaatactcgtcaagttctgttacaataatcacatcttaggagctagaatttaccagagttaacaggttttttttttgtcttgaattttaatgatcaagtaccttccatcactgcttgtttaacatagatctatgtgataccacattgtaattcaaaggcctaacttaacttaaagtaatggtacagtgtgttgtagcaatatctttcttcacatttattccaaaggactatgtgtgttggcctggtatattcagctgttaccccagtcaccactggtggcctatccacagctggtgatttaccttccttgagaccaaagagctggtgttaaatgtttcttttttttaatatggggaagccaagttccaccactgtgctagctagatttgttagacaattggttctagtgtttgggtcagacatgaggtaaatgctattcctaccctttatcctccaatacttggtgacaattctgaatacaattactgaggagagggtttctggtgtgagacttttcttataaggtactcaggcaaggtgccagttttattgggtttctctggaatctagtcctgggagacagaatcatggtgcttatgtacattcgcctcttacctcaggtctatccaattttctagaatggccttttcatctgacctttgctacttgataccactcttaataatgttccagatttatcttatgctctacatttctttttcattttgactagaaattccttttttgagacctttcaactaagagaaataccaccagctgcctgccatgcttgaagacaatcattaaattctttctctggtccctcaatccgttgtctttcactagaggatagagatggtgtactagaacagaagacaggtcttgtcatcagaaagatcttagtgcagtcctgttggggtcacttggtatgtgacctcaagcagattagttaagctctctgagcctgtttccttttttttttttcatttggaaaatgaagatatcttctttgtatattgttataaggattgagataatgaatgtaatacacctgccatctacctggcctacagcagaaacccattttaatttgtgattctacttttcccaaactagaaacattgctttaaaggactgaatgttctagaaatgaacatctacaatgaaatgggactctccagttaaatgctgaattggcaactcactctagtaaggaaggatagaaacttgtttcattgcttgactgggcactgtgctagggacttctcaagcatctggctattgggaggtgtgtattagcttatcattttcattgctaattcacctgtaaatggaaagagcaataccttccctgctacgtggattattacagggccagaataagagcattgttgtaagtggtttgaaaaacaaaagaagatatgctcaatattgcattaatggagatctattatcactattttttcatcctgtttttgtacgggtctgagtttcttttcctgaaaactccctgtgagattggttagcattgcttcagttttctagggatgaggcacagaggctcaagcaagtgctggactttctgccacatgcaggaagtggcctcactactttgaaggtttttttttgctgtgatgtctaggtgaagataaacctgttgaagaatcttacctcatatacccgattacgtaatcctccatttgtatttatggtaaaatcaatttttccatctttttcctgagaaaaagagaatggaaatatggattaggggctgattttttttaatgttgaaaaagagaaatttaaggagtgcagatggctgcttatgcaattgtgaaagtcaccaaagagctgatacctgactgggattaaactttgaagtactgtaatctttcttcatcaaaatatgcaaaacagcatcatggattgttaagaaaaatattgagcttttcacttcaccatcaaaaaattcataccggttaagcttctcaatgaagtcatctgaagagaaaaaaacagtaacttttaggaagaaacaattgtttggctaccggtttccccttgaggctagtaatttcaccttccatttgcaaatgtgcgtttcattgacatttggttaagtgtgtgtgggttgcagtggtataataccagtctatctttagtacaatgtcttttggaactaacaaatacctttctaataaaaaaaatttaatgccctaatgtaaaaaggaggaaggcaaaggagcaaatgaaaaacagtagttcctagaagaaaattcatttaggcaggagcctagtgaattgatctccctgcttaatgattagagtatcaagtgtggcttcttattaaagtttgggattctgccaaaatggaacatatgtttatggaccagtgatatgctgtggttctttattgtagcccattttcccaaagctgctgggttttatgagaaaacatcttccttaccacttacctctctaatcatctttgagaaatcccatttttgtaggcactaagcagcattcatttacatagatgactcaaccaactattaccttatgtctgccatgtgcaaaactctggctgagtaataagaaagatcaaaagataaattagacctgaatcttgccctcaaggaagatagaacatttatatattcctgtagtactgacagaaaacgtgtggtataataatgagggaaaggagcaatctagtttttttcctttattgttttcttagttttaaaaaaattcccagcacatagtatgtcttcatattttttgttgaatatatgagagagatatagatcatgtactatgaaaattctgagaaattttcctcttggtgggtatctgggaaaacttgagcagataccgtctaaacgtgcctaggatttgcagaaaagtggaggaagagaaggtacacagttatgaagatggattcttctgtttacagaaagctttcagtgacagagggagagggagcgtggagggcattgtggccaccaggatctgggatggagtgggtggcatgcaatgggaaggaaggtgataatctttgataaagactgaaaagaatgccaggcagcagagacagcaggaacagatactttccaaaatatctgggatgatgaggaaagggtaaaattgttagtaaattaaaggtttctgggatcaaggggatgtttttaattataaggaagccttgacaatggttgaactaattttcactcccaccaacagtgtataagcacagtgtggcgattcctcacagggctgaagacaaaaataccatttgacccagcaattccattactggatatatacccaaaggaatataaatcattcttttataaagacgcatgcatgcatacattgattgctgcactattcacaatagcaaagacatggactcaaatgcccatcagtgatagactggataaagaaaatgtggtacatatacaccgtggaatactatataaaaacatataaaaaaattaaaaaaaaacaatatcctttgcaggtacatggagttggaggccattatccttagcaaagtaatgcaggaacagaaaaccaaatactgcatattctcacttataagtgggagctaaatgatgagaacgtatggacacatggaggggaacaacccacactggggcctatcggagggtgaagggtgg

SEQ ID NO: 1187 - DNA, 2038 bp, Homo sapiens
tatgctcgccccacaacactagggtgtggcagtgagaagaaatctcacagatgccttcctgtgcccggcaggggcctgcggtttcctggcctaccgtctggtgtggtacctacctcctccgtgccggcaacaaccgctcctactctggttctgctgagctccgagcccggaccagtgggcgatgtaggccttcgggaagggagagccccggctctgttttatttagcccagctgctctggcctacgttatggagactggcgggtagattgcggtctccgagtcgcggaatcctctttacgctgggagtggacgggcgagaatgggttggagacttcctgctgtctcagtcagctttgggcgggtgctgcagtggtcaccccctgtcgtctctccgatcctttatggactagaggggtgaaagaagggagtctgatagagtttttggaatcaaactcggagcagtttttctacctaaaccaaaagcatgccccgcgcttcggctgaggtccttactcatcatttgagggtatttacaaagaggagtttaaaatcaaggcattctcatacttttctccaaacaatgagttacaaggcactaatagttctggatccttgggtggtcttgatgttcgcagacgaattcctataaagctcatctccaaacaagcaaacaaagcgaaacctgcaccgcgaactcaaagaactataaacaggatgcctgcaaaggctccacctggtgatgaaggatttgattataatgaagaagaacggtatgactgtaaagggggtgagctgtttgcaaatcagcgaagatttcctggacaccttttttgggactttcagataaacatcttaggtgaaaaggatgatacaccagttcatttctgtgacaagtgtggattgcctattaaaatctatgggagaatgattccatgcaagcatgttttttgctatgactgtgctattttacatgaaaaaaagggagataagatgtgtccaggctgtagtgatcctgtgcagcgaattgagcagtgtacacgaggttctctcttcatgtgtagcattgttcaagggtgcaagagaacatatttgtctcagagagacttacaggctcatatcaaccatcgccatatgagagctggaaaacctgttacccgtgcttcacttgaaaatgttcatcctcctattgccccaccaccaactgaaatccctgagcgttttataatgccaccagacaagcaccatatgagccatattccgccaaagcagcacatcatgatgccaccacctcctttgcaacatgtgccacatgagcactataatcagccacatgaggatattcgtgctcctccagcagaattgtccatggctccacctccacctcgatcggtcagtcaggaaacctttcgtatttcaacaagaaaacacagcaatttaataaccgtccctattcaggatgactcaaattcaggtgctagagaaccaccacctcctgccccagcacctgctcaccatcatcctgaatatcagggtcaaccagtggtatcgcaccctcatcatattatgcctccacagcaacattatgcaccacccccacctcctccaccaccaataagccatccaatgccacatcctccccaggctgcaggtactcctcacttggtatatagccaagctccacctccaccaatgacctctgctccaccaccaataacccctccccctggacatattattgcccagatgccaccttatatgaatcatcctcctccaggacctcccccacctcaacatggtggtccacctgtaactgcaccccctcctcaccattataatcctaactcattaccccagttcactgaagatcaaggaactctgagccctccatttacacaaccagggggaatgagtcctggtatatggcctgcaccaagagggccaccaccacctccacgattgcagggtccgccttctcaaaccccacttcctggaccacatcatccagatcagacaagatatagaccgtattaccaatga

SEQ ID NO: 1188 - protein, 440 aa, Homo sapiens
MPAKAPPGDEGFDYNEEERYDCKGGELFANQRRFPGHLFWDFQINILGEKDDTPVHFCDKCGLPIKIYGRMIPCKHVFCYDCAILHEKKGDKMCPGCSDPVQRIEQCTRGSLFMCSIVQGCKRTYLSQRDLQAHINHRHMRAGKPVTRASLENVHPPIAPPPTEIPERFIMPPDKHHMSHIPPKQHIMMPPPPLQHVPHEHYNQPHEDIRAPPAELSMAPPPPRSVSQETFRISTRKHSNLITVPIQDDSNSGAREPPPPAPAPAHHHPEYQGQPVVSHPHHIMPPQQHYAPPPPPPPPISHPMPHPPQAAGTPHLVYSQAPPPPMTSAPPPITPPPGHIIAQMPPYMNHPPPGPPPPQHGGPPVTAPPPHHYNPNSLPQFTEDQGTLSPPFTQPGGMSPGIWPAPRGPPPPPRLQGPPSQTPLPGPHHPDQTRYRPYYQ

SEQ ID NO: 1189 - DNA, 58540 bp, Mus musculus
  misc_feature (1)...(58540): n = A,T,C or G
ataagagttacctaatgactaaagtgtctttgaaaaacagactgtattgaaatctcctttgccaacagtcttcagtttagcctcaggcacattcttaggacaaaggcaaaaagcagccacattcttggccaaaatatcacaagaatggttctctcgcccagttgttaacagtgttcccttctaaaaccttgacctctggtatccacattgctcttagaactattttattccaaactcctactagaatggcccattaagctctacttacagcaaactttctaccactcttctagtcaaaagccttccacactcttctagataacagcatgatcagggcttttacagcaataccccatttctagataccaaattctattttagttagtttctgtgacaaaacaccatgaataaggcaacataaaagagtttgttgagggcttacaattttagcagatgagtccatgaccactatggctgggatcatggcagcagacatgtaagcctggtgctggaacagtgactaagacatctcatccatcagcacaaggcagaaagagcgaactggaaacagtggggtttataagcctcaaagcctacctccagtggcatgcatcctccaataaggcattagttcctaacccttcccaaacagttccaccattgaggaccaagcattcaaatttatgaacctatggggaccattctcatccaaaccaccacactcaacatgatttcttatcctcaggacacctacttcctcagatagcacagccctcagtaggctgagcctttgcatatcaatcactaaacaagaaattgtaccaaagagatgcccacaggccaatctgattgaggcaattttccaacccctgttcccagatgactagtttctgtcaagttaatataatgagcaagcacactctgtgtggttctgccttcaacctcatgcagaactagttcttttaagaatctaatgtttggccaggcatggtggtgcacgcctttaatcccagcacttgggaggcagagacaggtggatttctgagttcgaggccagcctggtctacaaagtgagttctaggacagccagggctacagagaaaccctgtctcaaaaaaaaaaaaaaaaaaaaaaaatctaatgtttgcagcaatcccagaaatgtgtttttactgccatgtcagatgaactttctaaaagctgattttacttaccttactatagtgatctttctgtatcacagctacttgcctgggtttaagtaactgagtttaaatgagatggacttaatcaactactgtgcaggcgctgtactaggccatctgccagtagccagaatatgccccaaaaaataaatccaagttttttaaatgcagcataagccaaatcagagtagacatttatatactcattaagagagttagataagctgtttagtggtgttggaatgctgagagccaaaaatatctttctactgttgagactgataaaacctcttgttatgtacaataaacatcaaatttggaattttaaaaatgtgaagtaattgcagttaatatgaacacctaaatctgttttggtcgaatggattctaatttaatactctccttggctagggaaaaactatttcctagtactttctggtctaggcaagtgactttttgttgttttcatgaaacgatttagaaatgttgatctatgaattttatttagcgccacattctacccaactaagctaagcagctggctgtagatctgtgaattgtaaatgtctgcttcattccggatcataagctagaggaaaagttcctacactacagagcatttagaactttgtcttcccttgcatgtggttacaatctcccttctgtgcttgctctctcaaggtgggcgatggcggacggttatggagcttgcttgatcaacaagccagagcttgttcacgatatggtgagacaagtgagaaatcgggtggaaagcccaaggttttcagtttccattaagataaggtaaacacaatactctagtctactgacaacttgacatattacttggaagtttaaaaatgttccttttgcctaatgatgtgggagtgtctatcctaaataaattagaagctgatatgtggaaatattgaaagatgtttgtctagcaaacaaacataaaccccattcttaaattatgatcctgatgaaccatgaagcatgtcctctttttatttctttttttgtttgtttgttttggttttttggtttttttgagacaggatttctctgtgtagccctggctgtcctggaactcactttgtagaccaggctggcctcgaactcagaaatccacctgcctctgcctcctgctcttttttatttctttttttttttaagatttatttatttattatatgtaagtacactgtagctgtcttcagacactccagaagaaggcatcatatttcgttacaaatggttgtgagccaccatgtggttgctgggatttgaactcagtacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcttaattaatgttgcattaaaaatctgtgtgctatacacagctgcaattttgaaattataggatccacgatgacctggcaagaaccatagatctttgccggaaggctgaagcaacaggagtgtcctggattacagttcatggaaggacagttgaagaaagacaccagccagtccactacgatgccattaaaatgataaaggaaaatgtgtctatacccatagttgctaatggagacataagaagcttaaaagaagcagaaaatgtgtggcagatgactgggacagatggtaagaaataaacactaggatctttttatcatttaataaggatgaaaaagtgaagatgggggagtaatctaatttcctgtttaacattgaaccatattataatgcggtctttaaaaggcacctagaacaccaaaatagagacgagagttaatgagcttggatggacacaggagccccagaactgccaagtagtttccatgccccttgcagaattaactagccggccccatagtaactgttgctaggcggaagcaaatagattccactttaaacagcctgatttatgacaatgtggatgtctcctaaagaaacaataaggccagtgaattaatggagatgccctttaaaaaatagttgtataaatacaactggtttatcagtaataccagaatcaatttatttcttactgtattacattaatttgtaattaatttgcagttaattggtattctgaaatctcaaaataatactttctgatacgtactcttgcattaagtttgaaataataaccatggattcttagtttatgagcagatatgttgtgctttaatttgcaggtgtgatggttgcaagaggacttttagcaaacccagctatgtttgctggatatgaagaaaccccactgaaatgtatctgggactgggttgacatctctcttgaacttggaactccttttatgtgcttccatcagcatctgatgtacatgatggaaaagataacgtcaaggcaggagaagagagtatttaatgccttgtcaagcacatcagcagtcctggactaccttatggaccattatggtgatgagtcgctttctaaatctttgtagtaggtacttcttacctacatggaaccacatgaggttacagcctcgtatttcttttaagtctatggcttttaacatcagtacaacagcaatccctggggccagacatggcggcacatgtcttttatccagctactcagaaaactaaaggaagaggtttggaaattctaggccagcaaaactttatctgaaagaataaacggaacttttccataaccaagaactcaaacctgggactgtagagatggctcaccagttaaaacctcgctgctcttctacaggacctgagctccagttccaggggattcaacaggcttttcaggcctcctcaggcaccagctaagcacaatgtgtatagacagccatgcaagcaaaacattcatacacataaaactagcaacaatggccacaaaaatccgcccggtactccgtcctcatggattcagtagattgtgagcagacccagaagttgtaaagaactccggagttttgaccatccaataatcccagatcaaatattgaaaacctctgcttctaatctttatgggtgtgcgggatgggtggggatgggagttttactaaaggtattctgtttttaagtgttttaaataaaacttttctaatagcaagacggtatgactcgcctgtaagttaacaagaagtacatcttaattttttgaaagttcacaagtagtagaacaaatgtccacatccatataaatgaaaaagaacaagaaattctagctagaattatattcagtgtacattaacttttgttttgcttgtttgtttttgagacagggtttctctgtgtagccctggctgtcctggaactcactttgtagaccaggctagcctcgaactcagaaatccacctgcctctgcctcctgagtgctgggattaaaggtgtgtgccaccactgctcagtgtacattaacattttacactataaaatcaactggtacattcctaattgaatacatacttgaaggtatttaagttgtgtctaactgagtttagttgcatgtgatgtcagctgtaatttaaaagtaagagtagggacaacaaaaaaggttcagtgggtaaaggtattgccttagccaagcctgacagcctgagttcaatcgcttggacccaagttgtagaagaagagtatcatttcctcaaagttgtcttcaggcctccacatattcacccatgtacataattttttaaaagattgtgtggagctctttgagtaacagcaaatttagttcttttgaatctttctagattaggttactaaagagcttcccagagtactttgttctaccaagatgaaagtgttggttgagaaccctttccaaccaccatttgtatggctttgtcagtgtttatatccccagcatttgacagaaggagctagccttggcaacaggagtgatggtgctctggtattaggattcttatgcaggcctcaagtaacagggcctttagtatccagtgttagaactctggataatgtaggtctaagaagtgggactctccaacctttgacagcagctatttttatagcttggtttcatgattctcaagctatgacttcccaaaccctgaataatggcccctattaccaagatctttggccactgagatttgacagctctctggaactctacaagctgccagtgtctgcagcttctccaaatcttccagcctctggtcaacttcagctcttcactcgctctcacctctttctaccgttcttgtacctgccctggtccctgtgcccagtcgttcaggtacctctttctgctgtgactgccaccacgggaagaacagctactcctccttttgctgctgtgattctgtttgtttgtttgttttgttttgtttttgaggcagggtttctctatgtagcgctggctgtcctggaactcactctgtagaccaggctggcctcgaactcagaaatccacctgcctctgcctcccaagtactaggattaaaggcgtgtgccagcattgcctggctgctgtggttctgttaactggcctcaaagtctgtgtttcctgaggatgtcaaagccaccagctgttcccaagctccactagtacaactgcactgtcatcacaactgccatatgtaagttcagcccatttaaccatggattgataccaacagagggcaaaaagggctggggagagagccaggctactaaggagcttgtagcataaccctgaggtcctagatatggttcccagcatccatgtaaaatacaggcgtgagagctggagagatgactcagtagttggagcacttgttcttgcagaggacctcctttcagtttccagtacctacatggctcaccaacaactgtaactccagttctaagggatctgacaccctcttctatgcagacaccaggcatgcacgtggtacacatacatacatgtaagcactcacacatgcacataagtcttttttaaaaaaatataaaaaacccagttacattgtacacacttgtaatcccagtgctcgggaggctgagacagatctagccagactaggtggatatctaaagagcaacacccaggattgacctctgacttccacaaaaggcatataaacacacacacacacacacacacacacacacacacacacacacaagtgggcaaaaaagccactcaagagaggccttgtattagtcctaagttgctttaccagaaacgaaagcacaagaggctgtcttccaggctgcttgaaaaagaagccaaactgcatgctcatatggccagagaaggagtgtttgcatcaacagtgtgggaccatgtgaataagaacgcacttgtaccaatcatgctaccatccctgttcccctaggcacaggagcccctttcccaggccacgagaagtgcttccctcagagctggactagaaaggttgactatagtgtctcctgacattgtgatttacataaacatcaaaacaatgttttttttaaggacttgtcataaatggtgattttttttttaagatttttaaacaagacttaccactagaccagcactcaagagagagatgaaggtctctgaatctctcaaagattcagaattctggtatgcaaaaagaagaaagcaattgcaggcttctacatcttacgtgtgaagaatctggtagctaatgtgtaaataaatggacatgtctttaagaatcttcctaaaaccagccaaacatcatcaggtgaagccccttgcagagaaatagtgatgacctgaatttgatccccagaacctatgtaaagatgcaaagagaaaatcagttctagtgaatttttgacatatatacaaatgctatagcatacacagtgtccttacacacacacacaacacacatcgtacatagttatagtttttaatttaaaataataactagattttaatattaaactaaattttatagttgttttcatatttttatggctcaatgttgctagcagcttttattaatgaagaacgtgtagacgacaagaagtctctggatgaaataaaggttcagtactaaaatattgctgaatgtcaaaaccagcaagactgtggagagttgtctacaactgtttacttcaggctgtttgaggccatgaatcaagtttaacatgagcactgggctgttatttttttcttggtcatatctgtgctctcatttttcagtttattcagttttaaagatgacgggtttttttttccagttgaaatgaatacagaagtgaggccgtcgttctggcatttacacactaactctgaagggaatgtacaatacagtacagtagtcgcttgactggagtgaggtggactgtgggaaatgagcatggaaaagcagatcccaaccttctgtgctaagttcagcctgcatttttcttccagctacttatgaccagatatctatgtgatacagtttttaaaagcactcacttaaatgtgggagattttttttctgggcgtggggggagttgttttgtgctggggattgaacttaaagcctcgtgtgtgccaggaaggcactaccaataactaagcaagtaaccccaaccctgaaatgtagtctatattctgtgcttacttattcttttaacatgtaatgctcccaatatagttgtatcctatagcagtgtttgtgttaacagtgacggcagtaagagctgagatgtaaccccacgtgcgaattcttttcagagacctctacttgggtgaaacaggaattcttgactgtgccaccaagagaaaaaagaaaagtggcaggggtgggggaggaatttcagaggcttagtaagaagcagaattggagtttattgttttcgagctggagtttcatgtagtcacagaagcttcagaaacactctccaaaacaagaaaacaagaaacaagaaaacgagaaaacaagaaaacgtgagcaagtggtgagggagacattgccatccacctttgccctccaccaccatatacatgtgcactcgcaaagaaggttctaaagagcgtaccatagatttaagcacagacatttttttgttttgtttttttgttttttgttttttcgagacagggtttctctgtatagccctggctgtcctggaactcactctgtagaccaggctggcctcgaactcagaaatttgcctgcctctgcctcccaagtgctgggattaaaggcatgcgccaccattcccggcgcatagacatttctaatagacacttagcagaaggacactacaaacccaaatgaacatgggctgctcaaaagtcatgattaaattaagcatctgagcaactgcacaacagccttacaggggatttttaaccttttgaagttacattctgagatttgcaaatattcacatatgttgaaaacctggaagtatttggagttcccttttagattcctagttttgttaataaaagaatgccaaagctttttttaaagggcaatactattaatttggaattaaaaacaaacaaaacaaaacaaaaaaaaaggtagccaaggggatggagaagaggaggaaaaagacaaaagttacatctttaggcataaagggtccaataacactgccttgttcagaaatgaaggtctaccagtacttccgggagggggcaggtattcagaaatgagaaagcccattatcagcagaaagcttgcttaggcttttggccatccactaaagaaaaacagaggcaggtgttaggcttttctgaattagaacccagaaaaccaagcaagcttactactgccacagggcagaaggaagctccttcaaggagtgccatcttgggatgtgtaagtgctgcgtcgtattaatggaataattatccctcccacctctttaacacatctccaagtgaatcctttttcctggatagtgaactcctggccagcttaatggagacagtatgtaatgtagtatgtaatgttatcgggatgccaagtctctacttggagcagggatattacaggaattgaccagaaagcctaaggagaggcagtagttaggtttttctttctagtgttaccagggaaaccagaggtggaatgcaaagttaaccaagcatgagagcatccaccctcaaaggtttctggggcctatctagttacctaagggaatatggttaggtaaaggagtagacccagcagttcccacaagttgcctggtcttgcctatgggcacggtaggaccaggaaaacagcatgcaaaacacaaaacgctccacagacccccccaggcctgggccatgacttaaattcagtttagctccgggcagggaggcaggttaccaccctagggcacctggctgggtcccaccatagacccgggccctggctcccgtcatccggcatcagccgcatcggggatcagccctccggggataccgagcccacgtggaggagcctcggccgcctcacgccgnnnnnnnnnnnnnnnnnnnncccggcaggccccacgccgcgtgtctggccgttcacccatgtttctctaaaattgaaatctttctctgtataggtgtgaagaaaaaacaaaacaaaacgatgacaatccaatgggcggcggttgccagctttctttatgctgaaataggactcattttactcttctgtctgccctttattcctccacagaggtaggaaaccgtcagatccttaacagtaccaaatgtttgattagcttcttcaggctacggcgtgcgatgctctttgtaaggttagaaagttttgggagggccggcggggtggctcagtaggtaaagggcccttgcagccaagggagagaatttcagttcgatacccagaaaccacctggtggaaggggaaccgactccacaaagttgtcttctgacctccacacttccaccctgggacgcccagaaacacccatgcacgcacataaacacatgatgaatacacatgcatacatacaacaaatggataattaaataaaagatgggagccaattatataaaaggtagtctttaaaaatgaaactcaaatttgcaatctggtaactattaaaattctactttatataaagcttgattctgtgtacaaatagattttcacctcctttttaaaagaacctaagtttttttggggggtgggtgtcttgattacaggtataataaagccatggttatgccatgggacatctttcctgtctatatatctatattctctctctctcttctctctcctctctccttcctcccccttcatcctcttcccccaccccccaccgcctcttcatttctctccttcctcttccccctcttcctctctccctccccttcccctaaactgccctgcatttgagcagagaaataaaaggatgggtgcaaaactgtttacttgggacaataaaatggactggctcagggtccacgcagtctttcaaaaacttgaaactcctcatctgcttggtttgcagctcttctctgtcctggtctccacaccatgccctttccttccctcacaagaagcagtaactcatactgtaggaagggatgtaccaagttcttcccaccaaccatgggttctatagatcacatgcttaaggccagaaaggctctgttccataacctaagtcacctaactggtcagtgtcagactccagatgagatccttagcttacagtcacacaatgctgtccctgttctttctacctcagatttcaagcagacatatttggtactacttatgacagtctcacacatattcaagaagtcatttttttttatgcacaacagatttataaataaggcttagagctttgataaaaagaagtcatcaggaggattgatagagcagtctttttcttcttgccatttacagttttgtacccatcctgatctagtagctgttagatgaaagtgtgaatcggtgcacatgacatatgaatattgtcatgtaagaacatgtggtacacatgtacaggaatcatctgtgcccctccatgtgtttatccacagtgtgtatgtcagtcataatctttcaaagtcttcatttagtctgtctagtcttttctcctgtagtgaagtggttgatggttcatgcatgctcagaataacggctttcatttgacttcctgttgtatgactcagaaattttttcccttctctggtcagttttcctggtaatagtggtatagacttcatatgatattgtggtaattagacgagatggtgcatgtgttccaaccaataatacatcaactcaataaataatagttattatctgctcttaaattcagtctactgaaaactcctagatggcccttctgggaggttcttatattccctcttttattgactcttgaagaggtgaacaaatttacatttgaacctacaacaagctattaccatttatattctttttttttttaaatgtttgtagtgttaaatttaaatagtgcctatagaaaatgctttgagtttggtcaacaaggcaaaaagcactgattcacctgtgtctgtctcctccccttcagctggaggttactactgatcattcctttcagagtgtattaataatttgtcatatcttaaagtgacaattgtcagttgtgtttgtgaagtgtagtcacacactaatcaccttgatacctccttttgacccaatgtattatgagtttaaaatgctaaggtgcagcgtttgagacctttccagttacaggacggatggctcagccacttgtaactcatcgtttctgtggcttggcttgtgccgctcactctgtctagactgttcatctcatttcctctgtgttcagaccttggcctaggtaatgagtaaattatatgagcatttacatgtgtaaatgtttattcgtaaaagcttgttttttttcattttgcatatatgccatatctcagtcattttagattcctttttgggttaaagagagaaattacttttttttacattacttagtgtagatgggagaagcacatcacataaaaatcaacctgcagaagccagacatggccgcgcatgcgtctatctgcagcactttgcaggctgaagcaagaggactgcaacttcagacacagctctggcaagttccatgccagcagaggctgcccagcaaggcactgtgtctaataaacagagaattaggtgttcctaattgttagatcaaaagacttccgacatttctgagacagttctctaactagggaaaaagaaatagctttcatccaagatgtgacagattaagaattttctgttgggctggtcagattggtaaattgcctgccatacgagatggagaacctcagtttgattcctaaaatccgtggggaaaagtcaggtgtgctggctgcagaggcgaataatcccagtgctggtgaggcagaagcaggcaggtccttagagctcactaggcagccagcctgcccatcagtgagtcccaggatctctgtgcaaggtgggcaggctgggctcctaaggaccaacctctcagactggtctctaccctcccactgtggagtccacgggagtgcgtgcgtgcgtgcgtgcgtgcgtgcgtgcgtgcgtgcgtgcgtgcgtgcgtgtgcacacacccatgcctgcgtttctttccaaggttctgctcatcgtgaaaaggaacttctactttaaaagttattttcagtcaggcagtggtggcacacacctttaatcccgctactcggattgcaaaggcaggcctaactctgagttcgtggccaccctggtctacagttctggaatgaccagggctatccagagaaaccctggctggaaaaaaacaaaaacaaaacaaaataaaaaagttattgtcactttagaatatataaaccatcaaatatcatagtatattattttctatttcatgagttatgatgtcatgaaagaggatgaaaaacttttaaaattaaatgtctttaatttttgccatactattatcaaaatatttcagtattttacaatagttcaagaccagctcttgatttgtttgttgtttgatcgtttgctcatctaatctaattgtattgctttacagatggcagaagattttttcatttagtgtctggggtaagattgcaagtttttggaacaaagcttttcttaccattataatactattgatcattctgtttctaggtaagtactaactatattcctcctttgaatccagttcttttcaataaattatccgggttttgattggttaggttgatgctattgagatattgaaagactattttttgtattgatattaaggtaattatggctattttgatacctatttggtactattttatatactcaaatttcaggtgcagtgattcttaacctttctaggttactttaaagtttagatacaatgtaacaagtggccttctttcaagttggcagatgattgacagttatagtctttgttagtgttgtcctgggcacccaggaacttgacttatatgcaacaaacaagtagaataataaactcttaagagattcttagacaagtgtgagtcttccctgaaacctgattgaaagcaacagctttagtggctactgcaatttttttaaatatgaagtgattgttaggtaatattggtaaatttttgctttagttgtgatagcagtgttgtatttcatctttatggttcagaagcctatatctgtagacacagttttattgaaacgtcaccattcttgcttttgcatatagtgtgccttagttagggcttcattgcagtgaggagacactatgaccaaggcaacccttataaaggaaaacatttacctggggctggcttacagtttcagaggtttagtccgttatcatcatggtgggaagcatggcagcatccaggcagacttggtgctggagaaggagctgagagtgctacatcttgatctgaagtagcttgaacatgggaaacctcaaagcccatctccacagtgacacacttcctccagaaaggccacacctcctccaacaaggccgcacttcctaatagtgtcactccctaagggccaagcattcaaacatgagtttctggataccatacctattcaagcaccacatggcctatgcccatttccatagacaactccagagtttaatattgcagctggtaagcccggcaaacatccattgcctgtccctttccctaaaagattagttgtctatcccttggattaaaaaaaacataagttcctaatagtttttacataggaatatatctgagaagatgcatactaagatatttaggggaaaatatcaaagagactttggactgaaaaacaaagcaaatatgacaaattcttcaaaatttgaattcctatgataggattataggtgtgtgcaggacagattgagcatccccaactaaaaattccaaatttaaaaatttgaatctaaagaattgaaaacatttttgcacaagcatgctggcacaggtagaaaatcttatccctcattttgtatgatagattagagtccaaatccaagaacagtaaagacattgtctgaaattaacttcaggcttacagctgtaaagcatgtgtaaaatttaagtgtatttcatgtttacatgagtaatatttaaaacatgaaatttcaaagttcttaacaacagcagcaaaaacagcctaaatccaagcatgtctggtagtaggcattttacagaaaatatgcagcctaaatgagtttttcaacaggtcagaaatgttcctggcaatggtacttcatacattaaaagtagagctttaaggtttccaaagcagaaattccacaagccttcataatctccatgttcttttagaaacgactgagaccagcaagattaagtgacttgtctaagattgcctacccacttcttacaaatgtcactccttgctactttagcttttaatatgtattgcaaactgttttccctaggaacttcctcctaacgctcatgttgtgggttaagtgggtttactggtaccaactgggaaccttcaccactgtacttgatgtcgttttatgaaaaactgagtctgttccgaacatcaatctttttttttgttgtttcttggtttttcgagacagggtttctctgtgtacccctgggtgtcctggaactcactttgtagcaccacgctggcctcgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaagtgagttccaggacagccagggatacacagagacaccctgtctccaaaacaaacaaacaaacaaacaaacaaaaccaacccccaagaaggaagttgcatcaagttttgaatggatttgtattttacttgaaaatgtcactatttgtcatggtctgttattgttagcattgcgcactgaaacttcacccatataacaacacaataaaggagtaaagaagtagagagaactgataattactgagctaccaactacctgaataactttggaatggcattctgtctctcttagtttgacaaatgtatctgtgaagtaaaagaataagaaataacctcaactctttaaaaggtatcaaaatgtctactgaaagctgtcacctgtgtaagaaaagagactgtaactttagtggattcttttggctatatttatccaaccagcttaccctcacttgagcaagaaagaaaaatttaaaaaagaaaagaaaggaaaagaaatttataataaaacagttgttgtttcagtgaggtgctggtaaagggagaagccagattccgaggaaggactagctagtgctggtaggtgaactaccctttgcatctgtacatgtctgtttattcttacctcgatggactctgggaactccatctccaaggcagaacatgttaccacacagctgccaggtaatccatgtgcaaaagttaactatgcagccaggtggtgggtgcgagcttttaatcctagtgctcggaagggagaagcagatgcagctttgtgagttcaagaccagcttgacctacatagtgaattccaggacagccagagctacaccctgagaccctctcgaaaaaaacaacaaacaacacaaaaatctacctttgtgtatgttgcaacatagagaaagtgagctaggatgcctaatggtattggaaataaagagtttcagtcaaagagatggcatacaaatgtgaggtgagaaaatggaaccttcttgtgcggagtgatagaaagtggcatgattcagggatagtgcctgtgaactgctgtcaagtaagtgcagcgttgcctgcatctcatttaactagtctgtgcagatagaaatgtcaatgaggcgaaacagttctgacgtctcagttgtacaaagtaatagtataataaggtgctggcactttaagagaggctggattatatctgttgctgacagcaagttggattttagtcatgcatagaaatggaaagagtcagagataatatttcacagtagatcaagacttgacagtaagatgataagtgagccccagacgaatgattttaaaatgctatagtgctgattaataacttgccactactatccatttacaaacgtccatctttaagctcaataccctgtcaggtactaaagagggacagacagaaagaaaggcatatctaaagtccattatttaaaaggctggtaggttattctacaactccttcttgtttaaagaaaatgctttcttaaaaactaaaagtagcgtcctctgtcttgtaacagatgccgtgagagaagtaagaaagtattcgtccacgaatgttgtagagaagaactcagccatcagaccgagtgcctttgagcacacacagatgaagctcttcaggtctcaaagaaatctgtatatttctggattctcattatttttttggctgtaagtaaaaaaaaaaaatttgctagcagttgtatcactcatagaactcccctttgttttttccacttacactaagatcttttcattgatatcttcataaaagaatgcaaatgatacactcaagtaacaaatctcagtcacactaaagaacgcttggaatggaagatgttgcctttggaagggaagagcccatgaattggttgtccaatgccaaatgttcagccctgaaaacatacatccaggtagcagtatatggactgaacaggctatatttaggaatatatatgtatgtagatgcaataacaattagtaaaaggggggaggagggaatgaatttgaaggaaaattgtcaaagatatgggggagggtttggagggagggaagggaaaggagacatgtaactaaattacaatctcaaaaataagggggagttagatttcgtagatctgctgcccgcagacggccttgagtgatcaggtggctcaccttctggactgtctcttgctgttctccaatacatgcagtacatctcattcccacgctccttttttcaaaaaaaaaggttactgtttatgaaatatctctgctcttcccacttgagtcatcctacaaactattctagaaccctctcttgtcctcccagtctttgtttgtttgtttgactggggtttgaagaatagctatcgttagggacgaggaagcacataacccagcaggcacacagagataaagaccgactgcaaagccaggtgctagggaaggacttgggaagttgaatcccggttggttttatttctgagacagggtctcactgtgtgaccctggctggcctggaacctgttgatataaaccagtctgaccttgaactcacagatatctgaggcctctgctttcaagtgctggtttaaaggctaagctgaccatagctgaccttctattttttatttaacttttacttatcttttagctttttcaaagaagccctgtggccatcagttcctccaaagtatgcagatcttctgttaagtcctgacttcaacttctggtgccattcacaactgtaattaaatactgcttatgtctccagctagaagccagtgcttgggattaaagcagacacaggcagatctctgtgagttcaaggccagtctggtctacagagtgagttccaggacagccggagctatatagtcagaccctgtcttgaaaacaacaaaaataaacaaacacataaaaataaaaaaatatctccaactagcacttaaacttgaaggcaagaattaagttccctttcggctatggccctctgacctaacatactagttcattagtaaatagctgctaaaagaataattgaagagattaattttaatatctaatagtggggcttatatgtaaacatgtcaatattcatttttttgacttgtgcccccttataaaatgatctttaaactgcaatttttttttttttaagtggagatttttcttgctgaccttgcaataccatccagaagccagtggtggcacatgcctttaatcctagcactcagaaggcggagacaggcagatctctgaggtcaatgcttgtccaggctagggagtgagttctagtacacctagggatatgcatagaagccctgtctcaaaaaaacaaattaattgaaatgtcacttgactactttaggctaatggcttataaaagggaaataacattgtgtgcaaggagcttcgagagaccactccatctgtgtgtttgtttctgcccttacacttgcaactccccaccccccacatacacacacaaagaaagaagatagaataaaaaaaaaatttgttgtggaaactttagtgtgtcatagtgtgtcatgtagtatatacccttttgttacttgcaaatgttcatcacaatgagtggtctggtttgagcctctggattctgctacactatctatactggatcctcaggtgcactcctcttggataccttcctgttaccctgtgtcatggagatcctgcagctttgggtctgcaggacccttcccttcacacaccccagcagatcatagatgggatggatattgtggtgagccaacccaaagcccttgggtttgggcctgggaggtagttgagttggtcagtcagccaactctactgcaccagcaccagcagggcgagctctccagcactacctcagcttagctttcccaaagctgcagatggcgggggcaagggcagctctccagctctgtattctaatgcttaccttccaacagaggatgcaaaggagtgaagctcagcttgttttaactgacagacttggatagcaaaaaggaaatgtcccatttcaatgccgactccaccaccatttctgtagctctaacaggaattatttgacaatggctatttgtgttagagtcagagttcccggtgattaatctagttacgcattattttgaacttggtttgtttttcccctcagagtgttgagacgtctggttacgcttattactcagctggcaaaagaaatagcaaacaaaggagtgcttaaaattcaagcagaaaataccaataaggctgccaagaaattcatggaagagaatgaaaaactaaaattggtatttaattttctttataaaaaaaaatgtgtcgatgttgttaatattcacaaggagaaatgtactatttttagcatcaaaaatagcattttcataatttatcaggagaaagtgacagagacaatagccttgatctaaggagtgattactgttgttgttgtttgttgtgttttggaaaaaaaaaaaaccctgtagatgaagctggccttgaactcagagatcttcctgcccatctgcctcttgagtgcgaggttaaaactgtgcgctattctttagcagcttttgggatagcccctgttccagttgttcaggacctacataaagactacactgcacatctgttacaaatgtatagagaggtctaggtatagcccgtgctccaagagtccatgttagttgattctgtgggtctttctgtggagttcctatctgcttcagggcctgtaatccttcctcctattcttccataagagtccccaggtccatccactgtttgactgtgggtgtctgtatctatctgagtcagctgctgggtggagcgcctcagaggacaaccggagcatgcatatttttaataggtttttttgtaattgaatttcttcttaaacaatttcatacatgtatattctgtttactcttacccctgccccccttgccccttcccacccatcccaaatctctgtccccccccctcctttgtctcctctccaccttcatccattgttggtttgtgctgcactgagtttaaccgaggccttctgtgcccacacatttggagctctccgttgtaacttagtgggtaaccactgggtgcacagctgatgaacccctcttccagagtctctcagtagtcagtagttcaccagggaggagtaggccctatggccgtctgtgactgtctcttgccaggggccagtcttgtactggcccagtgcaagtaaccatagctagagtgagttgaagattacagggaccatgccatacccagaatgtggcatcttatagccattcttggtttacaaatttgaagtcctctgttaccattaattttatttcataacctctaaattaaatctttataattttctgtgtccatttctctttcagttaaagtatgatttgttttatgagaagtagagagaaattattgagactacattgatgatttaaataattttaaaagtcctttttacaatttttacgttgtttgtgtcttctgatatccacacaatgtgtgtgtgtgtcaaatattgaggtttgccctatttgcaaaaagaaaggaaggaaggaaggaaggaaggaaggaaggaaggaaggaaagaagaagaaaagaaaaggaaaacacaaaattattgtgaattttaaaatctaatgatcttatagattcagcatttcagttcataataagtccatgagtttttcctcaaaaaaaaaaaaaagtctctggaactgttaacaaatgaaacacatttttctgatgaaagtatttttatgatcatgcattgagattatttctctattacaaactaaagaaatatagtctccatgttaagtccatgccatgttcagcagtagacactgaaagcccagcctttaaaaaaggacctgcctgcaagtaccacctgccatcagctggaagccaggcagccgtcacgtgaccagtagagttcagcgctcataagtctcaccgcctcctactcagaacttctagcttaccttttatggtatttgttagatagtaacaaaataaagaaggaaagacctcctttcatagaaacaggatttttaaaaatggctctttctgaacaggttgtaactagcatcttttatggaaacagcgtgttataaacagtttatgttttactttgttttgttctttataagaaatgattgtggtgtctgcatgatgtatggagagggcgggcatgggcatgccacagcctgtgtagttaggaattagctctcttctgccgtctttacatgagtgttaggggtgacctcaggccaccacgttctcatagcagtgcttttacccactgaccgctcaccaagtttattcggatttgaaaaaaaaattgattgatctattgatgtccctcttaaaataatattgttctctagaaatcaagatgtaggtatggtctgtattaaaaagctagtaataagtactttttgctttctttacagcacaatcaatttcattttgtacttcagtgttgtttgcttaattttcgaccttttgatctattccagagtgtaaaatcatcgtctagtgtttgatgaccacattcaaaagccccagctctgtgttcacgggagggctttcatctctctccagagctttgaaactaaccaccgctgtggtgcacaccccctttacttgttttcctcctaatcttgaactgtgcgtggacagttttttttaacattttttataaaatatttgtcacatgtacatcataactaacagagttaaattagccctgtccttcaaagcaacccttcaagagaactttagaactcttcctttggaattgttttcaaagccagtcactcacggtagaaaattgatgacctgcttgctgattcctggactgtccacagtttgtctttgattccatgctgtgctgactccctgactgctgtatagctgggtctcagtcagtcagtgctagaccatcagaagaagaggcacagtgggctggactatcagataagctacactaaagctagtacacgtgagaaggaagtttgtaaactggataaatcctgtctaactaatggggatgtaatcaataaaagccataggcaagaatgtaaaaaaatgccttttttaaaatttcatatgggctttgaaatattagtgaaacaatgataaaattgctaaaatacctctttatatagagagaatattatcctacagaaaatatataatcctgagattcagaaactttcaattgggtactaatttcagcactacagtaatcagcagtgtgacctagggcaagtcacctaggttttgaatttcaaggttctgtgcctataaataatagttaactctatgccaattgtggttttaagtgtttcacagtaagatattaactcttttaattcttaaacaatcccatgcggttgtattgtctgcattttctagctgagaaaacagggagagagagggtaattaaaaaaaaaaaaaaagatacagtagaggaagtttgaggccatgcagcctgactgtaacccctgcatttacaaccactggctctgtaccctcaactcctgtgctgtcctatgaaaatgatgctttggtgcacaaagcccatttctcatcaaataattcagtcaaagaaataagatagttatgaaagatcagttagttgacttttgtttacttttcgaggcagattctctttaagtagcccaaactgtccttgaaatcacaatactcggcctggagagatgctgctccctggtaagagcacttgctgctcttccatcggaccctgagttcagtttccagcacccacattgtggctcacaaccatctatacctctagtcccagggtatctgataccgtttctggcctccatgggcaccagtacacgtgatacacagacatatacgcagacaaacactcatatacataaaaataaatacatctgagagagagagagatcacaatcctcctgcctcatcctctcactctgatgtgtgcattcatgccttgccatcagttaatgttaactaaaccgcttcaaaatggcggcatgaagctttgctctctcctgcctcctggtggggataaggcggctggggtagcgaagacttgtgctcttgtggcggggctgctgagttgcagactgcagacctctttcttggtctttctccagcatgaattaaggataagaaatggcagcagttttccaggtgcaggaatgaaagcttatttacaagcctgccgcaaatccagcttttcccagtcggcagcataattcaggcagtcagtgtaaacattcctgcagctcagtggtaccttcccaagtttggtcatcatccccactgtggtcgtcatccaaagtaagctgtgtgtttttacatctattctgcctttacaaatgtaacccttcttttctaggctaaaattgttttgaacttgaagtaagcaacaaattaaaattaggcttcgagaagttctctctctgcttttctagaggcgacttttgattctcaaaggtctgatggctttctgtttcaggctgcttgaggcctccactctcctccgtgctgcaggagagagtgtgttgcctggagctgtcgttcctcctctgctgcccactcctaccctattcccacattgggggggggggggggcatgttcttggtttagctttgatgtacctgtttttcctttccattagatgaaagctaccggacaaaggctatagagcagctttctcttcatctttcatgctaaaatgtttgcatccactcattgctcactagattctgtgagttttatctgataaattacccactaatgatagaaaatgaacccctctggtatagacaattttaaatcaccatgttttccttaccgtggacactatcagaaccaagctgctgccaccacgcttactttttttttttttttttggtttttcgagacagggtttctctgtgtagccctggctgtcctggaactcactctgtagaccaggctggcctcaaactcagaaatccgcctgcctctgcctcccgagtgctgggattaaagacgtgtgccaccttgactggcccacgcgtgtaaatacttacattgattttctattgatgttgttgggtgtgttgaggagaggggtactagtccatgtgcatgtgtgtgcacatgagcatagaggtcagaggtcaacctcaggttcattcttcaggtactattcactttgttttttaaaacaagatctctgattggcctagagctcctagaataagctaggctgattggccaaggagtgtccagcttcctcctcctgtctctgtctacccagtgtaagcaggctttcccaagcccatttccctgtgtgggttttagggattgaactcagtgtgatcacactttactgactgagctatctcatagctctcatagatttaaaatataatccatctttctttgtaacttattttatgcttcttttaatctagttctaacttacagtaacagtgatgatttctatctaggcatgcaagttaggaatttcttcatattttttattggttatgttatttatttacattttaaatgttatccctcttcccagtttcccctccacaaagcccctatctcttcccctgatcccctgcctctataagggtgctcccccacccgcccacccactcccgcctcagcaccttcgcattcccctatgctggttcattgagcctttataggaccaaggacctcccgtcccattgatgccagataaggcatcatatgcagctggagccatgggtccctccatgtgtattctttggttggtggtttagtccctgggagctttggagggtctggttggttgatactgttgttcttcctatggggttgcaaaccccttcaactccttcagtccttgccaactcctccattggagtccccatgctcagttgatggttggttgcaaacatccacatctgtatttgtcaggctctggcagagcctctcaggagacagctttatcaggcttctgtcagcaagctcttagcaccaacaatagtgtctgggtttggtgtctgcagagggaatgtgtccctaggtgggacagtctctggatggcctttccttcagactctgctccactctctgtccctgtatttccttttaacaggaagaattctggattattctttttggggtagtggggaaccccatccctcaaccaggggctgtgtctatccactggatttagtctctacaggttcttggctaatgtcctccctgttgggtcctgggagcctcttggaagttaggaaatttttagtctatgatgttttttgggagctactttactgttcaaatctgtatattattcttacctagaaaagacaagctacagacattgttagatccagattagattttaaaatataaagagtattttaaattatcaactacattaaaaacattaatttcatattgttcaacgaaaaccagaactttcctcccctgagatcaccctgccctttcccattcttcatcctggcaacattgcactacgtacttccatgtgtacaagatagtttccagcagacaggatagtacaattgtagcatgatggtttgcacatgaagcataaaaaccatcctgaaccaaagaaggcaggcacagaattctaactgtcggccaatcagaaaatcctcctttcatctcagagacatcatccataataagagcaaatcttctgtgttttgtgttgtgttgtgttgtgctgtgttgtgttgttctgtgttgaggcctctcagctgtaatacatcgtttataaaaatatttttatgtctatgtgtgtccttgtgaatgtgtgtgggtagatgaatgtacgtgtagttgcccatagagctcagaggcactggattcccctggagctagctttatagggagttgtaagctgccccactaggatgctgggaatcacactcaggtcctctgtaaaagtgtacgtccccttaacagctgagctctctccccagcgtcacaacattttgtgtgtttgctagctatcaagttccttttagtaaaagtactttataaaagatattaaatacttaaaatgacaacttaataaagaccaacaatttaaatttattcaaaaaaatatccaactgttacaatataagcttattttttcttgtaactcttttatgataggggctaagaaatgacaatgctgaagaacaccttttggaagctgaaaataaaaaactaatagaaagcaaggagaacctgaaaaccgagctgaagaaggcttccgatggtaattttcatgcgtgcgtaaggggaaggactgtcagatattttatgctgtcacatacgcctcgttggtttactttaaacaaaactaaatgccctctggccaagcactgaggatgacttattcataggtttctattcaatatgagattgaaactttgtgccaagagaaacatgttctgttgtgcagaaaaacatgtaggtgtttcagatctgtgttgtaaatacaaatgttcttgcctcagcaaaagagctgtgggcttgaaaactttcctataaacatggttttgtaaaaatcagtcacattttcttctgtcatcatatattatttctttgatagaaggaatcacaaggagagagccttgatagaatagtgcattgcttatcttaagccttaatatttccaacacataaatttaaaaaaaaaaattgagaaagacaaagtaagcaccagtctgggatatcagttgagaaactgcactgtaggatcaaattggtgcatcctaaatctaagtctacaaagccaactgttactgtgctgaaaaagtcccagtagttcttagtatatcaatactcatagtaaagtcgatactccaaacccatcgtcattctaacaacatattgagtgtgggtagcttgacacccctccccagcccccactgcaggcagtgtgtcagcatgtggaggcagataatgctagacattggccagacacaaggaaacctgccaggtattcatggttaagactgttggctaaagtgatggtgaatgcataggccttctccagtttcaaatctcttccactactttaggttgaaggtaaataggattcggtgactaaatcaagacctacttgagatcattacgagtttaggtttcctttaagttgctctcagcacaatagaagttctctgaaatattacttgctattgttaaagatctatttatattatttggacaggagtaatttcatggaggcatgtttgaattttaaattgaaattccaaagataaaagctaattctatatacaaaaacccagatgaggatatttcatgtgctgcataattctttagtcaacttcactatatttttttaatttttaattttcttatatgtgtgggtgttttccctttatatttgtatgtgcactacatgtgtgcctggtgccctcggaagccagaagagggcatcagataccctagaaatggaattgtagacggttgtaagcttccacgtgggtgctgtgaactgaatccaggttctctggaagagcagcatctcatcaacccctaaaatgtgtctaaatttaggccgtgaaacaaaagcagcagccaaagacagcttagagtcagtgcattagaaatccagaccccttctaaacaagattgtcccggtatagctgcagactcaaaagtcttcttttcatttaatattattatatctactgtaattcaaaaagatgtagatatagttaggaaagtttaacatttatgcaaaaattaatttagtagttcctattctctgcaatgatgatttttttaactcataaaatgttcctattaatccttttagagaatgtaaggaagtatttcaaaagtacatttaattagtaaaaataatgttacaaaatcttttttatatctgacagggatctcttattttgtgagtagataatataacattaaaaccaaaacaaaccaaaacaaagccaggagtttagctcagttcattcaatgtttgtctcgcacacacaaaactctgtatttattccctaacacttcataaactaggcatgatggttcacgacattgatgtgaaaggggtcttacctacagactgggtttcagaccagccttgccagcataaaactgtagtaatattaataataactgttgttgttgttattattattattattatttcagtcaataaagtgcttgtcaagcaaggaggacctgaagctgggcatagtgacatacacctttaatcccagcccttgggaggcagagccaggcagatttctatgagtttaaggactgcctagtttacatagtgagttccaggatagatagagctacatagtgacagtgagatctgtcttgaaaacaagcaaacaaaagaaggcctgagttcaagccctagcagccgtgttaaagccagcatggtgacagtcaactatagttagagctctggggaagcaaaaacagaaggatctttggggcttgctggcctaagtctttgtgtgatcagtaagcaaccaggttcagtgcacccagtgttgacctctggcttccataagtacacagcataaataaatgtaaaaagacaagaagctctagcaaggttgctcagcagtaaaagtattcactgccaccactcactatctgagatggagccctaagatccacgagataaaaagcaggagccagctccctcagcttgtcctcttacctccatgtctgtgcttgcacgcattgtcacactctctctcacacaacaaacactaagaataactgaatgaatgaatgaataaactgtaatgttttccaaatatgataataggtgatgttcctctccaagcaatttagtttcctctttctttagcactcaaaatttatgatttacactttacaaagctgaggcttgagggaggctgaggtgtttaggatattcagtcaggtcaaagccacagagggagtcagatgcacactaaaatttaaaaaacaacttgtaattctgagatactttaaactttagcttcttaatcctgattaaaaccaaactcaatattgcttcagtatttatttaacagaaaatgtgggtgtttggagaaaatgaactctttaataatattggcattgcgtttataatctgataagaagctatcggtcctgtgttgaaatgtagactctctgactcctttcaatgggagtcagggttgaagtcaaagcagccttgtcctgtttgagtgagtcttgtctggttcctgcaaggtgtgtaatattttctgaacacatttcattaacatggagtactgttttaggtaccttccttagtgaccttgagacgctcaaaagctctgtttccagagatgtttctttggctgttttctggacttataccagacaaattcatacagacaagactaagaaactgtatcagctgataaagttttatatgattaacagtacagtgcccaacacacagctgcatcaaatactcatttaaatatttccaaaattggggatattaagatgacattgcttaagaacttttcagaatgatcttttagtcatcctggtatgttataggctgtttcccaaaggaattttctcttgtgcttctatgatccatcttaaatattttctccaaagttatttagagaaaataaagtactaaatataaaggcttacttaagccaattttagcgccaaaacagaaaagtagtattctttactttattcttacactctcccaggggctggaaaaatgactcagcagttaagagcacttgtttctggactagagagatggctaagtggttaagagcacttgttgctcttccagagaagcagcgtttgtttgccagcacccccatggcggtttacaattgtgtgtcactcagttccaaggaatccagtgctcttttctaacctcctggggcttctgcttgcacatagcgtatatacataaactcctgcacacacatagaataaatatttttaaaagaacattatactagtaaatattccaattttaaatccctggctcagattttgaccagttagtaagctatttctgtgtttcagtacattaatattatctctgagatcagaagagagcacacatatcccagagcacctaatttgtactcaagacaacctagtcaggtgcaaggatctagtctttcactttaatagtccatttaacaataagtctgctatcccagtgtgttgagtaattgggaaagggctttgttatgaaaaatgagatcctaagatgtaaagaatttgtaaagctcataatagaaataaacctgtgtgtagaaaacctactgttcaaaagattaacttaaagacccttcagaataattagtagttgttgttcctacaactatatcttcctcagtgtttcttcttatagctagaggaaatatctagaactcaaatattgaatgcatttaggccatggtaaagctacatgggacctaactagacatgacagtacctgtacctcatgcctttaagaacaggactgtcacaggcatggtgcaccctaatctcagcaccagagaggcagaggcaggtggatctctgtgagttcatgactagcctgatctacaaagctagtttcagaccagccaagctgtttgttatacagagaaatcctgtctcaaaaaccaaaacaaaaatacaggattacacttgtaacttgctttacttaaaaagaaatcattagggctgccaaccttagagcaaaggttatccagcaattcatgcctccttaaaaaggaacctgggagaaagcatggaaacctataatactaggattacaggggtgggagacagcaggatcagaagttcaaagccatgcttcactacaactcacaatcacattcggcctgggcaattagagactgtgtcagagacaaacaagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatacctcttaagggaaaagcaaatttttaatgacttttctagataaagcgtgtctagctaggacagagcctgagtgtaaagaaggtacgtgtacctaagtgctggcagcgtgcaatagagacttcagtatggggccaggggacagtagacttgtgtgccctttttaaaatactgttggttcaatatcttcctaggtgaatgtctattactttgccataccttgaaaaaaaccctaaaattccctttcatagactgcctttataacctcaaaatatatatttttttaatttctttttttttttttaccagtagttaagtatactaatgtaggaatcagagactgaaactgctaaatgcttttcaatagaaactgaaaatcaaaaccaaatgcagactcataggacacttctattctgtatagccagacgtctatattcctgcctgagtcttaaggatcatataagttttatatgcaaacttaaattataggttttccagttcctgcagataaatcatttatctttctaaaattaaattctcaaagtctaattctggatacttctaatagtaaaattattgtggacatgagccatgaattaaactattcctttttctttttcttcttatggtagttttgtggcttttgtttttgttttatgttttgtttttttgttttttgaggcaggctctcatgtaactaaagctgctctgtaattcctgatcccctgccttaacccttaccttgcaaatttagttatctaactgacctagttgacaatagctttttaaagtgattaaaacctatgaccaatccttttagttaggcaagtaattcatttattaactcatctctatattatcttgtatatggatggttgatgttattatcagactatacaacgagtcttgctttctataacattactttcttagagcctggcagtggtggcatgcgcctctaatcccagcagtagggaggcagagacaggggatctctgtgttcaaggccaatctggtctttaaaaaggattactttattaggacaaatatataatggtgatatgttattgtttatttcctttttacattcccattcaattatattttccttttctgtgagctcttcattgtacccaaataaatataaaatcacctataccaaggaaaagcttttgtagttaatacagagggcattagcaagagaaaacagactatttaataaagatcatatagtccagagaggtgtagcaaatataagtacttaacaatatttttacttccttctctaaatgatacatgaggaagttacccaaaaaagcatgaatagacacagccaactgcattatgaatagagaaatgttctaaggtcaatgaacacagttctctaaatgtggatcaacttaaactggcagagaatggatcaatgacattactctgttgagtggagcaaagcgtatgattgacaggtttgttgatgtatcgtcctaggaagcagtaaattgtggagataaaatgttgggtcccctatgggggaaaaaaaaaagagagagagaggatgtcttttttttttctctctttcaagacagtttctttgtataactttggctgtcctggaactctgtagaccaggctggcctgaaactcagatatccgcctgcctctgcctcccaagtgctgggattaaaggcgtgcgccaccactgccctgcttaaaagaatgtcttaatatcttgatgttcttttgttgtacttcctaactcggtatacatgtttattaaagacctttatggaaaatgtttttataatgattatagcaccttataggaacttattttcattgcagagggagttacagaaaaattaaactggacagcttgtctaaaaatacttaggaaagagttggagagatggctcagtggttaagggcactgattgctcttccagaggcccagaacccacatggcagctcacaacaatttctagctccacttgcacaggctccaacaccctcacacagacatacatgccatacatgccatacatgcaggcaaaacaccaatacacaaaataaaaataaataaatcatttttaaaagttaaaaaagatgtttaggaaaaaatacaccaaatgattaatacataataattacctttggtatgtacattggatgtctgttcttaatttaacttattttctatagtaatttacttatatacaatgaaaagttagttaacagttttgtgggtattattttttttttcaaagaccctggtaagacagccagttttggcttggaatatttgatcaattgactcaatttctaacctcacctagaaagtagatttgcactattagaaagttgtttaaccttggaaatctgtggggaagaaatcttggtcaagttggtaaatctttctagaaaacagttttctcgggctggagagatggttcccgtgcttaagagcactgactgctcttcttaaggtcctgagttcaattcccagcaaccacatggtggctcacaaccatctctaatgggatccaatgccctctgctggtgtgtctgaagacagcaacggtgtactcattataaaaaaataaagaaaattttaaaaaaactttaaaaaagaagttttccctcctataaaattaggtaagagactaaactagaatgtccattatgtagctccaaataatgtaattaagtaagcttgactaagggaatgaacttcattgttgtccttttgacctttaaatatatatatatttcatgagagaaaacttcacagtgacttccctttccccaaatcttaaattcagtaggtggttaattaaataatattcttgagttccaaaagatgtatctagcagtcattagggcaggacctggcatgtttgatctatctcttaactctcaaatcttaaatgttgaactctcttgggtggctgcttatgtataccatctgctgaacccactggtatggaatgataaacgctcatgacagcagaattgattaggaaaaataatcagcatggtctttctattatcctatcaagaaactaaacccgagactagatctactcggcttttaagagtgtttgcttttgcaaatagcaagtgtaacctaaagcatggatctgaacacctcacctagcatgtctgcatacttctggtactgtttttaattttcttttttctaactttataatttatccaaattttgcatacatataaatttaaatgttaattagtagtagaagcttaaaagaaataacagcagtcttgtgaggctcttttcacagaaacaagtctattccgtttattaattatttgggaaggaataggaggtatggtcttgttgcaggaggtgtgtcactgggggagggcttaaaggtattaaaagattcactcatccccagtgggctctctttgctttcgttgtggggtgaaatgtgagcccccatgccttggctttgccaagtggaatctaaccctcagagcctggaagcccatttaaatcctttcttatgtaagtagccttggtcatggtgtttatcactgcaattgaacagtcaggggagaagcacaatagaggggatgattggttcttgtcgataccacttttacaaggaagagtatcattctgcctgagttaacaggatgggaaggaaggatttgaggagcagaaaggagctaggaaaagctttcccagcttcaagagtgtggatgaagcaaaatgaatgccttgtgaccaagcctatggtttatgtctgagcaggaggatgaggctggcaagaaaagaggtattctctgcttagtaaccacaccaaagttgttattagtttgtttgtttgtttgtttgtttttgaggcaggatttctctatgtagccctggctgtcttcacactcactctgtagaccaggctggcctcgaactcagagatccacctgcttctgcctccacaagtgctgggattaaaggcatgcaccactaactcctgccccgaaattacttttattacttagcaacttaagactatttactgatgtttctttcacatgtagtacacacagttgagcttattttatttaaacatttgaaagcctgtctatcaatttcctggcccagagtaccaataattatgtcagcatggataaatccatatcagctccaaaatttcaaagcacttttcctatgggcttcattcattccttcccctcctagaatgtaaggacattaagatgtgtgcaaagaaacaatttttttgtgttttttaatcttcacatgaaagaataaaattatttttgtatataaagtttactctctattatattatttttatgtagctttgtctctatctcagaaacatctggctctccttgccaaggaagcagtgtgccaaagtatgtccagtttaatctctctgccattagtcaggcctctcacattgctattaagaatggggattttgttgttgctggtggtggtggttttgtttgctcaaccatgtttatgcctctgcacgatttaaaactctctgttggctcccttgtcacctaggtagcagttgaagttgtatagtgtggtgagcagtgatctgaccaccagcacatctccagtcttagcagctttgagttttacactccctctttgttatcatagctggtgcttacaacagtggcgtctcattagttttccccttcgctcagcttgcccacctacctgcctagaaccatgtcctttactcttctaagtgcaagcatacacttgatgctcatccttctgccccaaagttgctacctctaggaagcttctcctgaagtctccccttaagcctgatagagtgccttccttctatagcttacattcctgcccagttactaagcgtgcactcccgagaaattaccgagtttctctgtaattttttttgtttttgtttgtttgtttgatgtgtgtgtaggtgatctgtttgcatgtatatctgtacactgaaagcatgcctgatagccccagaggccagagtagggtatcagctccctggaactggagtaccaaatggttgtgagctgtcgtttggctgctggaaattgagctgggggcctctggatgaggaggccgtactcttaatcactgaaccatctcttcaattccttataatttaaaggagtttactataggcttagaagtaagaacataggaggtaggaaacgggcagaatcctagcaggagtgagtgccaagaaaatgtgtgccctggggattgctgctgggtcagtaaggttttttaactggagggatgggaatgagctggttagtccccttgtcccggctcggaggtccctttgtatcactccatcctaggggtctgcactgagggttcagcatcttcacggagtttccaggcagctggcaaagtgtaagtccttatcctgggggtaagtcaatatcaagcaagtccctcctctggcagcccgtccccaccccacaccccacaccccacaccccacggaccccacaccccacaccccacgaccccacaccccacaccccacaccccacacccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccccacgggacctggggggatttcttgggagtccattgtttgaataatcgatgccttggagcacataaaatagatacttcacttctaatatcattcaaaactttagaaaacatgacacaaatgttttatttaaaataaaaatgtatttatttcaggctgggcagtagtggcacatgcctttaatcccagcccttgggagacggaggcagatggatctctgtgagttcaaggctagccctaatcgacagaggaagttccaggacagccaggactacacaaagaaaccttgtcttgatgcccacccccctcagtaattcatttcattaaagaaattttggtcattatgataagttatcagttacttagtacttacttagtacttagttacttagtgcctagtgtcttctagccactcctgtgtgtaatgtagtgattaaagacgcttgctgcctagcctgatgacctgagtttggtccctaggacccacgtggtagaagaagagaacacattcccacaagttgtcttctgacctccacgtgtgggtggtcacacctaagtgacctcctccccattatacacacaagcaaaactaataaatgtaaaaaatattaatactctatgtatgctgtgaaacaggtgaggagagcagcggaaaactttgaaaaaggaattctctcctttcactcacttgtcaagcttggcagcagtatctttacccactgagccatccttctggcccttattacatcatttcagtagtacgtacgcacatgtgatgtatccctgttggtgctaatctgaaccatctggctgagaaagtgtctgttgagtctctgttctctaaatgctctgctcctggcctctcagcatgctgtagtcttcagaaggaaggactgtttacagagcacactgagagattagaaggattctataaccttgagagcagagaatccacatacattattgattattttgtggaggcttgtctgttctccccatttgtttattcatgtcagtgtgaactcattagaaatgatatcatactctaagttatgcttgaactctgctttttgttgatgactgtattacctatttggggccatttaagactcttttgattagcttctagatttcagttgtgtcaggctgtttgtctcggtttggcttttacagcatttccttactttatgtactctgacactcaaagataatcttaatttttcttgctggtatatttctatcaaaatgtttcaagtatttctgtttgccttctctccagctatcctgagtgtcttctttttttgattgaagatagtgttgtgcttatcttctggagaccaaaatttctatcagataactataaagtaatacatcatattatttacccgacatttatcattgtacaaatgatacgtgtacattcatggaagatagcacaagctaagcactgctaggaaatggaagaaaatattttcgaaggcacttgcaaaaccgattaaggttgggctgtagaatacttctgagccagaagaaagcatggtttatgttttccacaaacagtgtttctttcaggaaacactgtttcagatacttgtacgtggcacctctgtgtctgtgagcacctaccatggggcaggcactgtgctacatgtgtatgaatagctccctgtcatcctcaggaataagtgctgtgatggatgtacattcggaggacaatccttgatattttaaggatgatattaatcagccaaataaaactggaaccactaagtaaggcagggcagtagcagggaaagggttaggacacttgactgatacagcttattacaaagaagagaggcagcgaggacagagagcagcagccttgaacccaccaagaaaggccggatatctttttcttacacgtcatttttgagacactatttggagtttaaatcatgggagtgaccactttggttagcattgtagacatgaactaaagcagctaagcacctagctgaggaatgcatgccagtgatgtaagaggtaaagagagtggacacagcgatgaaggagaatgtagaggctgggcgggtaaaaaggaagtcgactgaagaagccttatcagcgggttgagagtcctgggggtcactggaacaataaacattgacctcacctatgcaggcctgacaaagcaattcaaagtaactgcatgaagtccagcaattgatcattgaccagcatgtgcatgtgaatgtcaaatgctcagtagctccagggcatcgtatgttcaagttctcaaaaacagaactaaagaaaccagcactaaatctatacattttttccaagtgaagtgttttcctctggctcaggtattataataattattgtacaaaagcccaactttatctgttttgccagtgcctccaaaaaaacagttccttccatttctggcagtgcttggctggtaatatccgttatctctgatagaagtcatagtgatatgatgcatttacacactatgtcagtcttaccctctcctctggtgtgcaaataactccataaatataagttcaacacttggaaagataacaagtggtctggcctactttatatgtcagtttgcataaacatgttgagttactaatatctctattatatatttactttctatgttaatgataaatgtactttaaagggttctcgggactaggatataatctagcttctgattgaatctggccattttgggaaagtatctcagcatctctttaaagctctaagtgatcacccatcttgtatttccaagattttttataataaagttaattaaaaacttaaaagagtaaggaactgatgggttaatctctagaatgttctaaataacattcattaagcataaatcatttttaacattaaaactagccccattttaatacaacccctgaccaaactatctcagtccattttggctggtataacaagatactgtaggcccaggagcttataagcaacataaattaatttctcacagttttggaggttgggaagtatgaagtgaagatggcaagccgttagatgtcagcattttcctggcttgcggacagtgctttctcattgtcctcagagcatggagggagggcagccctctaggatctccatttaggacccaaactctgatatgagggctctgtcttcatggcttatttcccagtctcacctcctaataccatcactgtggtggttaagtttcaatatgtaaatggttaagtttcaatatgccaattcataccatagtattgacatttgtgtgtgtgtgtgtgtgtgtgtgtgtgtgtggtgggggtggatgttttgttttggaactaccattgtaagctaatcaggcattattagtctgagggaagtattttgatttttatatatgagaaaggttctaaacatgctcaggacaatctgaagatagcactaaccatgcgtcatagtagactaagaaatgtcgttatggtccagtccagactgaaaacgaaggcataaaaaaaaaaaaaaaaaaagaaaacttaagtcataactctttatattgtggctgtgatcccaatgaagtctagctaccacctccaaaaataataatgataacacaatctgcctctcatacatttggcaagtaataatcatattaaatttgtcaaaaatcagtgtttaatatttaatttagaattatggatccaataaaaggaaatcatataaaaaaaactgtgcttagctttcaatatacatactggaggtcctttaacagcaagcactttactatgcttcctagaaagagaccttttgtgactgttttataatgcctaagtactaccctatgctagggaaggttacagtgggcctggaacatgtgccagaaaataaagaaatgccttttaaaaagaacgaatgaatgaatgaaaggaagaaaagacaaaagagggagagaaaaggagggaaagaaggaagacagagaaggatgggagcaaagacattggagggagggcctgaagttctctttgaccaaacctaagggaatttgaacctcagtgaacaagttattgaaaagaacaggaaactgtgaattctattgatgatgcatggatggcaggtgtacagttcacaacctgttggatgtaactagttacaaaattgtagttaatgaaatatcaacaaaataattttaaggttgggggggggtcacctcaacatgaaagactgtactaaaggatcccagcatacactgtatggatgggaaagaaaaacagtacaattctaactgaataatagagataaaatgatcaagttagaagatggcaactgtcacgatgattggtttaggcaagaattatcagtggacaatgagtaggcagccagacatcttgacaagggagcaggatctttccatcatctaatttatcttcccacatattgctactctagtaatgagaaaacagtaaccaaagtgaaagagtgaaaggtggaaggtctttggaagtggttgttctctggtggcactgggatgtattaaacatcatttttatcgtattcccctgtatggaaatgcataacctgatttcagtcagaagggaacagcagacaaacccagatgaaggtcatcgattttaaatgaagcggcctatagtctttaaagtggcagggttacaaaagagaagttgcaatgaggttagaaagaaaaaaattaatctagattaagggaaactaaggaaacgtggaaataaaatgtaaatgtgatctactgtatcttgaagtagaagtaaaatataaaatgacatagttataactgctgtcactattgaaatttgagtgactaaattaaatgtattgtgtcaatgttaaatttcttaaatttagtaattatactgtggtcatgatagagaatgccctattgttagaaaatacacaatgaagaaataaagagaaagaagacatgttctttgaaacttcccaaatgtgtgtgtagagcatggtaacaatatgtagcaggacagtaacagttggctgtctgagtgtatactgtataggatttctattcttaagtcttgaatcttttctaattctttgaaattatttcaaaataaaattctgttggatatttttagcccttttgaaggcccaaaatgatgtcatgactatgaagattcagtcagagagactttctaaagagtatgaccgactcctgaaagaacactcagaacttcaggttggtgacatgtatttgtatatttaaagttttttgaaataataattacttaagtaaactatttgcattgcatgcccttcacaaatgcaaacagggtgtttaatcctggctttattaaataaccagagaagccagatttacctaaaggataaagattgggtcattatatccaaatgcaagatagccatagtataaagaattactaacatgctatttttaaaatattccactttagctttaaagaaaataattgaactatacaataaaagcattaaaaaactggttctggaaaaatttgtatttcaccatctagaatgtttgccatatttatgccaaagtaagactaaaatttgaagtttcatatcacattactccagtctttgtttctggtatcttaaggcaaagaactatggcattcaaatgcctgatttacacctacaaagatgacttaaagatgggggaaatctttgttaaagcagtttcaaatctaagccatgcattttctttctctgtgtctaatttagcaagagtcagttccaaacattcattcgtaggtaggtctatcttttttctttttagctgtcaatcactgtcttagttgggattttactgctgcagtgaagagacaccctaaccaaggcaactcttatacggagtatgctggctcaagcatactcaaaccaccataatcaccaacctgaatttatttcccagtcacccttttttgaggtgaggccagggagggtgctgccaaacagagatcaaatccaggcctagtgcgcgataggcaagtgtcgtagccctgagcttcaagccagctccacactgaggagaagcctaggaaaagctgatactgagacagccttggcgtgggacaagacattatacccagacactctaggatcagactgggaatgcctgtatcagtctaaacactagatttatgatcctgacatgacgtcatccatctgaatgaattcacataattcatctgtaacactgaaacaataataaagtcctgttcactggagtgttgagaactaaatgaaaggcagggtgcttggaacttttcctagctgatacaaacaatcaagaaacctagacagctgttagctaagcatggtggcacatacccttaactccagcatttgggtatgcctcaaagaaaataagggagaaaaggaggaagagagggaagaagagggggaggaaagaaagagggagggagggtgagagagagggagggaaaaaagaataacagaagaactgtcactgtcatcagcattctttcctctttagttttactgacagcctagcttaacctcagtcagccattccagtcttcagtcaagaagcaatctaaaacatgaatagacttgttcccaatcctgatatgtagtctagtctcgggacaccaatggctaacgtatgtggtctagagtagatgtttgcatttgtagagatcctgacattgctgacctccttgaggcacagcaagcaccactctgtgacatcctcaggactcagctggggaggaaagaagtgttgttgaggcctcttgtctatgtacactttacccctcttattgtgaagtgagggtattctcaaccatcatggtttccccacacattttgagaggaaagagttttcaaggtaccaaaaatgtttaggccctaaactgaaaaaaggaaaacaaagaatataccctcagtctaaactaaagttcagtgtccattgcttaatgtctctattgtggtgacacttgatggtaactttaacagttcattaggggtaactccttaaccatattcctctatctccagaaagaaaaaaaacaaagactttgcacttagagcttctttcttcatagcaaatatatggaaagctcttatagatatactctgcccaagaaaatagttgttgtccatgcctcattggaaaggaaccacatcctagatgaactaagagccatgctgtattgattcgagccttatctgatcacacatgtaagccttcatctaatacctgtctgtattctgtttcccaagtaccacatttactcaggctctggaataaggcacctggctgatagtcttgtataagtgtcacattcactctatggcaactcagtacattaacatattctactatttccgattagtggacaaaagatgttaagaatcaaaattttttatgtaatttgctctgaagttattgaactagaaagagcatttaaagctgggcagcaaagtcaggaaatctttctcaacaacctcctggttaaccgggttcttcagccttttctggtcattgagctgtgtattcttggatctattcttttgctatccatgttccaccccgtgtagaaatgcacatttccagacccttgctttctgacatgggcaggtttgtcagtgagaggcattagtagaaaactgaaatcagaaacagggaaagcccctgatctctctctcctatcttctgctttaggtgacatttccttctgtcctctagcccctctctccctggtcaaagttgcaatgggcagctgccattttcaggacctcaccagaacatctcaagcctccacccacggctagagtggtggctttctgctatagctaatgctgttctgcccactctctcattacctgaaactctaacttcctgaaatatcctctaaagggttaaatagcccctaacctctgaatcatctgacattcgggtgccctggctacatcatcacttaaatgagagataggatggataccttaatgagcatcaaaccagatcctatttcaagaaagaaccttcaatatttttaaacaagaaagtctctttatagccataagatgcttagttgatttgttacaattttttcctgcccacccacctgactccactgtccatgaaaacctaagaaacatgctgaaatttagatgtcatctcatgagcactggagagatggctcagtggttaagagcactgattgcttttccaaaggacctgggttcaattcccaacacctgcatggcagctcacagctgtctgtaactccaggatctgacactctcacacagacatacattcaggcaaaacaccaatgcatataaaataaactaataataaataaataaatatgtcattttatggatccatttttttcacaagtgactctaatgttcatactctgaccaagcaaaagataacagaaaatcattctatactattaagctgaatttagcttgtcctcaagtattttacttttatggtcaaaacaacttagtaatttaattatatcctaaggttactcggaaaccgtactaattttcttaattttatataattgtgatagtttgagtgaaataagtatgaacagttgtttaaatgttaaagaaacaaaggtggtagaaaatctggttccttttccgtaatcaaatctcattttgcagcttttaaatccatttggatttccctagctgggcccctccctgctaacagcactaaataaatattagaaatcagtcccttcagaacatttgctttttcttatttggcctggctgtcacctagaagaaaaaaaaaatccctgactaggtattattagcaaaccatcaacacttgctaatttttaaattcattttataaatcacccttcacctaggaaactgccctgaataccaatttcatggcatttccattaaaactttgatttatatgtaaagtggtcaaatatgtataaacgagtagaagtaatatattgccattgagaatacccctcttgtcctaatgctgttgtttaaaagcattgatactccacctaacactctgcagtagactgtctgcacgagccagttctgcagccccactcggtgaggtctcttccttaatagaaacatttgctttcctaatgcagttcctcgtctacggttcactggtatttcgtttcccgtctgtttagagctacattctcataataatctgtacaccacgatcagaaaggtgtgaggggccagttctgatttgggaaggactaaatgaaaaggaggtgggaggacggacagaaagaaggatgagggggagggggagctggccatggcagttaacaggctttggttttattttttgttctataatgtttaaagtttcaaactttctcaatccgtattttcacattttaattctctaatgactagcagaataccatttatatacaagtgtttgtatctatgaacgtacttcttaatctgctattttttcttacagaaccgtttagagaaagagaagaagaaaggcctgtgaactaactttataaaagaagactgtaatacaccttgtcaaagttcagttgaaaacaaagaaagctgtgctagcgcctgcagacccgcacaggctatacagtagtgacatttccaaaatatttgataatgtttcagatttcagatataaagtatggatttcagctcttttggaaaatataagcatgttaaataccatatttacatattgctaatagcattgatatatggtggctctttacccataaaaggaaattttcatttgctagcatttacttcccaaattagatctgaagttgcatgaaaccattattagctttgaaagctttgatgtgtttttagtaataatcagatgatggtagtggtaaaaatgatgtgtttgaaaagagaactcagtatcagaaaatgttttcacagggaaacaaggatgagtaaccacaattagccactgcgcttatcgagaagagtcagagaacagcgaaaactacggccttagggctcttcaagcctcatgattgtacaacctactcgaaatatgacagcactgttgatagtgtgtgttgctactgtgcttctgtgcctataagactattgataatttgtttagtcatatatggtcagtagtctgtcttttcaaggtcatctgctaatagaatgtatgcccatttgcaaaactgtcataccactgaactgagcttatgttgcactgtggatttctccactgacaaagcttatttacgacatcctaaaagcagcgttttttctatttgtgaaagttactgattgtactggtattacctcagtattcatgcactggtatcatacagatctctctactatgtttctatattctcaaagttaaatacaggttttcatgcaaatattcatgtagaagtagtgagtgtaataatatgatttaggttatttcagtgtttaactgtgaaaagccacttgtcttaaaatgcttaaatataaaagaaaatgcaaaataataattggagtttttattctctagtttttatctataattttaatgccaatcctatgtatatttaattgttctcattgcaaagtgggtaaaatgagtaatacctaattgtatttcagataaaagttaggatttagtgctagaaaacagacatgaggaagacactctccggggtaaaatacaggagttacaccttgtgggctgacaccaccagaggtagaggagagggcgcactgaatgagaggaaactgcgcacatgacttctcaaaccctacacttagaaatgtcagcgtgagagcaacttggtaagtatagaccctgagctactctgcagaaatcagctctaatgtcaaaataacattaagtccaagagaaagtacacagctttagagttagaacccagagctgaccccagcttcaccacatgcatgtttagtcatgtgacttgaacgttatccagattcaccgggactccttttcatttccaaattgagactattaatattgagataagggttactatagaaactaacatgattctcaaagttattctatcaaattcatggatttgaaagtttcaccagaaaagcactttaaagtttacagttaggggatcttagacctcaactctcaattttacaaatctgtaattagataactcaaaaactggaggaattttcctgagggaaaatagaaaagagagtcagagtcaggtttaggaactgactatgcaggtctcctagctccttccctggatattgcttatcttactttacaaactagtttagtgtgctagcccttaaacagtgccatatatgtataagtaaactggtacgtgaccgctgcaggattggttagggaggggggtttagtgtaggtatgagggagagagcagccagaggcttctagaagagtctagagcagaaagtagtagactgagtatggccagcagactggaactgggcaagactctcaggggccagcatgcactttggtatgctaataggcaccacagagcgccctttgtcccttctgccagtgacaaggttacttactgcctcttttttttttcccccctttttaatgccttgtcctggaactcactctgttagaccagactagcctccaattcagagatctgcctgcctctgcctcccaagtgctgggactaaaggcgtgtgccaccactacctggcagtaattgcctcttttgatagaggggaaccagctttataagttcctcagaaatgctggggggttttgtcttaacttccataatttgggggagatggagtttcctttggctctgacagcacatagccaaggtttgacccagagcgtttggaagagctcctcctcctccctccctttcctttcctgtgttgctggttaacaaatcctctacatagcctatgggcttaggtacccccacgttaaatcacttctcagagtaacgactttgtgtctcaggctgcttgcgatctttgccttcttcatcatggttatgtaagtttgtcaaacgttctttctctttccctgtgagttgcctgaggctctggtctcttagaagcagcacaagctaagcagagctgcagggtagagtggagcagcatctttattggtccttgtcctgttttatcctttgcatccccactttatctcttagggcccacactctcctgtggttatttatcgcaccactttagggactagaagcacttccagggacacagttattgtcctgattcttgaattgccacacagttaagtcaacctcttggtccccttgtaccttctcttaatcctctcatatatgcacacttggtagccacctaactgaaaaaaaaaaatctaatcatttgtagttcaaatttttccagttattcttcattgcacttaagcttaaacccgcaggatctcaccaggcctccaacttgttcctgacaagttctcctaccctgccaaacacagcagcactttaatcttagtacaggtcacagtatttccctcacaggactttggcatatgtgcaaaatgttgtattctagcttcttaactcttatcttcattgcgatatgtattgcctgagatgatctcactaatggctaacagttcctgaacacagtgagtgttgcttaaaggagagggggaatgctctaacatacttggcaatacctaaaaacattcttggttgtcaaaactacagtgttactgatgggcggagaccagaaatgctgctaacttactctgctatgcacagggcatccatttacggcagaatcagatcaataatgtccataccacccaggttgagatatctaggcataaaagggaatgtcacatggtggccagctctttttccttcctctgtcttgtttcctaaaacactgctatcttagattatgacattgggcgcattcagaagggaggaacaagataaaaggaagctgtgttgctaacagtgccatacctgtcctgaagttctgctcagtacatgatgaaataaatgaataacagtagatatctttgcctttcctaacatccttaacatcagcagtatatgtctatatttgtaggggggtgtgcacacatatataatacacaaagccaattagtgtgggggtacacgtatataatacacaaagccaccagcttttgtttgtatcttaccttttatttgaggatctcatttaaaaattatagccctcccccaagactctgactttgattgttttatattttactttattattggtcattagcattatataatgtatccagcctacttttctgtgcttcacaccaaaggagtgcgcaagagaaataaaacatggtctgtctcttgtgtttagtgttgtgtgcaccacaaggacagcaacactacaagtaccagatgaaaggtatgatgtgtaagtctaataaactgggaaaaagttgttgcctgggtttggtgatcagcattcttcttagatctgaacaaaggatgtgtttgaagcttaggcttctgctccccacccccacccccacccccaatgtcttcgtggtttaggcagattgctccaagaatctaacactccttcagaaatctttgttctcccagaagcaccgcccagcaaataatttgtctcttgcaagggctgccagcttccgggagcacagtgatgcctggagcaccacttgttagctgagggcttcctggagtgatcttccacagaagcccactgaatgaaatatgagcaacttgtgtcaagttaattgttttcctcttaaaacaaaaccagtatatagaaaatacagacatttcagggaaatgttatcagtggttaattcacatatgtaaatatataaatactttaaaaatgagatcatgcttgtgttttgatactgtctgactcttttctttttggtttttttcgagacagggtttctctctatagccctggctgtcctggaactcactttgtagaccaggctggcctcgaactcagaaatccacctgcctctgcctcccaagtgctgggattaaaggcgtgtgccaccactgactcttttctatatcaaatattctataaatgtttacaggctatttttgataggttaaaaaaaaaatcatctgatggataggaatttcccaaaatgcccaggcacccaggttaggaatgatactgagcataaccacttagaacatgaaatcagaaaagggttgaggcccactgtcacctggcacagtgtacttagcccctggatattctgtattggcccccagtactggaatctgtaagacacaagttacatataacatacagtgaccacctggattccaatcctattttatcattctatttttaaagtgattaagactaaatctcagacttcctgataatatatgacttcatacacaaagaacttcaaacagattctggtgacaaactaaatggccagtgtcaaaatgttattttaaaaaataaaatagaatcttacaatttatagaatagttgtgaaagtgaaaaaaaaatctagagatacatggcagaatcccctataaccctagcacttggaaggctgagacaggaggattagtttgaggccagcctgagcccatataactgagctgcattaaaactggtaggaattgtagacccctggttccatgtaataaaaatacactatgatgaaagtgctaagcagtttatgatgactgttcctaacagtgggcagccctctgcctgccaatcttgttccattccacacaaagcacagcgccatcttggtttaagtatgaagtaaatgtttacctagttaaattctgttcagatgtatctttcagcaatatgtctttagattgtgacaggatgtaatataattttgacaaatcataaaatgttaatcagcccctattttgaccactggtgtatttactttcagatcacattgacatatttaatattctggggtatctcattagctacttaatcagtctctctctctctctctctctctctctctctctctctctctctctctctctcacacacacacacacacacacacacacacacacacacacattgatgacctagaatagttaacacttgaaccctgagtgcatagcacagacctttagtcctagtcttgggggtgacctagaaggataaaaagtttaaggctcaacttataatatggacttcatagcaagaccctgtctcaaaacaacaaaaatcaacagaaaattatctaaacagaataaagcatgaatgaaatgacaacaaattgttagaactttagaaattctgaaacttccaagatcttttagggcatgtaataaaaaatctttcctggttgcaatctggcttcccctttatgtctttagcacccaaagggatgtttgtatccaggatgaagcttagacttcactgcctccacgtaaatcttcctagaggtggaaaacaggaaagcaaggttaatgcaataacactgaaaacctgaaatgcacttttgatttataataagcatatttctttcttattgttgtcatagatacccccaaacttagtgattcaaaacagacataaatacatttatcttgacattcttaaggtcaggagtccaaaattcgtcttatcaggctaagccaggctaccccgaaggccttgactctctccatcttagccaacaataaagcagcctttgaagcattctctccctgaaattttctgcctccttccacagttacacttcttgatactccttttctcctcaaactatacatctcatatttttccttcctcagctgcataagaatgatcactgataaccatatttcacagtcaatattaggctgtcttgaaatttctactaccagtgccattaatccagcagtcttcaattcaggcacattcttaagtcaatggcagaaagtagccacattttttttgccaaaatattacaagtatggtttttaggtcacttattaatattcttctcctctgaaacctcttgaactaggccagctctcaataccattgtcttccctgctactacaagtatgtcccattaagccacacttaagtattaaactgctttcttaatccaaaattcacattctgccaaaaggcagtatggttgggcttgacacagcaataccctgctgcttggtaccaacttttgtcttagtgttctcattcaaatcaccataccatgtaacttaaaattcaggttctaaagaattggaggtgaacacaatcagtaggccattatggcacaaagttatttgaatgctaaattcatttgtaattattaatttgtttttcaatatttactacacttatttttctttatatgtatgtgcatgcaactgtgtgtttgtgtttgtgtgtgtgtgtgtgtgtgtgtgtgtgtgtgtgtgtaggtatgcacatgccagagtatactgtagtgagaattctggaatttttttgtttctttaaaaaaatacagaaatattgtaaaaatatgttttcattttaatcccagctgtggactatgtgactgcttcagactgtccacagcagctgactatgatttgcctcatgctctagcaggggcatgattttgccagatatagtttttacagttgtgtgacatttggaattctgggaacttttcagagagtatataaatgctaggaccctgagaggcaaggttgttggggaattgttggttggttgctgtttgatagtagtcatgatcaaagaagaaacaagaattagaagttagatatcatgataataaagatcaaacttgctcaaagaactcaacacctctaatcaacaggaagtagtttaaagataatgttaccccctttccaactgtcttagggttttattattgagaacannnnnnnnnnnnnnnnnnnnccacccacccccactcacacagtgtatacttcctccaacaaggccacacccacaagtagtgccactccctgggccaagcatattcaaatcaccacatctacctacctctgactttattcaaggagctctttctttcctcctctatccctttatctcgcttatctagtattaaggagttgaaagttggaagaaaaggagtggagaagggtaagagaaagaaccacaaagtagctgggaccaactacagtatacttttgggatttaaaggacaacttgtaagatttggttctctgcttccactatatgtgccccaaagatcaaactcaggtcatcgggtttaatagcaaatacctactgacccatctcatcaaccctatagttattcttttaaatttcttcatgtctttttaaattaaatttatcctaactaatgtaaattttgaattacacataattatatatggcaatgttttatacattccttttatacatacactattcaatgtttaaatcaatttaaacatatctatatcatttctccatgatagctcaaaaatggtatttttgacaatgctttttgtagtcaaattctcatagcttcctggttcttgactgagaagatttttatttttaactgaactatgaagaaaggaagctgaattgaaagggaaaaggtcctcccatctctacataaccagcttctgctgcctgtggctttctcaaacacagagacctgcaaaacaagcactagaaaacacccatatgggatatctacctaaagaagacaaaaattcaccaggaatggctggttgaacataaactctgacttctaaaattcagtaaaggggttgtttgaaggcctagaacaaagttaaagaacatgagaagacccagcaccaactgtcttgaaattatcaacaagtaagactgatgaaaaatggaagcctcttctttcagaaagccaagaaccagttcaacttaaatcaccaactaaaacgcaggcattgatggtgcaacccctggaagaacaaagcagcttgactaaaaactatttaggaagcaatgttatccctggatgcccctctcctccttagactactgggtggctcccttcctgggcccagcagaagacagaagtctattttaagaaaaagaaagaattaaatgatgcatatattctaaattcaggattttcttctcaaccagaatggtggtagtcagtgccccatctccaagctcaaaaccaaatgaatgctttctagtggggacttagtaaacccaagaggaaatacctagagatagtcacatagatgttgatagtgagggcagggaatttccccaacgacaggcagctcaccctactggaaacctcaccatgagcaagcactcattcagaacttccaggtagctcttgagcctctcattttaatcatgagtggtaaggaattcaatcctgaagagactggagcaaagctgacatagcttttgtcttattttgttttttaatgtgctgaaaatagtgtatacgaagaaaacggtcccggggtttttataggctataagcattctttctagactctggcccacagttaactggcaatagccagatatgcctgactcactataaaaggggctgcttgtcccctccttggtcttttactctctcactctcttactgtctgccccttctcttttctgacccctttctctctcccccctccctcctcttctcctctctccatgtgttcctggcccaccacctccccacccctctctttttcttattttctcctttctcctcctcctcttcctcctcctctttctcctcctcctcctcnnnnnnnnnnnnnnnnnnnnnnnnnncctcctcctccttcttcttccttcccaacttcacttcccatgccctaaataaacccaattccatactatatccattgtatggcttgtacctggggagcgggaggagagatgcctgagcatgggcccacagaggcaccctcttccacctcaccatacctcacttctatcaaacacacccttgactctttctggttttttgttttgttttgtttttttaataaaacacaacataggctgtggatttttatttcagttcactcataaattcaaaattttcaaacatcaggaggtaaaaatgagaacttggcgggggggcggggggcagtggaaggcccagtagatcctcagcacaaatagaacaccctgggccatttgtgctctatagaaagacaacagagactgcaccatatttcagacttttcattacccaccattctggcacctatgagattcaagatagaggttgttaggctttctgcagaggcagataagaagcaacaaatctcacccaagagatttattggaggtggagtatacaaaggttgcctcagagctaagatagaggagtaagaaagatactgggaaacagagagagggacagatagagacagaggaagagggagagaggggagagagaatgggaaagacagagccatagtggcagggaccttctaaggggtatacgtgtggcatttggaggctgatgatgacttggcagctggcactgagtccctgaaggtaggctaggagcaggggcacctggttcctaacacaggtgccagcagctttggtgtctggtgagagctactttctgcttctaagacagtaccttgattctggatcctctagaaagaaacagcagaaggcagaaaggcaagaaaatatgcattccctcctcctctaaacacttgtataacgtcatctagttctttcatgagggggaagagctcccattaactaattaccacttaaagagtagttaataccacattagtcattaagttcaacaactgaaatttggagaagaaacattcaaaccatcacatagatccaatactagtgaaccggattcagtgagaaggttctacaaatgtccaggaaactcgtaaagtctaagagttataagtacattcagtaagctttgaaattcaagacaataaagtaatgctttcaaaattctgaaggaaaaaactcatattctatagttgaactaccaatcaagtatgagttaagaataaggaaaaaatttagacctacaggttcacaaaacttttacctcctatcaccccaactcaagacaaaaactgaatgttcttctttattgaagactctaagctgtaaatatatatatatatatatatatatatgtaaacagacaaagtataggtaaagtctaaaaaatctggaaagaccaagagaggataaaatcaggtgttagggaaggatgagggcaaatgggacatgaaagaggagcaaggaaggtggctgcaaggaggaaacaggagtagcagggggttggagagagaccggaggaaggacaaccacaaaaatactttgttcaaaaacgttaggatggtatctaatacattagacactgatttagaacagcacgtgtgtgtgtgtgtgtgtgtgtgtgtgtgtgtgtgtgtgtgtgtatgtgtgtatgtgtaaattttacctcctgtacagccttcctcaaggaaacta

SEQ ID NO: 1190 - DNA, 1698 bp, Mus musculus
gtgtgaagaaaaaacaaaacaaaacgatgacaatccaatgggcggcggttgccagctttctttatgctgaaataggactcattttactcttctgtctgccctttattcctccacagagatggcagaagattttttcatttagtgtctggggtaagattgcaagtttttggaacaaagcttttcttaccattataatactattgatcattctgtttctagatgccgtgagagaagtaagaaagtattcgtccacgaatgttgtagagaagaactcagccatcagaccgagtgcctttgagcacacacagatgaagctcttcaggtctcaaagaaatctgtatatttctggattctcattatttttttggctagtgttgagacgtctggttacgcttattactcagctggcaaaagaaatagcaaacaaaggagtgcttaaaattcaagcagaaaataccaataaggctgccaagaaattcatggaagagaatgaaaaactaaaattggggctaagaaatgacaatgctgaagaacaccttttggaagctgaaaataaaaaactaatagaaagcaaggagaacctgaaaaccgagctgaagaaggcttccgatgcccttttgaaggcccaaaatgatgtcatgactatgaagattcagtcagagagactttctaaagagtatgaccgactcctgaaagaacactcagaacttcagaaccgtttagagaaagagaagaagaaaggcctgtgaactaactttataaaagaagactgtaatacaccttgtcaaagttcagttgaaaacaaagaaagctgtgctagcgcctgcagacccgcacaggctatacagtagtgacatttccaaaatatttgataatgtttcagatttcagatataaagtatggatttcagctcttttggaaaatataagcatgttaaataccatatttacatattgctaatagcattgatatatggtggctctttacccataaaaggaaattttcatttgctagcatttacttcccaaattagatctgaagttgcatgaaaccattattagctttgaaagctttgatgtgtttttagtaataatcagatgatggtagtggtaaaaatgatgtgtttgaaaagagaactcagtatcagaaaatgttttcacagggaaacaaggatgagtaaccacaattagccactgcgcttatcgagaagagtcagagaacagcgaaaactacggccttagggctcttcaagcctcatgattgtacaacctactcgaaatatgacagcactgttgatagtgtgtgttgctactgtgcttctgtgcctataagactattgataatttgtttagtcatatatggtcagtagtctgtcttttcaaggtcatctgctaatagaatgtatgcccatttgcaaaactgtcataccactgaactgagcttatgttgcactgtggatttctccactgacaaagcttatttacgacatcctaaaagcagcgttttttctatttgtgaaagttactgattgtactggtattacctcagtattcatgcactggtatcatacagatctctctactatgtttctatattctcaaagttaaatacaggttttcatgcaaatattcatgtagaagtagtgagtgtaataatatgatttaggttatttcagtgtttaactgtgaaaagccactt

SEQ ID NO: 1191 - protein, 248 aa, Mus musculus
VKKKQNKTMTIQWAAVASFLYAEIGLILLFCLPFIPPQRWQKIFSFSVWGKIASFWNKAFLTIIILLIILFLDAVREVRKYSSTNVVEKNSAIRPSAFEHTQMKLFRSQRNLYISGFSLFFWLVLRRLVTLITQLAKEIANKGVLKIQAENTNKAAKKFMEENEKLKLGLRNDNAEEHLLEAENKKLIESKENLKTELKKASDALLKAQNDVMTMKIQSERLSKEYDRLLKEHSELQNRLEKEKKKGL

SEQ ID NO: 1192 - DNA, 69081 bp, Homo sapiens
ttgttcctaaggcaaaagtgttctgtaggaattttgtggatatactttatcaaactgaggcaggttccctctacttctggttttccaagagttagctttttttttttttaactatgtatgagtgtattttgtcaaatgccttttctgcatctatatgatcatgtgatttttattatttagcctgttaatatgatggattacattaattgattttgactattgcaccttctgttttaaccggctttttctgacaacactccagcagggaatgatgtaggggagtggtgccacctcattgctatctgatagaaatccaagttctccacttggcctccttcgacatctggtgggtgaggagctcctcattactgcggggcagtgatgagagttccagttccccatagtgagggtagcctcatatgtgctgggcaataatgaaagtcctggctctccactatgcctcctctgacaccacaccaagcagggagggagaagagtgcttcattactgctggcaggcatggaagtccaggctccccttgtggcctccactgataccactgggctgggagtgacctcagtggccaccagagatgaaagtttcagatccttacctggccttggtatcaatagaatgttggagcaccttgttacagcctttggagggtagaagtctaggattcccacttggcctttgctaatggagataaagccatagctttttctacagtatttggctggagtagaactgtctaaaagttttctgtcttactaggtcagacagaacattttcctggtcctttggttagagaaggcttttgttggggctggttttgtctgcatccattgttgtttccaggtggccagcttcttcaagtctaggatatttgagacaaaaataaaacccagagaactcaccaccctgtcattcctcaggtcctgaggtcactagcctatctggacatcttttcttcacctttcaaaattttcttgtgtttgttttatatataatatccaaggtttttagtaatacttaacaggaataatagggaaaagtaaatctcctccatctccccataggtagaactttctctgataaatatttaacaatgcactaaaatatgtttgtggtgtttctaaatgcataattaaggttttatatgctcacaggttggcttttaggacactagtaagaaaatatagttgtgatctgtgttacacaccaatgattgttgccgctgattttgtcaaatctataaaagccagagacagcgaatttaccacaaatcaaggtatgtgaaaccgagtgtactgactttgtaaaactttttaaatttgtttacaaactcaactatcttatcagaaacaacacaatttagagattttatgtgaagaagctttagttctttagtgtttttaataagtattttttacatgttattactgaatgccttgcaaactatcagtgtatataccaaagtgtaaggtcactttgaaaccctctcctctcactagggctactagagtagattcctgtcacactgcctctagtcttgtaccattccaaactatcctccaaggagaccaaagtgacctattgaacatgtaaatttttctctcattgttctcaaagtgtgatccccagaccagcagcatcagtattatctggaaacttgttagaaatggagatttacaggtgtactaaatcagaaattccacatatgtggtccagcaatctgtgttttaaaagctctccaggtaattctgagcttgttaaaggttgagaactactggcttaaagactaaaatttcagcacctaaagataatacacagtttttcataatctgacctctgaatacatcttctgcagccttatcttccttcagtttctccccacaccccactgactttatccttcaaaattcctaagttattttaagtccttgaacatacactgtcttctcacaccagaccccctctctctcttgcaaactgtagtttatgtttcgtcattcagctctcaatatttgtagccatgaatctttttttttttttttgatcatcctctactcatgtcctccctgctaagcacaggctcttatgttgcacttaatcacttaattctactgcattatgatttcctctttatatgcctgtttctcccattaggttcggcctccttgagggctgtagctttagaaatagcttgatttgtatcctcagcatctagtacagtgttggaaatatattagaccaataaatggttgttaaattgaaattctgtaactctcttgagttacaaaagggaaagcaccttacatctccataaagaataaagcaaattctcctaaaccatcataatcctgtaaatcagtagattgccataggaatcttgaatcagtgcaactaggatgatgcccacaaatctgcattttcataaacacccagtgaatctcatacaagtattcctcaaaagaaatgttgaaatacatctaaacagagtttataacactgacccaaggatacgaaaaatatgttctttaaagcctaggaagctttaatacattcggctgtattaaaattaaaactttgggccagaggcggtggctcatgcctgtaatcttagcgctttgggaggccaaggtgggtggatcacctgaggtcaggagtttgagaccagcctgaccaacatggtgaaaccctatctctactaaaaatgcaaaaattggctggccatggtggcaggtgcctgtaatcctagctacttgggagactgagccggagaatcacttgaacctgggacgcagaggttgcagtgagctgagattgtgccactgcactccagcctgggtgacagactctgtctcaaaaaaaaaaaaaaattaaacatttatatgtaagagcacaaatatactcaaagacaaaaaactgaggagaatatttataacacatgatagatagcaatactaatttctttgttttattaaaaaaattacaaataaaaagaacaactaatggaaaaattatatacagaaaaatgcaaagaatatgaagagagctcacaaattagaatattcaaatgttggatatacactgtatgataagttgtgaggaaacaagaacttttatccatattggtatatgtctatattggtaaactcttgaaagataattctgtaatatctatcacagtgttgtatgttaaatgcctattaacaattctcctaagaatttaccctatgaatatactcagagcatgtgaaacagtctaaaaatacactatatggtccatccgtacagcggaatatcccactataaagaagaaaataggtctgagtacatctcccagatacatgaggaaagaaaggaacactaggcacagtggtatatatagattgttcacacttgtttaaattttacaggtatacaaaaaaattgttctggaatgcagtaaactaattctcacctttgagaagagggtctattttgtcaaaagtattagaattgttttcatttatcaaattttgtactgtttgaattttttaccgtgtaaattgcttttaattttaaatattttaaattgtttaatgttatattatttggacagatgcttcttaggctaaaaaatcgttattgctattttatcctgtacaaacattaaagtttggtgtgtgtgtgcatggggttttttcctgtgaattttaatgttgagctattcattttgtcaggtgattgcccattgattgttcagtttgctgctaacgatgcaagacttttatctgatgctgctcgtatagtctgtccttatgcgaatggaatagacattaactgtggttgccctcagaggtaaagctcaaagaagttggaagaattttccaaaagagtagaaaaaaaactgtgtgaacatggtaaaatatctttctagttttccaaaaattaaaaagaaaatagagttacagtcccagggctcaaaacaagaaggaagaaaatatagggaaatgtaatttagaaacataaattcaaaggtcttttctgatgactgaaatgatgtatagacctttgacaggtgttttgtctcccctcaccaatagaatttttatgtggctgtgccttgaatctcatccctaagtagttatatgagaatctaatgtttacggcaatccctaaaatgtatttttactgtcatgtcagatatacttgctctgaaaacagattgtttgacttaggaaatcaccacatatttcctcctaattaattccccttataaaaataccttattataatcactttttctttctataccacagttacttgtttgggtttaaataactgggtgttgatagggtgtacttaatttgacaataatatttctttttttttttttttttttgagacaagagtttcccgggttggagtgcagtggtgtggtctcggctcaccacaactaccgcctcccaggttcaagcgattctcctgcctcagcctcctgagtagctgggattacagccatgcaccaccacgccaggctaattttgtatttttagtagagacggggtttctctatgttggtcaggctggttgcaaactcccaacctcaggtgatccgcccgccttggcctcccaaagtgctgggattacaggcctgagccaccgcgcccagcctgacaataatagttctactttactggcactgtagtagattatcagtaattcaaaatgtgtccaaagaataaaagcaaagttgttaagtatagcgtaatcgaaatcagattagacatatttgtatactcattaggagggttaaattagctgtttagtggtattggaatgctgtaagccaaaaatatctttctactattgagactaataaaacctcttgttatgcacaataaacatcaaatttggaatttttaaaatctgaagtcattgcaattacttcaaatatttaaacctgttttggttgaatgacttttaacttaatattctcacttgccaatgaaaaccatttctcctgagtactttttgatctgggaacatgttttcctaatctcatattgatccacttagaaatgttgaatctatgaattttttatatctgcttctcttccagatcactagagaaatggatgcacttacatttcagtgctttcagaattttgtcttctcttccagttatttataattcacttgttcatgtgtttgctttacaaaggtgggcaatggcagaaggttatggggcttgcttaataaacaagccagagcttgttcaagacatggtgaaacaagtaagaaatcaagtggaaacccctggattttcagtttctattaaaataaggtaaagacaatatttcaatctattgataggataatccattacttaggaaatgaaagattattgcttttgtctgatgctgttgggagtatctatcctaaataaattggtagctggtgtatggaaatgttgaaaataagacatttagtaaaagaatatataccataattttcatttatagtcctgaaaaacttcctctttgtacttttaacaaaagttaaagcctccctttaagtttcaccaaactttcaactttagctatgtagtatttaatgttaagaaacattactggtgccaagtgtagaaaataggaaaaatatttgcactaaaatttcacaatgaaaagaaaataaaccaggaatcagtttttccgtgacaggttgaaaacatatttctttttttgagacagagtctcactctgttgcccaggctggagtgcagtggcacaatcttggctcactgcaacccctgcctcccaggttcaagcaattctcatgcctcagcctctcaagtagttgggattacaggtgtgtgtcaccacacctcgctaatttttgtattttttagtagaaacgaggtttcgccacgttggccaggccagtcctgagctcctggcctcaagtgatccacctgcctcagcctctcaatgtgctgggattacaggagtgagccacggtgcccagcctgaaaacatatttcaagataaagtattatattctcccactgggggatgggggcatgcacagcaaatattaaggtttaaattcatctgtgacagtactttcatgggtctttcatttatcaaagccaaaacatagaagcactaggtctaagataaaacttgttttttgtcctttgttgtcaatagtgaaatagctaaatttgaggtcttgtgtaggaactgctccctgaagaaaaccttgctgataatgacatagagtaataatatgatatagcaaagctaactaatttggtagatgaaatatcattttagtcagttaatgttagcattaagatttgtgtgctgtgaacagataaatgtaattttgaaattgtaggatccatgatgaccttaaaagaactgtagatctttgtcaaaaggctgaagcaacaggagtttcatggattacagtccatggaagaactgctgaagaaagacatcagccagtgcactatgattccattaaaataattaaggaaaatatgtctatacctgtaattgctaatggagacatcagaagcttaaaggaagcagaaaatgtgtggcggattactgggacagatggtaagaaataagtacttgggttcttttaattgggggggaagaaatgagagtggggaagtaatgttaatttgattttcatttgttttgtttaacattaagccatattttcccattgtactgttttaagctaagcgatttattaaaatgatgttaagttttctacctagaaaaacatggattatcttaactgggataaattaattcagttacttttctgacaccatcatatctagtgaccagtgaagaattttccagatagcctactagtaaaataaagcacctagaaataagagtaagtgaactcgagaatgataagagctaaaggaatcccagaactgctatgcagtttcattattcccttaaattattggcatgccaagccctataattgctagatgggagaatatagataaactgaactttaagcagcccaatttatgacaatccagatttaccctaaagaaaaactaaagactaatggtttaatgtagaaatctttaaaaaataaagatttctgtacgtacatttaaactttcctggtttacaaaaggtaccaaaattaattcttttgtaatcggattaaacatattaatgcaataaagacattacaaaaccttgtgataatactttttaaaaatatactgtttgcttcattgagcttgaactaataaccaggggttcttaatgtatggacaaatatggtgtgctttaatttgtaggtgtgatggttgcaagaggactcttagcaaacccggccatgtttgctggatatgaggaaaccccactgaaatgcatctgggactgggttgacattgctcttgaactcgggactccttacatgtgtttccatcaacatttaatgtacatgatggaaaagataacttcaaggcaggaaaaaagggtatttaatgctctgtcaagcacatcagcaatcatagattaccttacagaccattatggcatttgactagacttcccaaataattttaatatacacttttagacccacagtgaaaccacagaaggtcatattttgtaccttaaaccagtagctctcaaattttagtataaaaacaattcctgggagcgttttttaaaaatcagttgtagacaccaccctcagagattctgattaggtagatctggagtagacccagaaatacacagtttaaagaaaactcccagtggttcaaacatcctgatcatcctaggcaaacattgacaaatactgctctgaatcctgttctatagatattggggggatgggtagagtgggaattttttcctaatcatgtttttaacattttaaaataaaatttaatactaagaaattatggcttatagtatctataaattaacaagaagtatgcaggtgcaaaaaagtggtggaacaaataccaacatccatccaaaatgaaaaagaacaggaaattctgaatagaattgcactcagaacttatattaaaaattccatttggttaatgacattaaatttggtacatttcaaaacttctaggtcctccaaagattgaaagcttaataatctcctacctaaaaagataaaattaattgcaatctaccatatcttaagtataggaaatttggtgtccaacctggagatgattatatatttgaaatatttcctagagaatagtaaccaggttttgtttttaactttaaaacctaattacttttgtgcctctcagccgttgattgtaactttaaagtcccatggttttggagtgttattaatagattttgttatcggtgggcatgcactgcaagaattaagtatctcagactgaaataaaaccgttcataattaaagtattattttgttttgccaacatgaaaactgttataaggaaacaattatgtaaaactgtttaattcacgtttgggaatattgaatgaatccattttaacataagcactgtggtgccatcttttttctcagtacattctgttttcacttttcagttaatgcatttttttttttaaagataactcgctgtttcattttctatgaatactgtacaaaatagggaggtatggtcagaactctgaattgaattaccctagtgttgtgagcacagcatcatcactagagtaatgtgctcggtgtttggaaggaaccagcgtggatgggcaagaagttctaacacttttgattaaaagtaacttcctggccgggcgcggtggctcacgcctgtgatcccagcactttgggaggccaagacgggcagatcacgaggtcaggagatcaagaccatcctggataacacggtgaaaccccgtctctactaaaaatacaaaaattagctgggcgtggtggcgggcgcctatagtcccagctactcaggaggctgaggcaggagaatggtgtgaacctgggaggtggagcttgcagtgagctgagattgcgccactgcactcctgcctgggcaacagagcaagactctgtctcaaaaaaaaaaaaaaaaaagtaacttcctggctaggcgcggtggctcacacctgtaatcccaacagtttgggaggccaaggcaggcagatcacttgagtccaggagttcgagaccagcctggccaacatggtgaaaccctgtctctgctaaaaatacaacaattagctaggcatggtggcaggcgcctgtaatcccagccactctggagactggggccagagaatcacttgaacctgggaggcagaggctacagtgagccgagatcgcaccaccacaatccagcctgggcgacattgggagactccatctcaaaaaaaaaaaaaaaaatcttccttatggttaatttatgttcaaagtctatttttctattttttctgttacatgtgatccagaatattagtgataaattaagaaaaagcaccaacttaaatgtgtttttgaatgttttatattctataattatcaattttcaacatttatttactattccccaaataattgttaccaggatagtacttttattaaattcctgatacgttgtcaatattgaaaaaactcaacaacttaaatgtacacgcacagtttgaaaagctggaaaatagtgaaagaatatccccatacccacctttcgtaccagtccccaaacatcacggtaaagtttactgtctcttcccagcccatggacgggaacgggaacgcctacggaatatgttgtgacatacagttgatcctaggttctccagaacaaaatgctgcacgaccacctcatcctggccctttattaaatatagcttaattctggacacaaacagttcccaccatgaagagagagtaggtgaccggaaaggagtgcgtcttaagcgcgttcgctgaatttgcaccacccaatccagccccgccgcccggcgccgctccttagacctggaccccggcaccctcccgccggggccgcacttagcagtggaaagtctgtcctcctgaagaagttgcgctccgacctccaagcatcaggtcaaaagtctaactcattctctgacctgccgccaattagaaaacaactgttgccaataaacgtggtcgcgccgcctgtgacctcagccgggacggacccgcgggcgggagcctgcggggcgtgaggcggggtggggccctggctcccctcccccgcccagccgcggcgtctgacgtcccgcgcgtcggcggccgcggagcagcgcagggagccaggcgggctgccggcgggtaagggcttctgcgacccggggacccgtggggcgtaggccgcggagggagagcgccgctgcctggtctggagaaccccgcggagctggcctggcccgacccggcccggcccggtccgcggcgcggtggtcgagggcccgcggcgccttctgggagcgggagggccgggaagccgggcgttggtggagggaggcgttgggcttctgtcgccgcgaagctggcggaaaaggcagtggccagcgagccgcctcgccagttcccacgactcccagggaggtggcgacacccgcttcccgggccacccttttccccttcctgaccggggtccgtgcttgccttcccaggtgggggaaggtggaacactgtccatcccctggacaaaaacgctgcgcctcggggccttgaacccggttttgtttgaaaggaagcaagagaaaataagtgtttttccatttaggtgtgaagaaaaaaatgacactccaatgggctgcagtggcaacctttctttatgccgaaataggactcattttaatcttctgcctaccttttattcctcctcagaggtaggaaaccttcaaatcgttaactaataaatattggatcgctcttaatgtaaaatggaaaaagttttctgaacattaaaaagtttcgaaagtctttgaaaataaactcacctaacgaattaggtagtatataatgacaatattaaaataacattttatataaaactctgttacgtgtacaagtgaaataactttttcttcccttctaaaagaaaaggcgcctatacttttgattctgttgattacagatataataaagcaacgattatacttttaacacctgccctgccttgtctcaggttttacctttgttttattgccctgaattggagccatgaactaaataaatataagtggataaatcatgtttacagtacagcatgggtgtaaaagtgtttcactgaggcactggaacagcaatttagaaaccaaagccaataaattattcttagttttcgcctttgtaaccgttagtttcattaatgacaattttactacttttgatttcacataaaattaatgaatgtatattaaaagtgctgaatgtgaaaagtatcacaaccatgtattagcattagttcgttagtgacggaacttctaaggtcttgaagaaccaagtacagtgtttcaagccaagcagtggttcattttacccttgcagtaatctactttttagtcgtttaattttagatccagaaatttgatagtatgaatggggaaatacacatgtaataaaaatattgcaagatatttgttcatactcctggcataaaagaaagtatttcataagtgagatcctagagataacccactaaagtgtattaaaatcccaggactgggagaaacttcttaaagtttcaccttagctcagggtccagatagtctttcacaactcctaacttgctccttacctgcctggatttctgctctcttctgtccttctctatcagctaagctaagctcagtaagttgtttcttactaaagaaaaaaaattgaatcatactgtagggtctttgatcttatttgatccattccacccatgttctatatatcacgtactgagacccaggagggcaagtagcctacggttacctagctggtaagtgacagattctagaaaaaaatctggctcttagtccagtgttctttctactccatcatgctgcctctcatcctgtaggttttgtttcaaactcagtaacaccctgttttgctttttggtaatatttgcaatgatagaatcctatatactcaagagaaagaaagattttgtatataaacatctaatttatagataaggcttaagggtttgcaaagaaggaaaaattgtcagttgatctttactccatcagagtgatctgtaacttatggatcaatatttttcttcctgccaaataaaaattttacccatcctcatcaagtagctattagatagatgtgtgtatatttgcatatgatatataaatgtgttctcatgtacagatataaagaaaatacggtatgtatgcacgcagatcatttacaatatgtcctatgtgtgtatccacatctttttatcttttatatttgtatcaccataatctttaaagaaaatatttcatcatttagtctctattattttcttacataacccagtggttaaaggcacatgctcagaaatcaggtcacctataactgcatgttactaaccttgggcatgctcttgatcctctctgatctgtttccccatctgtaaaatggaggtagtactagtgtctaccccttacggtagttgttgtaattaaatgagataaaacatgtaaaagtacttagaaccataatatagtgagaacacaataggtattagctatgataaggtgctcaactgctagttgttccctatgagagatctcttacattcccttttacaccacaccaaaccttgaagaaataagtaaatttacatttggacctagatcaaggtattaccacttatgttctcttaaaaatataaaattttatattgcataatttaaatattggctgtataaaatgcttggacttggaagcagagacaaaatgaaccgattcatctgtatgaatctccctcaacccaccaatttcaagtagttacttgaagttgtcctaatcttaaatcttaaatgtgtcctaatcttaaagtgaaactgtttttttcaagttgtaagtgcttgaagctatttaagtgcttactacatttttctgcctcctttcaactaaagtgttactcatttaaattgcccttgtacaaagtttgttacctttcctattgcgtgatggattattttgccactttgccatttataacccatgctttcttaccactgtctttgtttatactgttcaatccacctagactatttccccatctcatttcctctatgttcacatctttatctgtagtaattacatggttttatatatatatatatagtgtgtgtgtgaaaattatcaagctacatatttaagattttttcaatttatgtgtataatacctgggtagtttttataattccctcatggttaaagtagagaaacttttagttggagtatacgttaaaattgtactatataaaaatcagtatgcagagttagaccccactcctgaaatgttgccaattgttagaacaatatatctttatttctaagtcatttctctgaccatgaaaaagatacagagtagtagcttctatcaacaatataatattttactactgcaagaattcctttttaaggttttgctcatgtatggtttacttttagaatatttaagccaccagacagaggataatcaaatatcaggttattattaaatttgaaagagttgttttttaattcatgagatattctgtcatgtcagaattaataaattttaaaattaaatttctgtaattttcacttgctacacaattactaaaatgttacttcagtatttaaaaagtatttcaaaactttattttagtttttttatacctaatataattgtattgctttacagatggcagaagattttttcatttaatgtctggggtaaaattgcaactttttggaacaaggctttccttaccattatcatcctattgattgttctatttctaggtaagtactagatcccttctttgaataaatataactttttttaaatgaatttctttttaattaatagagttgatgttacaattggtgtacagttgactttatatagtatattgatagtacatagagtggatactgatatattgatacacagttgatagatactaccattctgtatgttcaagcttaagtttcaacagggcacaatgattcttaaccccttctaggttattttaagatttaaatgctgtatattaatgcataccttgctgttcagagttaccagactttatttttcatggtgttgtctctcctttgttactgtgatgtcctaggcacccaggagcttagctgttagaaaggcaaataaaagaatagaatcattaggctctccaaaggagtcttagatgcagggtgtgcatttggactggattaaaaaataaacatggccgggcgaggtggctcaggcctgtaatcctagcactttgggaggccaaggcgggaggattgcctgagtccaggagtttgagactagcctgggcaacatagcaaaaccttatctttacaaaaatgtaaaaattagccaggtgtggtgatgtgcacccatagtcccagctactcgggaggctgagagactggaggattgcctgagcccagaagttcaagtttgcagtgaactattgcactccagcctgagcaacagagcaagatccttccttaaaaaaacaaacaaacaaacaaaactgcaacatagatttggggactaccgcaaaaatttgaatatggagtgattgtataatattagggaatttttgttaactttagttgtgataacagcattgttacatagcagggtcagcaacctatatagcctgtgggccaaatacctatttttgtaaataaagttttattgggaaatgaccatgcccatttgtttacataatgtctgtactcgtttttcagcatgttttaaattttcatggtaacagtattttaaaaattaaaagtagacctttaggttcttgtcaaaccagaagttccatgagtcttagtaatcaccatgtttttccagttgttactgagctcagagaaattgagtgacttgtctaagattatctagctacttcttgaaatgccccttcttgcacagagtatgttttccctcagaattccctcagagttgttgtgttgttggttaaataggatttagagaggcgaacttgggaccctaaccgccatctttgacactgttttgtgagaaaatgtcttccatgttccaaaccaccaatctctcaaatagaatcctctttataaaactaagaacatctggtatgagaagggatggtattgtcaaaaacagaaaggtgtgaatgatttgtgcctcttttcaagatgtaaatatttgtctcatggtacattattaatgttatggattgaatctctagccatataactagttatgagaagtcagtaaagaacaataaggaaaaccggttccagttctgccaccagctaactaaaggacctttgaaatggcttttatttcctgggtttgatttattcatcttgtgaaataaagggagagatggaaagaatctctgcagctcctgattttatgatcttctaactctaaaattatcacaaaaatttctattgaaaactgtcacttatcatgtaagggaggggagttgtagtataagttcttttggttacattagaaacaaacttggccgggcgcggcggctcacctctgtaatctcagcacttcgaaagaccaaggcaggtggatcaacctaaggtcaggaattccagaccagcttggccaacgtggtgaaaccctgtctctaccaaaaatacaaaaattagccgggcatgggggcgcgtgcctgtaatcccagctactcaggaaactgaggcaggagaattgtttgcacccgagaggcagaggttgcagtgagccgagatcgcgccattgcactgcagcctgggtgacaagagtgaaactccgtctcaaaaaaaaagaaaccaacttgaactcgcttgaccaaaaaaggaaaaatttgtaataaaatacggggctgttgcagagtagcccaagaaaggaaggaagccaaattccagggagggattagtacttggaactgaaatgtccttttcttggccatatacatttttcctatatatacttcattcttttttattatggactctgatattctgtctatctccaaggcagtaaatgggtaccacacagctgccaggtgtggtacccattccagacgtatgcaagggttaattcatcatctctgaatcccaattccacatcaaaggaaaaaaaattggaccagctagtaccagttatctactcctcatctcctataaccaggaaggtcacaagggagaatcatgactgctggctgaagcctgcatctttgggtaaacagggcaattaattcccagagaacaaggacatcatggatagttaaggcaaccagataggtgcttatcctctaggtctccatccaaaatggagtaatgacacctactttcgtgttttaagatttaaacgcagtaacatatgtaaagtgcagagtctgatgttcgagtccacaacgatgtaaataatgcaaaaccagtggattactcatgcttaatttatattttacttggaaatttatttcctttttcttggttatctctctaaataaggtaacttttttatacattttctttttatatgtatttattctttttttttttttttttgtgacggggtctcactctgtcaccaaggctgaaatgcagtggtgcgatctcagctcactgcaacctccactttccaggctcaagtaattctccagctgcagcctcccaagtagctgggactacaggcgagagccaccaacccctggctaatttttgttttttttaatagagacagggttttgtcatgtttcccaggctggtcccaaactcctgagctcaaagcgatccgcccacttcggcttcccaaagtgctgggattacaggcatgagccactgcacccagccaaaataaggtagctattaagaagtgtttgtattcttagagccaacactaactgagtgtgtgcatacaagtgtgtgtgcatgtgtgtgtattttaggtgctggtaagagacagaatggaagtgggaatttcaagagtgtgtttagtgttagcagaaatgcatcccaggaatttgaaagtttccataactgatctaaaattggatcatcttcaggtggtttatagaaaattgactatatgtcacatccttcccttattgttgactccattccatttttcagacatagttacctttttagtatacaggtgatgtattctacaggtatgtttacatgaccattgacattaataaacctttttaatattattggttaatcttcagcttttctgcataatggattcaggagtattattcccatttaattaccaaggaagatgaatcacgaagcataatgatccttcatagtactcactatttgcctatttaaaataagtcgtaaatatatattatctttgttggttttttggtagtggttggcatgctcttactatattattgaggcaatctgagaaatgacaaaggggaaatagccattaagatacaggaaattttctaaagatcatttaagagactactttatataactatgcaaataaattggaaaacctagataaaatgtataattttgtagaaaaatatgatttaccaaatgaacaccagtagatatagaaaatttaagcagactaatttatatagaaaaattatagaaagttatcaaaaaggacccctatttgaaaaaaaaagcaaaaaaccagatagttttataagaaaccctactgctttcagaaaacagatattactactgcttcttaaactgttctagaatttaaacttcaaattgtacagagctagaaaaaagcaagctgtagaattgaaaataagtcagaacaaatgaactgaatagtacatcagattgcaatatataacacagagaaaaataattactcttgaacatagtactcttaactttttacctcgctggtagggtacattttaagaaccaagaggattacaatgaaatctgaaactttataatagttttattgttggtaatttaaaagctgttttatgtatagtgcagcatcaagcaaattagtatgttcatggtattagaaactaagactttcaggaatagatatggcatacaaatataaagtcaaaaattaaggattttttaagttttagagtgatttatttgggttttattttggagtatggaaatgtggaactagatagaggtggtagttgcacagcattgtgaatatactaagcatgactgaattgttcactttaaagtgtttacttttatgttatatgaattttgcctcaataaattaaaacaattttgttaaagacataggagtctggctttgttcatagcaaaacgggttgtattagactatttctcctgtgttaaaaattatgaaccctcgataaaatacgaaaaaaggtatttgaaggccttgtagagcaaccaaaagcaggcagaaactagagggacgtcaacccttaaaagaagggaatcatactgggtgtgatcacatttatatagcctttcttccaaccgctttccagtcatgtggcatagacaacgatatagaactcaaagcaaaaagacagtcttaactgacttaaggggtcagaggtcagatagattcaaaaataagaaggatgtctaagaaaggagagaacccaaaaagggaaccccaaaatccacatgtaaactccccttaaattcttggttgactcttcaaccatggatgtgtaggaaagattccaaggaaatcaatgaaaaggaacagccagcaaaaagcagcaaggctgagaagaaattttggctgctggccaccaaggagagacagagtttggagtatgagcctcatcacgttagaggggcttggtaaagaccttgaacctttccactaaaatcacagaagggctactccttaggaatagagactatatcccaggaattagaaatttactataactaaggcctaaagcaaaatagacttaccctaaaaaagtataaaaatcaagcctctctaaacagctgtaaactgtacatcagcagtccccaccctttttggcaccagggaccagcttcatggaagacagtttttccatatgcaggagcaggggatggtttcgggatgattcaagcacattaaatttatatgcacttcatttctattattattacattgtaatatataatgaaataattatgcaactcaccgtaatgtagaatcactgggagccctgagcttgtttcctacaactggacattctcatctggggatgatgggagatggtggcagatcatcaggcattagattctcataagaagcatgcaacctagatcccttgcacgcgcagttcacaaaagggcttccactcctatgagaatctaatgccaccactgatctgatagcttgggcagtaatgtgagcgataaggagtggctgtaaatacagatgaagctttgctcactggcctgccaatcacctcctgctgtgcagcccaattcctgacaggccgtggagcagtacaggtgcatggctccaggtgttggggacccctgctgtacataatctttgcaagggcacatgaatatactaaactctcttcaccaagatacactatattctgggccataaaacaagtctcaataaatacaaaggattgaagtcctaccaaggattggaatcatatagagtatgggggttttgtttttgttgttttatagagacagactttcgctttgttgcccaggctggtctcaaactcctggcctcaagtgatccttcctgttcccaaaatgctgggattacagatgagagctactgtgcccagcccctacagagtatgaaaatagaaatcagtaacagaaatctggaaaacctatacatgtttgaaaattaaacaagacttgttagtaatccttgggtcaaagaactcacaaaggaaattagaaaatattttaactgaacaataatgaaaatacaatatattaaaattttaagatgccattaaagcactgcttaaaggaaaaattatagatttgaatatttatttttaaaaaagatttaaaatcggtgattttagtttccaccttaataatatctacccattatattgaatattgacagtgaaaaaaataatattcactcagttgttttttaaagatttagaaggaagatttctcattctgatgaagagctacaaaaaacctcaagctagcatcatacttaaatatcaaagtcttcccccataagattggaaacaaggcaaggatatttacactctgtttattcatttgagtaatagatgtcctagccagggtaataataagtcatgaaagaaatgaaaggcttaaagattgcaaagaaagaagtaaaatatccttatttgcagatgacacgattatttatatagaaaatcctggcctggcacagtggctcactcctgtaatcccaccactttaggaggctgagttgggcagattgctcaagctcaggagttgcagaccatcctgggcaacatggctaaaccccgtctctaccagaaagtacaaaaattagccaggcatggtggctcatgcttgtagtcccagctactcaaaaggctgaggtgggagagttgcttgagcccaagaggtcaaggctgcagtgagacgtgatcacatcactgcactccagcctgggtgacaaagcgagaccctgtctcagaaaaaaaaaaaagaaagaaagaaagaaagaaagaaagaaataatcctaaagtatctacaagaaagttattatgtcaaagaaattaatatagtggggtcacaaaatacaggtgggtcagtatacaaaaattcagtgtatcagtaattgtatttctatactataagcagtaaacaataggcaaatgacatttttaaaaattccttttctaagtacaccaagaagcctaaaaaccttagaaataaactttataaaagaggcacaacagctctatacagaaaactacaaaaacattgctgaaagaaaatcaaaataaatggggatttttcatcagttggaatactcaatattattaaaatgtttgttcttccaaaattctacggacataacacagtccctgtcagaaacccaacaggcatttttgtagcagttgatcagttgcttctaaaatttatgcagacatgcaaagaactcataaaacagtcaaaaaatctttacaaataacaaaattgggagactcacactaccagatttcaacagtaaaggggaaaataaaaacaggttagtgggctttatctaatcagctgaaagccttaatagaacaaagattgacctcctctgagcaaaaaggaattttgaccgcaggttgcctttggactcaagatgtatttcttccctggatctccagactgccagtctaccctccagattttaaacttaacaagcctctacgagcatatgagccagttccttaaaataaatctcgagctctctctctctctttctctctctgtctgccccctgtaccacttttccccacacacacacacacacacacacacaccctattggttctttttccctggagaacccttacatcttaactaagtaatcaaatttagcatcaaaaagtatgagacaaactaacattacacagcataaactatgagggattcttgccaaaagtattaaaccttatccaatcaagtatttgttttattttatttttactttctgaggcctggcagaaccaatcaagtctgacttctggttttctaaaaatacaggagttagagaaagaaattggactacactcagacaaattcagaacgtgagaactttctttgtgcttattttttttttaatatttaaaaaaagagacagggtcttgccattttgcgcatgctggtctccatctcctggcctcatgctatccttctgcctctgcctcccaaagtgctgggattacaggtgttagccaccacacccagccagaatgtgagaactttctagaaaacaattggcctggcacctttttaaaaaagtattatatgtcaagagactacagaaacataactatatgtaatgagtatccattataaaattctcagtttgaaaaaaattctatgaaagacatttgggagacaaataaagcaaataacccaatttaaaaatgggtaaaggatctgaatagatatttttccaaagatgatatacaaatgatcaacaagcacatgaaaagatgttcaacagcattagctatcagagaaatgcaaataaaaaccacaaagaaatgccactttacacccactaggatgactataatcaaaaatataataacaagtgttgctgaggatatggagaaattggaaccaacatacactgcttgtgggaatgtaaagtagtacagctgctttggaatacagtttggcagttcctcaaaaattaaacatagagttaccatatggcccagcagttcatctcttaggtatgtaccaagagaaatgaaagcacatgtcgatataaaacttgcacatgaatgttcgtagcagcgttattcataatagccggaaggtggaaacagctcaatgccatcaaccaatgaatagataaaccaaatgttaccacattcatacaatggaatattattcagccataaaagtaatgaagtactgacacatactacagtgcagacgaactttgaaagcattatgctaagtgaaggaagccagacacaaaagagcagatagtatatgattcagtttatatgaaatgtctagaacaggtagttctgtagagacagaaagcagattgctggtcaccaggagctgagggatgtgtatagattttctttgtggggtgaccaaaatgttctgaaattagatagtggtaatggttatacaactttgtgaatatactaaaaactactgaattatacattttaaagaggtaaatttttatggtatgtgaattacatctcaataaagctgctaaaaataaaatagtagtcaaaaaggccccagttttctaactggagtctccttgtgtggcaataactcttacccaagacttctgttggtcgcatgaaaggggagcattcaaacttgttcatatacttccactggcttttgagaccttataaggcagatgccttccctagtacatacaagaatccaggaactaagaatgcactcaatgtagacccttataagctgatatctattttccactggaaagaagtggttcccctgcatctgagacttcccagaactgaaagcatcaaaggagcagctatctgaacctttccagtagcagctgctatgcactagtcggaggagtgtatgccaccacagatcaaatcccatgttaacaaacttatgccagtggaaatttcagtataaccaaatattttgaaaatctcaatcatttaaagtaataatatgtaataaaatgctagtgtagtaagagaaatgggatagtctcttggaattgattgtaatgggatatgacatctgtcattgtcaataggctgaattttagtcatcttagagacagaaaatgtaaaggataatagtttgcagtgtagttagagatgagaaacaataaaatgatggtaagtactagatgaataattttaaaaatgctatagtaattcaaaatttgctactagtgtccatttatagagcacctactttgagcatgaaaagttcccgggtactgtagacggaatgacataaaggtcgcctctgcctaaagtccattatttaaaagtttggtcagtttttctaaaactgctttccatttttaacaagcttatattcgtaaaagccaaaagtactgttttcttttgttctgtaatagatgctgtgagagaagtaaggaaatattcctcagttcataccattgagaagagctccaccagcagacctgatgcctatgaacacacacagatgaaactttttaggtctcaaagaaatctttacatttctggattttccctatttttttggctgtaagtaaaaaataataatagaagcacaatttaaaaacatgacttatgctttcctttctcattttgtccacctttactgtagattttttttttttttaagagagacaacctttcgctctgttgcccaggctgcagtgcagtggtgccttcatagctcactgtaacttcaaactcctgggttcaagtgatcctgcctcttcaacctctcatttctaggactacaggcggcacaccaccatgtagggctaatttttaaattttttgtagagatggggtctcactgtgttgcccagactggtctcaaactcctggcctcaagtgatcctcccacctcagcctcccaaagtacggagattacaggcacaagtcactgtacccagcctactgtagttttgtttgtttgtttgtttgtttgtttgtttgttttttaagatggagtctcgctttgtcgcccagactggagtgcagtggcgcgatctcggctcactgcaagctccacctcctgggttcacaccattctcctgcctcagcctcctgagtagctgggagtacaggcgcctgccactgtgccctgctaatttttttgtattttcagtagagacagggtttcactgggttagccaggatggtctcgatctcctgacctcatgatcctcccgcctcggcctcccaaagtgctgggattacagatgtgagccaacgcgcccggcctgtagatttttttataacatctttgtaaaagaattcagatgatatacccaaataacaaacagtagttaacagcttgtaggtttgcccagtccataaggccctgaatgattaggctcctgcctctctttggagccttgtctcatacgtgtctctgagatgtacaatacattccacccttacagaccttcaccatttattcattcattccatcttgcaacagatattgattgagttctgtggtgtacctaactctttcccattttagggtctttacacaagctcttccttttgccagaacactcttttctttcctcatttcctggctaactcttactcatccattagcctctttctcaaagccttctgtggccatcactacccacaaagtaggtaggtcttctcttacaggtgctcaaagaatgtatatatacttcattttctagtgtcattcatggttgtaattaaatactgttttaacttttgcttccacaactaggagctaaacccctgagggcatggactttgctgttttccgctgtgtctgcagtgcctggcagagtgtcttaacacttagcagttcctgagtaaaggaatgtctgctgaatgaataattgaagatagtcatcactatttcttctaacaatggcagttacacataaacggatgtgaatgagctgttcttcggcttgtttgaccttacacaatgttccttaaatagcagaatttgaactgggccaaaaaaaataattctcctactggccctgtcacactgtctgaaattttcctgtttctattcctccaagctaaagccttctacaggaaaacaaataagtaccactgaacctgtattctaaatgctggtcttctaacaaagattccaaaggaatgagacacgggcctgtttttactaagagacttgaattaaaaaaagaataatgggttctgcctaaacattatctgccaccaccacacctatatctaatggggagtaatttggcaatgactgttttaaaataagtttctggtgattggccagtaatacattattctggttttttttcttagagttttgagacgtctggttacgcttattactcaactggcaaaagaactgtcaaacaaaggtgtacttaaaactcaagcagaaaatactaacaaggctgccaaaaaatttatggaagaaaacgaaaaactaaaaagggtatttaattttctttgtaaaaattaaatgttgttggtgttcccgaggagtaatgtatttgttttcagcatcaaaaagagcatttttatattttataagcagaaaatgaccataattaacaatattttatgtaatgattatttcaagaatagttttactgttctttagaaatgcttgttcacactaatatttttactattatttagatttgctttttctccatagtggatttataccattggacctattttctgtgatttaaggagaaaatagtattctgggaatatgaattttaattccttcattaccgttaagtttactttataatctaaagcaagtctttataactgtttctatttctttttcagttaaagtatttttaagcctagattttcgttttcttttaaatgattggtttatagaaagcagagaaacgtcattgatgctagattgataattgcacataatatttgaaatctttaatgttattcctttattttctatcttttgatctcatttcacagtggcaaaaataaaaacacagtcattaaagctttgattgatagtgttaactaaactcaaaagcacgcagccttgtatttatagaacaactgatcatgtacatatcttaatttaaaattatacacatcattttggagtaatgatttgtaaccatcagaacactgctttttttcctcttcaattgtttttctcttattctttagctctaagaaaatggaaagtgttatttttttcatacataccatacttaatacacttaaattagtcttgcccttttaaaaaaagcaccttcctcaaaatacttttgcaacttttctcttggaattgttttcagaaccatttacccatgcaaggaaacttatgtcatgattaccaattccttgaccctgcgtgatttattctttctgtttgtttgttttcctctcctttgtttccatactgtcctgatttgctgcttcctgcatagctgtgacccaatcagaggaggcacagatatgctgggctaaagccagtacacagtggggagaaagtctttgagcagcacataaaagcagctgtcagtgcccagagtataactaattgaccaataaagtgaccaacaaaggccataagtgagaatataaaagatgacgtctgtttcaaggtacttcatgtaggttttgaaaaataagctaaggaaagataagcttgtgaaaacaccccctttgttttgtccttccttcctttctttcctttcctctccttccctcccttcctccccagactgatctcaaacttttggcctcaagcagtcttcccaccttggcctccagaagtgctgggattataggcaagagtcaccgcgcccagccatacctcttcattctctatcagagacacattatccagtggaaactgcattaccctgagatccgagagacttaggtgctagttccaacatgtgacctagcacaaatcacctatgttaatgggcctcaaagttccttagctataaataatagttaacattgtgccaggtattgcttcatatgcttcacaacaaggtttttaactgttaattttcacaaaagtcccttgagtttggtattgttattatctgcattttatagatgaggaaatggaggcatagaaaggttaagtgacttgtacaagatcattcaactaatatgtgacagaactaaaatttgaacctaagcagcctgactctagaatccacattcataaccacattattttgtgccctcaactcctatgttatctgatagaacaatttccacgtggtacctatgaccactttctgttctgatattcagttaaagaaatgaaataattatgaaagaccaattaacttttaattttacttcttcagtgtgatagagctttactttgtcctgatttttttttccagccacgtaacttaaccaaggtgggataatttggattagacagtgaacgcttgcattgttgtagctggtaaacattaaatttcagatttcagtgttcttggtctttctccagcgtcaagttacacatcataaatttaggcaagtttacaggtgcagtagtgaaagcttatttacaagactaacacaaatccaccttttccaagtcaatggcatgaaaattcaagcagtcagcgaaaacgttcctgcaactcaatgattctcttctaatttgggtaatcactggagattttatgaactgaattcagtgaagtaatagctggagttgttttcaacttgaagtaggcaacacattaaaagagatttggagaaatttttttcttgtgctgctctttacaaaaaagaaaaacttttaatttgagaagatatgaggctcctttagtttcagaatgtatttcaatcctcccttctccaaaaaacagtccttgggattatataatatatgcattagagctttaattccttctctgagctgcctaatctctatatagcacagtagtactgtatttggtcttgtgctacagtttttatgctcgtttcgtcctttctactagattgaagttattcaaaagtagagaccatgtttctcttatatttttatctcttacagcaccttacattgtaaaaatatttgcatgtagtcattgctcagtagaactttgtattttgatgaatatattggcttacattagaaaatgaatcaccctgcagtgaaattcctcttatgttagtctgtttaaaattctcctgtgttccttttttacctgactatagaacctgtcagtatcaagttgctgccactggccaggtgcagtggctgatgcctgtcatcttagcactttgggaggctgaggtgagaagattgcttgaggccaggaatttaagaccagcctgggcaatacagtatacacacacacacacacacacacacacacacacacacgcacgcacatatatgtgcacacgtgtatatataaatttatatatctataaatttatatatatttatagatctacaaatttatatatataaatttatattaaaaatttgtatatatataaaatatatttataaatatataaatatattaaaaatttatatgtatataaatatatatttataaatatataaatatattaaaaatttatatgtatataaatatatatttataaatatataaatatattaaaatttatatgtatataaatacatatttataaatatatatatacataattatatatatttatatataaatatatataatttttatatatatatttatatataatttttatatataaattatatataaattttatatatatatatataaatatatatatgcacacatatatatatatataattttttgtaaaattagcctgccatggtggcacacgcctatagtctcagctactcaagaggctgagatgggaggatcacttaagcccaggaggtcagggctgaagagactatgggttgcaccactgtactccagcctgggtgacagagtgagaccctgtttcttaaaaaaaaaaaaagaaaaaaaagtagctgcctgcctctttatttaatctattgacccacaacagtatacatattatgtttttcaaacatttactttgtctttctaggtaatttaaatgctttatcatttctttaagtcagcttcttagttctgatgataattatagtttctgtacacaatacagatgattaaatttttactccatgataattttattttgatcagttgttttactatatggatcttaatttttcttacctagaaaagataagctacaaacactaacatttttaaagccagaatcaattttaaaatataaagagcattataaaggattaatggaataacagtaatttggaaactattcaatgaaaattagaactttccagctgtagaaatggtcctgtcatttcccacttacccatctccactctgacatattcttctcttacaaatttgtctgtataaaaataggctgagtagatagctctacaatcagaacataatggttttctaattaatatcatcctcagaactgtttttttcccttagatttacatttctcattaattgaggaagaaagactgacgttatttacctaaatacttttgagaatattattttaatcacagcaactagaaattcttatgttcattttacagattttgccataataggaaatcttttttgtgtgtttcccaaatattaagtttctgttagcaaaagtacattgtagaaaactataaaattctgaaaaggacaaagaataaattataaacaggtaagtttagataggttactcagcttattttctgtaagaatgtctggctattgcaatctaagcttatttcttcctgtatctccttttgcaatagattttgaaaagccatggtaaagatgaagaatgtgttttggaagcagaaaataaaaaactagtagaagaccaggagaaactgaaaactgaattaaggaagacttcagatggtaactttgtgtacatgtgaaaaagtaaaaagactagcatgatattttatgctgtacacttcactgtttttcctaaaacaaaactaatgcctaaatgttcttctaagataccgagaatgacctatttataaattcttgttcaaatatgaagataaaacattatgtcagccaagagaaacatgctctgttatacagaaaaacatgtaggtgtttcagatctgtgttgtaaatacagatgttcttgccttagcaaaagagctgtgttcctaaaaagttgtttataaatgtgtttttataaaaagaatcacatttttccatcatcgtatattcctcctctcagagaagcaattgtaggggaacagttttcttacaagaaaatatattgtttatttcaagcactaatatattctacctgttagacataaggaaagcgttccttgaaagaggtgggtaggcacagagtaggcaacaatatctgggatgtcagctaagaatttgagtgcctccttcccacataacattgcagtgtaggcttgaagtggagcatcccaactccattttcctgaaggcagcaatttcttctacattaaaaaaaaaagttttgctagtgtttttttcttagtcaaagaacaaattatttttgttgcatctgcacagcacagaaaagtagataacccaaattcagtgtcatccaagaaaactcagtgtaagtttgtggcttgatgatttgcaacatttctgcatacaacagatagttttttatgttggccagacactgagaaacctcactttcagttggtgttaaggtacgttgtttggatagggtttacttcaatcagggtgtatttgaatttgagatgaaaaacataaaaataaaagctaattctgtgaatagaacagaaatccactggagaatatttatgtgatacaaaattctttagtcacgttcctccttattatttcaagtgaaaaaaagaagacagttcagaagcaataagttaaaaaataaattacccttatagacaaagtggtatattatgtagttggcatagtatagcccaaaattcaagaatcttctagttggtactgttgccttttctgtaattccaaaagatttcgaacatgatcaagaaatgttattgtttatatgaaaatgaatttaatagttacctaccgtttacaacagacatttcagaagagaaactagtgttcttttttaaccctgcataaaatattgctaccaattcttttgaagaatgaaaccatctatttccaaaacacaaaaatattctttcaaaatcctgctttcttttttctgtatccaccaagaatctcttttcttatgttgtaagcagggtggcacaaaaataaaagatagacaagagtgtatgtgtgctacacttctcttaaccctgcacaattgagtttctcctttcacctttcaaaaattccagctctgagatattttgagttttaactctttaaatctggcataaaacttaacttagtattacatgagcatttctttaaaagacaaaatcagattttagaaaaaatgaactctttgacaatgtaagcattgtgtttacaatctgataacaactgataccagcttctgtgtttgaagtatagactgcagagctactttcaaagtgaattagtgttcaggtaaaggcagattttacctgttcgagtgtgtcctgtttggttccagcaagacatataatattttatgaacatgttttatttaccctaagtttttttaaaaaataacatttgtaatgaccttgagaagatcagagttccgtttctaaagaaggtgtttccttggtcatgttctgttgacctaaaccagttaaattcagtaaggtaagaactaagaaaatatatcaattaatagtgcatgatttggatgaattcagtggtacaatgctttgtgcacagtaccactcaaaaatattcattgatttctaaatattgagggtgttaaggtgacaaggcttaagaaagatttagaaagagatcttacatttgaaaattgagttaaaaaaaagcaatttttttttttagaggaaaatagggtgttttccatatgaattttcttatcctttgtgttacttaaatctaagtgaaacattttctcccaagtgtattattggaaacaaaacgtaaatacaaatgtttatttaagctagttagccccaaatttaaaaagtggcattctgaaggcagctactgagaacactctatcagtagtggcaaacaccttcagtttttaacctccaactcctattttgaccaaagtttgtaaactattaccggtgcttccgtgcagtaatatcaccctagcacagacattgcatttagtggaaaaaccttctgatgtccaaagagattgactttaaaggtctcttccaggaaaactacttattttcataaatgaataccttcttttattctttttttttttttttttttttttgagatgaagtctcactctgtcgcccaggctggagtgcagtggtgggatctggctcactgcaagctctgcctcccgggttcacgccattctccagcctcagcctcccaagtagctgggactacaggcgcctgccgccacgcctggctaatttttttgtatttttagtagagatggggtttccccatgttagccaggatggtctcaatctcctgaccttgtgatctgcccgcgtcggcctcccaaagtgctgggattacaggtgtgagctactgcgcccggtctcctttattcttataactagaaatatgtagcattcagtcattgtatgcatccaagcaatgataaaagtaaatatcgtttaaaaagtgattgagctgcatgtggaaatgtctgttcttcattcttttaggagcaggaatacatatagatataaaaaacatcccatattttaaaaggaattcttagggcttgccaatcttgtagtaaaggttgaattagcagtatatgtcttctacataaaggaaaagagaaaacagtaattgggggaaatttcttgaccatgcctttcttctgtttgttcctgctttcctttgttccttctttgtttcatcagcaatttttttttttttttttttttgagacagagtctcactgtcacccaggtgggagtgcagtggtgcagtcttggcttactgcaacctcgaactcctggactcaggagatcctcccgcctcagcctcctgagtagctgggactacatgtgtgcaccaccatgcccgcctaatttttttgattttttgtaaagacagggtctcgctttgctacttagtctggtcttgaacttctggcttcaagcccttcctcctcagcctccaaaaacgctgggattacaggcatgaactgctgtgcctgggcctcagcaatttttaaaagaacttttcaagtaattcagtcgttgtaaagtcatttaatgtggagcataattaacactttccttaaaaagtgtgcctcttgaggataaagcaaactttaaataaatttcttaaagcatatactaacaatcagaaactgagtgtaaagacctattatgggtacctaagtattagcagcacgcaatagagatactagatttggaccaggaaacagaacccttagtcccctacttaaaataatgataattcaactctcttcctggataaatgctttcatatcaccttgacttacgttgaacaaaactaaaattaccttttgcagaccaactttgatacccttgaagatgttaagttttttttactttttattgccagttaacatagggaccagatagtgaaaaatagctgaagtgtttttccagagaaattggagatcaagacaagatagaaaattacaggggaattgctgatctgtatacccaaaaccctaaattcctgcctcttcagtgttaagaataagacataagctttgtatacaagtttaaaaccatatgatttccagtttcttacaaatgaaccatatattcatctaaaaataaattctaagtttaccctaagcatgttttacagttgtaaatttttgtggacgtgaacttagttatcttttacttacagttatatcaaagcccccagcttattttaaaattattaatgcttaaaaacagtttgctgtttttagtcattttgttgttgttgttgttgttgttgttttttttttgctttgttgccttttaatgcacttttgtgatttaaataagaaaaaaacatattatttgttttcatgtctggaagtttctgtttctttgacacctttgtcccttcttgtatcaactgaaaaaaaaaactgcattaagaaagaataatatagtttatttgatggttgtgccagtaggcaatatataattaatagtattttaattatttaaagtaaataaaactcatgaccaatccttttagttaggtaaataaaggatttattagtatttattagttcatctctgtgttatcttcacatattgatgttattgtcaaaacagaaaaaagggtttgcttgctatcagagtacttttcttggactaatatataatgatgatattgcatcctgtttggttccctgttacattcccatttagttgtgatgtttccctttcttgtgagcttcttatctgttatcaaggcctatactcataaactatgtgtctttcagtaaccaggaggaatagctatagggaagatattaagacagaaattcaaagataccttatatattattcacagtactagcaaacataacgatatctaccctgaggagaagcttttataatctccacagagggacattaaagcaagagaaaacagtttgttctcagaagagcttgtagtccagatggtaaaccaaacatatgtccataaagggattcatttcctccccagtgtgaaacatgggctagtctaccaaaaacatgagtggagagtgctaaatgcatactgaatcaaggaatgttccaggtgttaaagatgtaatcaagcacaattctctaaatgtgttgatggacatagaatggcagaaaaatgagtgaaatgatactactgttctgagtgagaagagcaaagcaaaaagcagagtggtctgtttgaagtcgatgtgtcacactaggtgcagtgaatgattgtgctgtatggttgaggggtccattgatgtagcccctaaaagatcgaaggagataattactttgaatgccttggtgttcttttctactgtcttattccatacctagatatgcatgtttactacaatccttcatggtaaatacttttctaatgatatcagcttatggcaggttcatgtttatggccaagtgagttacaaaaattaaactgtacaactctagttttaaaacactttcaattaggaaaaaacactaaactattaatagtggttttccttagcatgtacaacaaatgactttttcctagagtttaaattattttctacaatgaatttcttttgcttaatgaaaaagatagctttttattgtaaaaagaatttaaaaataaaaataaaaaacctcttccaaatacccaggtaatctagggcggtagttttttggcttgaattatctaattaattggctgtattccaactttactttgttggtagaccctaaatattagaagctgttcatatagcttttgctaagttatatgaattacattgcaaaatctgaggatacactgggtaatcttggtgaagtcattgactctttttaggcatagttttctcttttgtaaaatgagagactgaactagttaaactttaatgtctattatatagctccaaataatgtaattaagcaaaactgactatcaagaattattttcattgttggctttttgacccttcaaattatatttatttttcatgagaaaaatcttttcacagtaacttccctttctccaaacttaataagctcagcaggtgattaagccacattcttcacttttgaagaatgtttcatgcaatcttaggatctttaggacaggatctggcaggttttatgcatctgttagctcacaacacaagtgtgctatgtaaaatgggaacacaagtgtgctatgtgaaatggggccacaagtcttaaatgtagggcattgggagaagagaggatatgccagtaaacagaaccaattctcattagtgttagagcgtggctgtttgtttagaacatttattagaactattgatatggaataataaaactttgcagaagaaatgatttaagaaattagcatgttcttttcattataattatgttagggaaataaaaaatgggactagatctctagaggtcttcccagctctgagagcctttgttataaaagggagtatttatctggagcaccttttacttttttttattttatcaaagttttacatatacatatttttaaagcaaaatagtaacacaaggcttataatgaaaaagagcagtctcctgaggccctgtccccagaagcaactacattcaactcctttagaaatgtcctctgaggccgggcgcagtggctcacgcctgtaatcccagcactttgggaggccggggcaggtggatcatttgagctcaggagtttgaggccagcctggccaaatatggtgaaacactgtctctactaaaaatataaaaattaaccggatggtagtggcacgtgcctgtaatccccactacccgggaggctgaggcagaagaatcgcttgagcctgggaggcacaggttgcagtgatccaagattgtgccactgcactccagtctgggcaacagagtaagatcctgtctcaaaaataatgttctctgatatgtgcctccaggtttctaaatgcagtgtttaggtagttttttcttgatctttcagtatgggatattatctttgactttgttatagggaagacgaggacttagacctctttatctcacccagtttccctcctggctcctcatacttcccatccccctccatcctttcaatttaaatatatcataacttttactatatcatattattacaactatatattcatcatcattatgaggatttcctttgcctctttcctgtattgataccctctttcctgaattccatgttttctttctttttctttttttttttttttttccgagacagattctccctttgtagtgcaggctggagtgcagtggcgcaatcttggctcactgcaacctccgccccccaggtcccggttccagcaattctgcttcagcctcccgagcagctgggattacaggcacacaccaccatgcccagctaatttttgtatttttagtagagatggggtttcaccatgttggccaggctggtcttgaactcctgacctggtggtccgcctgcctcggcctcccaaagtgctggaattgcagatgtgagccactgtgcccggcctggattccatgttttctacttttgtataggttttgaaagtcacagaggtgccagctttcatcacattgtatcaagagtacatattattaacataacttatcagttttgatgttgaccttgatcacctggctaaaatagtgcttgtctagtttctgaactgtaaagttcctcttttccctcctttttccataccgtaatctttgtgaatcactgttcacagcccacacttcagaaatggggatcagtgtgcaaatgagtggattaaaaaaaaaaaaataagaaagggaagttacgctcaacctccttgaaagcagagtatctgtgtaaattgtttggaattctacacagatttgtctgttgtctaccatttgtttgtcagtatggactcataggtatttattttataatttgggttataatttaatactactttagtttattgttcaggttgtccagctttcaccattgggagctctttcatttggctcctgtgtccctttgacacatttccattttggatatttgtttgtttgtttgtttgtttgtttgtttcatttttggagcacttccttactttctggcattacaagatactccaggcttatcttgaacatttcctgccccattcttagaatcaatgtttagggattttttttaattgggctggattctttggtactatttatttatattttatttttgattctggagtagtatgagatatttgtaacatgagtatattttcatcaaaatatttcaagaatggtctctttgctttgttttggctatcctgagtattttggtttttgattgacggtgtttttatcaagattactatcaggtgactaaagtaacactttgtattgttcacctgacatttatcatttccaagtgaactgtttacacacaagtgaatttttcaaatgcttaaagcttacacttttcatttattcattctttcattccttcaaggagcatattttaagcacttaccaatactaggcaatatgctaggtactcagacagataagacacagctctgtttcttgagtagtccatagtctagtaagggcatagttgcccttcaattcaatacgtggtgtggtgaaacttgagttgtagtagaagccaacactggagatcgacactttcttgacattttaaaggatgacattaattagccagatgaagtaggaggagatggacaaggtgttataacaaaaatgagcagcatgtaaccaaaggagtatggcacttttgaggtactacaaggagctcaaggcaactggagtgtaaaagaagatggaaccagtggagagagttgagcagtaggcctagaagccatcctgaagggcctcatatgccctgtttgtacgttaacattttcagggcactcttagagggtttttaggcacaagagcaatcactttgacagcattatagacaatggattcaagtagacgggcaactacgtgagaaatccacttaataatctaatctggaaatgaggacagtggtcacagagctggagtggaaggtatggattggagagctataaaggaacttaacagctatcaacaaactttatcaacagatgggtgtgaggttaaaagagattaggtgttgattgaagtgatgaataaaacgtaaatctttacctacacagacctcacaatataggcatgtacaaaagaaggataatataattaaaccacagtttatgtccttactgaacagaagtttgtatgtctactttccaagtatcttggaagcattactgtagattaacaatccaataagtgatcattggcaaaggagtagtacatgtgaggattaaatactgaatagctccagtgtatcacactcttgaattctcaaaaagagaaccaaataaattggaaagaaaccaacactagacatatggaaatttttcaaataaaatatgttttcctctggctcagtccttacagctattgtacaacagcccaactttagctgtcatgccagtgcctctaaaaacttccatttcctggcagagctttactggcagtgtttctatctctggtcgaaatcacagtgatacaatacatttacacggtacgttagtctcaccagctcctcccacttttgcaaatagttccgtaagtgaacgtttgacacttggaaagacaacaaatgtttttgcttactatgtgtcactgtaacattagttgaagtcattttctatattaataaatgatgcaagtgcctttaaaaatatctaatggaccataacctaggacataacagtctcttattgaatctagccagtattcttagcaaatatctcagtatttccataaagccactggcaagtgatagcagcccgtttttgcagttaagaaaattgcagtagcaacttagatgtatcatctaaagcctccttgtccaataatatttttcttatatatgctgtttccaaaataatatgcctcaaaataaaataagcatattcacatgtcagataacaagtttatatagtcccttggttacagatgcagttgcaaaaggaggtggaaggcatccaaaacacaataatttttataaaatgagataaaggactgggaaacagtccaagatgtgtctagacaataatagcctcccctaattggagtgatagtattcattagatttattaatatccactgaaatacaaaatgaaataagaaacacattttataccttggcttagtaagtggcagaaaaacagtatttgtctgcatttgttccgttaataactttataccagtagtaaccagaagaaactcctagataggctgtacaagtggttttctagcttcttttaaaaaggaactactgggttgatatctaagatatattaaatttattaaataacttcttaatgtcagaaattcaagtataaattgtttttgacattaagaccaactcctgttcattacaagcacctgaccaactgtcttaatagaaagtactctagactcagtagcttataaacaacagaaatttatttctcacggttctggtggctaagaagtctgagatcaaggccccaataaattaggcctctgatgagggcctgtttcgtgattcgtagatggtaccatcttgctatgttctcacataatggaaagggaaaggcagctctctggggcctctttttattagtgcacgaatcccattaatgaggaccccacccttatgacctaatcactccccagccacgcctcccaatacgatcacattggtaattaggtttcaacatatgaattttgtggagagacaagcattcggaccataacaacaacattcttaaaactaccattgtaggccaggggcagtggctcacaactgtaatcccagcactttgggagcctgaggtgagagaattgcttgagcccaggagttcaagacctgcctgggcaacatagtgagacctcatctctacaaaaaatttaaaaattggctggggtggtagagcaagatgttgtctcaaaaaaaaataaacaccattgcaggctagtcagccactattagattgtggaatctactgtgtattttatgtaccagaaatccagggtcttaaacttttttgctgagctctgaagataccaccaccatgcatcatattttcaagtagcctctaggaaatgccttgtagaacccaaattgaaaactaacgtataactctttatgttgtgaaggtggtcctaatgaaatctaaccatccccaaaagtgtcttccatacctgactcatacctttagcaagtgacatcacattaaatttgtcaaaatcagtctttaataccttatttagaattatgcagctatagaaggaacatggaggaaattatagagctgtgctgcccaatatggctagccactagctcacatgtggctgtttaaatttaattgaacttaaattgaaaatataggtcctcacttaaactagccacatttaaagttcacaatagccacatctaagtagtgactaccgtattgacaacgcagatgtagaactatgtagaacatttgacaatactgtctagaaagtactgatacaaaaagcactttagttgataatggcttatatatttatataaaaatgcctatatgatgacttctcaagagaaaagattgtttataactggaacctataattttatttcattgtgccagaaaagtagcttttaaatttataaattctacttttttcccttaaactcctaccctaaaatacttccaaatgtagaacttctgaaggctacatatgatatagagctacttcaggattcccagagtttggaaaaatgatttctgaaagcactatatgagataaaagtttcaagtatgacaactctaatttttctaccccattttgtacagctcttctacatattttgctcattagcaccttcttcacaatgtattgttttatatatatatatatatatatatatatatatatatatatatatatatatttattttacttctatctaaggccctgaatctgctgacatatgacttgtagctccttggtaggtaaaggtcaatatatagtaattcttgtgtgccattatcttgaggagcaggatgtttgcatagactaaattgtcttcctatatattgctgctttagttacaaaggttaaaattgtaagtataaaatggaaaaaccagtgagggacagaggaactttggatgtaatgggcctctggatgccctgagaagcatttaatatcacttatattcatatgtaagtggatgcatgacctgaatttattcatgaggaaacatcagacaaaaacaaagtgaaagaacattctatctaaaaagtggcctgtattctttaaaatgtcagtatcatgaaagatggggagaagagggctgtgataatggtggggaattattccagattaaaagaaattaaagagatatgataactaaatgcaatatgtgatcttgcactgtatcctggactagcagtggagaaaatgcttaaaggacatgattaagacagttccaaaaactggcatatggatgataaattagatttaaagtattgtattcatattaagtttcctaaatttggtgactatactatggttatgttagataatattttgtttctgggaaatacattcacagaaatgtattgaagagtagaggggcacgatgcctgcaccttattctcaaatgagtcaagaaaataatagtgtgtgtgaagagagagaatatgataacaaatgtagcacaatgttaacagtggatttgagtaaagactatacaggagttctctatttaagccttgtaacttttctataaatttgaaattattctgaaataaaaataaaactattcgatattttctagccctttctaaggcacaaaatgatgtgatggaaatgaagatgcagtcagagagactttcgaaagaatatgatcaactcctgaaagaacactctgaacttcaggtgggtgtgacatgcactttatgcacctaaatgttttgaaatagtaattacctaagtaaattatttgggttatttgtccttaactaatcaagatgatgtacttaatcctggctttgttaaacgatttaaagaagccagatttttacctagagggtaaagattaggacattgcaggaaaatacaagataattttaaggaattgctgacttgcatacttacagcattccagttttggtgaatttttaagcaaaagaagccacaaaaatggcagcattggaaaacagactggttctagaaaaggtgagttttgctctttgggatgtttgccatattcatgccaaaatgaggccaaaatttcaagttccacatcacactactcttgtctcagtgttttagacatattaggacaagactttagcattcaaatttatcatttacctccaaatgttgatttgaaagatggaaatgggaaaaaaatgtttcattgttaaagccacaaagtcagatctgggccataggttttctttctctttctctctaattcaataaaagaaatggtcatccctgttaggcttgtctttcctccctcccttctgctgccagccagtaacctgaattgatttctcagacacactctgatcaattggggaagagaccattccagagacagccctggccttccctcccagtttctcccaagacagactggttgggcttgtcttcaaaatttggcagcctttgtggctttcagtcagggctttttacaaataatagctttttatttcactgtacacatttccctgcatcttaatggtcatggtatctccaagactcagcactgttcctggcacaaggcaagcatacactatactcatagactttgtagtcagacctacttggaatacctacctatacctggctgcatgctaggttttttatcttaggcaggttatagcatccctttggggctcacttctttcatctataaaaattgaaacaataatgatgcctggctcactggattgttaagagaactaaataaaatgtgtaggttttttagcactatgcctagctgacagtaaacactcaagaaatgataggtattatcatcatcatctgtattacttcctctgtaggaattttgctgaaagaatgacttattctcaaccaaccactttggccttggtttagagccagtaattaagtaacccaaagcacatatttgtaatctgatattcccagttggtttgcatgtttggtttaactagcctactttgacaatagcaaaagacaaggtagccagagaagggtgaataccctgtatgctccaatcccaggacactgagggctcagttcacatggcctggagcagataggtagattgtcagcaagaccaccccttccccgtctcaaaaatagagaccctaaaattgctgacctcattggggcatgataattattcgtggtatctttcaaggtccaccttggaaagtgaagaagtcacttcagagacctcttgcctagaaatacaacattttccccctatttgtgagattagggtttactcagccaggttgagtatcgacattagtggactttgccatgatgtcagacatgcttagatctttgaatggagaaaggaaaaccagaagtatgccttcagtttcttatggccagtgtccattgttgaatgtctccattgttgaatgtctccattgttgaatgtctccattgtggtaacagccattggttctcttaattctgaagaatatatataacagtgagatttcctcaacccatttcctccccacagaaaagccacagtcagcctggagctgctgcattcttggtaaaggaagtagaaagcttttaagagtgattcctggctgagcgtggtggctcacacctttctttaatcccagcactttggaaggctgaggcgggcggatcatgggagatcaagaccatcctggctaacaaggtgaaaccctgtctctactaaaaatacaaaaaattagccgggcatggtggcaagtgcctgtaatcccagctactcgggaggctgaggcaggagaatcacttgaacctgggaggcagaggttgcagtgagccgagatcgcgcttttgcactccagcctgggtgacagagcgagactccatctcagaaaaaaaaaaagtgattccttcccaagaaaatagttgttataatagttgtcatacctgtttctgtggaaaagaccccatcccagattatgccagacaccatgccgagagtagggccttgtttgatagcacttcaggacttgatctaatttctgcttgtatccagtttttgaaatatttaatagatgtcatttgttgagagtatgctctggactaagcacttggctaagggcttcgtatatgttgttttgtttactctccatgacagctcaataattgaaagtattttaatatccctattttgtgaatgaggaaactgagacccagagatgttatataatttatcgaaagtaactagaaagtgatagcattcaaagtcagagaatctttctccagaacctccatcattaaccactatgttctttggcctttgctgatcattggattgtgttcttggatccattctcctctcaccactgctttactctgtatctctgggaggcccgtttccaaggctcccttgctgtctgactcagtctgggcaggtttagccagtggcaggcactagaagactgaaggcaggaggaaggggaaagccagggatttcttctactctttctgctatagaggccttctcctttatgactccagttccttccctctaggtcccactgggcagcttctacatactggccttcgcacctgggctccataaccctcatccctccagcccaagaagtggtggtggcttttctgctattgataatcccagaggtgccttaccaccctgtttggtgtgtgtactttttcatcacctgtaaaaccaatttcccataatatctctgttggaaggaaaacaaaatctcagctccatagtttaccacttctgtaacccacaggtgactcatttgacatctatgctcctcaggtactttactacttaaataaaggttgtaataccttatgaaaattaaaccagatcctgtataagaaagcactttatatatttataatcaagaatgctatttattatgtcctgactggttacatttttttccttcacctacccatcccccaccgttgtccaatatgagaccctgtataagattctcagatttagatatcattaagagccccattttgtttgtttgtttgttttttgagacagtgtctcactctgtcaccaagactggagttcagtggcacaatctcagctcgctgcaacctccacctccccaatttaatcgattcttgtgcctcagccttctgagtgactgggactacaagcacatgccaccatgcgcagctaagttgggtatttttagtagagacagggtttcaccatgttggccaggctggtctcgaactcctgacctcaagcgatccgcccacctgggccttccaaagtgctgggattataggctcgagccaccgtgcccagccaagaacccttttctttaactcttgtgctttaatgttcgtctgagccctgcttgagaagcaaaagatagttacagatcctctatggtaaaaagctctatcaaattgtcctcatgaatttacttctgttgtcaaactaatcttagatattgaattatatgctaaggttctttggaactagcttcctgaattttacacagttgacatattttcattggaacaatcataaaacgaaagatcattaaaatattaaggaaacaaaggttaaagagggaaacgctgatttctttactgtaaatagatcccaatttgcatcttttaaatccttttggatttccccatctggtcccctccctgttataggcactaaataaatattagaaaacagtcccttcaaaacatgtagtcctttccttatttgccctgcctctcttctaaaaaaaaagaaaaacagaactaactagagattattggctgcacaaacccatcagcacctgccagtttttaaatttcattttggaaaatcagccatcacttaagggacttgtccataatagcttcattaaagctttgttttttatcaaaagggggccacatatgtaaacttgtggaagtaatttacctcctctactcttgtcttcttatttgattgcaaaagttaatgttattaaagttgctatggaagcattaatgttcagcctgaacaagagcttgacgaacttctttatacaagcaataacactctgcaaccccattttatgagatatttttcatgatgtagacatttactttcttagcacaagtgatctcttaagattaatttcttttccattttccttcagttttaaatgatgtaatatagtaatctttataacatgatcagccaagtataatttgagaagtcagttctgttggcaaatatctgaaggacaaaaccaaagccaccctagctgaggtttttgtcccttccttctttcatttaccaaaaaccttaattgggttaacagtaggggaattttagaaatcatgttttcctaatgtaacctgtgaaacaaaagcaaaatagattaaggcaaggggaaaaatgaacttaccaagagtgttctttttcctaagtaaaaaccacaaattttatagttttttaaattttagactttctcaatcctttttttcacatttaattattctcataagtatacatagaagagagaatgttttttaaaagtccttgtcatgtctatgaatctgtttctctttgctgtactacataaatcatatttttttccttacaggatcgtttagaaagaggcaacaagaaaagactgtgaactttataaaagacacttgcaatatactgtgtcaaaatgataattttgttatgttagcctctagaaaatttaagttcagaaaaatgcactatgaccggttcgtaatttttttaatgccacacataggttgtattgtaatggcattatcaaaatatttgatgatgtttcagatatattgcaaagtctgtattccagctcttaagaaaaatataagcatgttaaataccatatttacatattgataatgtcattggtatatggtggctgtttaccaataaaaggaaaaaattcattaaccggttgcttccaaaattagaagttttaagttgcatgaaaccattaatagccttgaaagctttgataagttttcagtaataataacctatttaatcagatgatgatgtgtttgaaaatagtgttcaatatcagcaaatttgtacacagggaatgtaaataaggataactgatcagagttatccactgtatttataaggaagagtcggaaaaaacaatgaccttagttttttttaagcctgatgatactatggtttactctaataagatagctatattgataattatatttttgttactgtgcccttgcacattttggtctttttgttaatatttttattaataacacataattagtaaccactctactgtttcaagttaatctagtaatagagcttacatatatttgtataactgctataccactgaactgaatttattttacaacagtgtagaattcttgaaaagttaacgtagaaaatatccaaaaagcagtatttctagaaagtgtccaaaaagcagtatttctttcccttggttgtgagagtaactaattatataaatattacctcaaaaatacatacactggtatcacacagtctttctacaatgtttctgtattctgaaagctaaatattaagtactatttttccattcaaatattcatttagaatttcctttagaagatggcagtgattataatattaatatgatttcatttgttccagtgtttagacatgaaatcatcttccttgtctcatgaaaacctaaatataaaaaaaaggaaaatactggagtttttatttctcttgtctttgttacatcctctgtttattataattttagcaccaacttcacacctagctaatttttttcatcataaagtggatgaaatgagcaagtacctaaaaattttatttcagataaaagtcaggagttactgctaaaaaacagacatgtaggagacattcaacaggagtatgaaatgagagttagaccatatgggctgacaacaccataaataacaagaaaagggagtgctgaaataggagagaacagagcaaatgttagctcaaagtatagacttagaaatatcaaagtaagagctatctggataaatatatagatattgagtgcttggaatcctagcctactatgtgaaaattaagtctaatgtcagaataacttacagaaaaatagaaaatgcacagctttaaaatgggcagagttaaaatctattcccagctttatcacttatttagccatgctagcctaggcctctatttccttgtctccaaaatgagaataataaaatttaggtcaggattactatataaactaagataatacagtgattctcaaagttgttcagactgtatagtaaggagaaagtctggttgcactttgaagagcttgaagatttgaaagattcccaaaaaagcattttaaagtttacatttaagggaccttggacctcaaccctctcaagtttacaagtctgaaactttagacatcaaaagtttgagcagtttttccaaggcaacattgatagttagattcagggccaggctgtaagtctagaatttagatatcctgatcccccagataccgctcttctggttatacacagaccagctataatttgctaaacataaaatattgcagtgtattagccagctgtggctccagagtctgtgccctttaccaccgtgcccaactgtttcacatgctgtgtttggtagtttttcctagtgctctccttaataatggtggtgtttagcaaattgtattacataaataaatatttatttcatggattgagttatgttgcatattaaattactttccttcccattgtcaataatgacttctttatgtcttaggctgtattataaattcaaacacaggaatgttattcttgcctttttccatcagaattacctaaagttttattagactttccccctacttgcaaatctgcctggaggttctggtctttaggaagtagcacttagcaagttctggataagcactccagaatttgggatgagttatccttgttgtttgtccagctctatcttggaccccagtgctgctaattagattcatgccttgttctttagggcataagttcctctcttggctatttttcctagtatgctgagaactaggattccctttcagtgacagagtcctgccctggaaccccaatcaagagcctaaagtttaactactctctgagatattagcctgatgccagcagcctgcctggatctctaaatattacccattctgggagttgttagtggtctctgctttcctgcagtgtcactcctgcttcctcattgggcctgctagccacagctacttggatgtacccgaacctgttgccttgccctacctctgtgggctggttcagttctgcattcccattccagtgtccactgccttcttgctatccctcccatctgtgcgccaccaccagcttatccccagccctgctaacatgacaaactattgtgcatttgagtgcccactatacaatgtgtgaatataaccgtgcttttaagcattgactttaatgtctgggatgatccgtctagagtccatggaaccctcctgtgttttttcatccctttcttagtaatcttggaaatccacttatgaaattctttttctaacatttctttgctgaacggcatttttaaaattactttcacggtgtttctttccagtttgatctctacacaaacacaactttattacttgcaccagaaatgatttcaaacactttaggaactgtggtaggcttaattatgacttcccaaaagatatccctataccaatccctggaacctggaaatgttctcttctatagcaaaagatatgattaagttaaagtcttgagatggagagattattctgggtaatctgggagtgccctaaatgcagctacatctatgcttatatagaagcaaagggagatattaccacacagaagaggagaaagcacagtgaccacagaggcagagattggagtgatggagccgcagcaaaggaatgctgacagccaccagaagctggaggaggcaaagaacagattcttccccagagcctcttccagcaggagcatggccctacagataccgataaaactgatattggacttcctggcctccagaactatgggaataaatttattgtttcaagctatcaagtttgtgattatttgttactgctgccatagtaaattaatacaggagcatgcaggacagatctgtaatggcctgaactgaatttcaaggggtgtggaaaacagttactctttaacaccactccgtcttccccattagccatttggataagtcaaagatagccttagccatctcctatcttagttacttttctccttcaactgtattttgccattgtcgttgccattgcctctgcctaacagcaagccatcatcatctctcacatggactatgacgacctcctcatctccctgtatcttctctaatgcttctctcatatacatgctctcagcagccacctggtttaaaacaaaaacaaaaaaaacactaatcatgtcattccctgcttgtcttcccgttctttccaactgtcattccctgcttgtcttccaattctttccaactgcagttaagatcaaaccaccaagacctcaccaggctcccatctacttttcagcctcaactcagtccacctgctctgccaatcacacctgtttctttttgttgttctttccctaggatatagatcctggcatacctgcattctgattcttcttggaacaagccaaattctttcccctgtcagtacgtttgcatgtgtagtacatgttgcatcccaggcctgtctgccttcttaccctattttattttcatcatagcacttactaccatctgaaatgatctcatttatggtttgtctcctcagtgattaacacagttcctgcacacagtaaatcagtagttctcaacaggaagtgaagaggtcatcctgaggggaacatttagcaatacctagagacatttctggttgtcataaccaggggaatgctcctagtggatagaagtcagggaggctgttaaacccattccacaatgcacaggactggaacaaagaatgatctctcactcagaatgtcagtgttgccaaggtggagacatcctgcagtagatgcttgtggcagagggtactggttgtcccccagtatccattctttcattcacctgtgttaatacatgctccagttttgtatttttttttataaacagctgtcaagcataaagataacattttccatctccttgtatgtaagtggaaataggactgtcatgtggggccagtttcttttttttcttcctctgtcctgctgcttgaaacatatgctgctatcttagatcatgaggtcgaggccatgcaaagtggagcaacaaggagctgtgtccctgacgccataagcaccacacctgtcctgaattgctgtgaatgacaccagctaactacaatgcattgtctcaacatcctagacataataaaaagccataaatatgtttgtcctatgcagcacaaaacctttgtatctttgccttttatgttgggatcttaattaaaaattacatcctctactgtctctgcatgctcaactttttatattcgacttaaccattattaatcagcatcatgcatcgcacccccacaatagctgtgcatttcacattataaaagtttacaaatctcttctgcctctttgtctttagtatggtgtacaccacaacaagaacaaacacctcaagaacattcaggcacattatatatacaaagatagcacataagagcttgatgtgtaaacaaggtgtgtaaacaagttaggaagaagtttccaactttttcttggcgatcaactcctttcctaaatttgagcgaagaatgtgtttgaagtgttggctttgccccctaaactaggtgtcttcctggttagccaggcttctctgaagtctttccttcagaaattgttgttctccctgaagcaccacccatggtaaagaattttggtctctcccaagggctgtcaatttcccggagcacaaaagacccttacagcaccacttctcagccaagggcttcctggaataatcctccatagaggtttacttgctgaaactttctctttttaagtttgttggttttttttcctcttgaaacaaaattgatacatagtaaatgtagaaatgaaagaaaaaatagctgtttgtctaatttttatatatatatatatatatacacacaaatatttacaaaaataagatcacacctatttttatgcatactgttttgtgacctgcttttgttccccctacatcaatattcttctgcaacagaattctacaaacaacttctcataggtcatatacacatcacctggggggttcggtttgtttaaagcacagggactcatatgccctgtttaccactaccaccggtgagaattcctgccccaggtaacagtgttagtaatgagactgccataaccatccagtatgtgagagcaaaaaaggtggatgagacccatcgtcctatgacaaggtatttaccttatcccctgttggtgacatttcatgagaatctttattggcagaaaatgctctggaatcagtagaacatagtggttacatgcgtagattacctgtgtccaaatctcatctgctttatttattacccattcagcatctcagtttcttcatctttaaggtgatttagactctaaagtcttgctgatgagactaaacgagttgatacatgttaagaacgtttaacagtttctcatggtaaactattctgaacattatacaaagactgatgcccagtcataaatttccccatctaaaaacaataatctaatggaattttaaaatgtcttaaaaataaaaagtgtactggagatggatggtggtgatggttacacaacaatatgaatgtagttaataccactgaacgatacatttaaaagtggttggttagtacaacctctttggtattaactactagtattaaccacttttaagtgtatagttagatggtattaactacattcatattgtagtattaaccatattaaccacttgtaagtgcattttacatcattgaaaacattgggaaacaaaaggtggaccccctagttttctggaatgaaaatgcacagtgttgaaactggtagatagttaaggatgcctttttttttttttttttttgagacagagttttgctcttgttgcccaggctggagtacaatggcacgatctcagctcactgcaacctccatctcccaggttcaagtgattcttctgcctcagcctcccaagtagctgggattacaggcacccgccaccacgcctggctaatttttgtatttttggtagacaccaagttttgctatgttggccaggctggtcttgaactcctgacctcaggtgacccacccgccttggcctcccaaggtgctgggattacaggcgtgagccaccgtgcctggcctgaggatgcctgttcttaactgtgatcagtcattcccctgccacccctcttcttccacctcagagaaagcacagagccccatttgctcaggtatgcaactaatgtttgcttatctggattgaattcagttcaattctagtgtgtcagattcttttcaggtgactcttcccattccccatcttcagagtgtgtcctgttgtcttaagattatgataggatcagatgcaattttgaccaacattcttaaaatacatccagacatggatgtatttcacttcaaatcccattggcagatttgatattatgaaagggcctgggtctgaggtgttttgttagtcacttgaaccttaactgcaacttttttttcctttctcaatgattaaaataattacatatatatgtatatatgcacatatattatgatgtttttacatctttttttttttttttttgaaatggggtctcgttctgttgcctagactggaatgcagtggtacgatcacagctcattgcagtcttggcctcccaggctcaagtgatcctcccacatcagcctcctgagtagctgagactacaggcatgcgacaccaagcctctttaaattttctcattttttgtagagatgggggggttctcactttgttgcccaggctagcctcgaactcctgggctcaagtgatcctcccacctcagcctcccaaagtgctggagttacagtgtgagccaccaggcctggcctatgtctatttaaaaaagaaaaatgcagctaggcgcagtggctcatgcctgtaatcccagcactttgggaggccaaggcaggtggatcacttaagctcaggagttcgaaaccagcctgggcaacatggtgaagccccatttccaccaaaaattagccagatgcggtggtgcatgcctgtagtcccagctacttaggaggctgaggtgggaggattgcttgagcttgggaggcagaggctgcagtgagccatgattgcaccactgcactccagcctgggtaaaggggtgagacccccatctcaataaaaaaaataaataattaaaaaagaaaaaggcaagggcagagtggatctcaatatttggggcctagagcagatacaacttggggagttctctataaggaaaacaatacaaaattaccaaaacaaaattaggtatgaatttattcagaataggaacagaaatcgcaacaaataactggaggtttggagattcagatacctttctcctaagatctcttgggacaattcatcagggatgcttcccagctgcaacctagcttctcctttctacctaggacactctacaactccagtattcttgatacctgtgtaccaaaagccctgaagcttcactatcattatttccatataaatcttcctctagataaggaatgggagggcagagttaatataatcaatctgttgaaaacctcaaaaattttttggagttttttttaatttttttttttttagtttttaattttttgtgggtacatagtgggtatagatatttatggggatacatgtgatgttttgaaacaggcatacaatgtgtaataatcataccatgtaaaataggatatccattccctcaagcatttatcctttgtacaaataattcaattatactcttagttattttagaatatacaattaaattatttttactatagtcaccttgttgtgctatcaaatactaggttctattcattatccctatttttttgtactcattaatcttctccacctcccctctaccaacccctactacccttcccagcctctagtaaccatccttctactctctttccttatgtgcttgttttggtttttacatctcacaaataagcgagaacatgtaacgtttgtttttctgtgcctggcttattttcacttaacataatgacctccagtttcatccatgttgttgcaaatggcaggatctaattcttttttatggctacgtagtactccattatgtatatgtaccacattttctttatccattcatcttccaacggacacttaggttgcttccaaatcttggctattgtgaacagtgctgcaacaaacatgggagtgtagatatctctttgatacactgatttcccttttggggggttatatacccagcagtatgattgctggatcatatggtagctctatttttagttttttgaggaacctctaaactgttctccatagtggttgtactaatttgcattccctccaacagtgtccaaagggtttgcttttctctacaccctctccagagttattgcctgtcttttggatatgagtcattttaattgggttgagatgatatctcattgtagctttgatttgcatttcttttatgatcagtgatgttgaacaccttttcatacgcctgtttgccatttgtatgtcttcttttgagacatgtcaattcaaatctttttcctatattataattggattattagatttttttcctatagagttgtttggacaccttatatatactattaatcacttgtcaggtggatagtttgcaaatactttctcccattctgtgggttgtctcttcacttactgattgtttcttttgctgtgcagaagctttttaacttgacgtaatctcatttgtccatttttgctttggtagcctatgcttttggggtattactcaagaaatctttgcccagtccaatgtcctggagaatttctccaattttttcttgtagtagttacatagtttgaagccttagatttaagtatttaagccatttttatttcatttttgtatatggcaagagatagggaactagtttcattcttctgcatatggtacccagttctcccagcaccatttattgaagagactgcccgttctccaatgtatgttcttggaacgtttgtagaaaatgaattcactgtaggtgcgtggatttgcttctgggttctcagattttaaggtaatatgaatcatactttttctttaatttatagtgagtgtattcatttcctattggtgctttcacatattaccacaaacttaatgactcgaaacaacacaaatttattatcttacaattctagcagtcagaagtccaaaattagtcttactgtgctaaagtcaaattgtcggcagaaaaaagcaggaacaaggaagaagagggtagaggaggagagggaggagggaggtggcagtgctgtggcagagggacaggagcaggagggggatggagaggagaaggttcctaggtggcacagtgctcctgctcctcccggcgctgcccagccccctgtcagtgagggctgaacccccacaggataaggaagcctgagtgcataccaataatcaaagctacatctgtgacacaggacactgctgtggacagtctcagtgctgcaactactgctaggaactctggtagctctggctggtgtggaccatcatcatcatccttagctgctgctacattggccaccaccgccaagccaagcaccgccttcaggcccagcatcggcaacatgaaatcaacctgatcccctgccaagaagccttcaatcactcagtgctgcctttttatttcaggtttttgctaaactacttaactacctccttatgaggaagtggtgagccagcctccaactcctcccccagcatacagtgacttccagctacgcagcagcagcagctcctgcctccacagtgaggcctggcagatggcagtcccccagcgccaatcccaccaggggatccaagggaatcccttgtctgagcccagcagaagcatcacaagacccccaagcatcgctgatcctgagccctctgacctaccaggtgaccgagtagccaccaaagccctggggatgcagcccagtggctctgtagccagcctgggagagctggacccaggggccttcctggacaaggaggcagaatgtaaggaggagctgctgaaagatgacagttctgaacatggcagcgcaccgcccaacagcaaagagaagatgctcaggagacattgccacttcactggtgacgcgggcattgaagtgcgtatgtcagggccaccatgatcatagccttaaagagttcaacatgctcatcgctgatgcactggatgggcccctggacttctgcgacagctgccatgtgcagcctcctggtgatgaggaggaaggcctcttccagccctccaaggagcaggcttgacagcctgggcacctgcacctgccacagctacctgcatgcctgctgctaaacatcatcaatgagcagtactctcccaactcccagagcagcagctcccgcagctagatcaggctctgccagcacccaagaacttggcaaagcaaccagggtaggggagaaccacgagagaagcattaaatgactttcagagaaagtggtacagccacttgattcctttttttttttttctttctcctctcctgcattttcctccatctccaggtacagtttggggtgtggatgcctctcgccctacaaaggcacaatgttgtggagggctgagaagttggttctgtttctcgttcctcataccccatccctatcccctttattctccctttaaagtcctatctcacctacctgtttgggtcagagagatgtgttttaaaggcccccaaggaaggaggctgggactgtgccctgagatgattcttggtgacgaagtggatttgtgctctgagtttagtttaagagaacgtcactgtgtctcagtcccggagaggcaacccatcttagacctgggtgaagaaggaagcctgcagaggcctaggctttgtcgcctgtggctcccagtgtctgcagagccagcattgagctaatcctgtgggaggatgagagctgatcggcagttgtatgacaggttggtagggggcttgtgatctgtgaaattccaggtgatggatgcatccagtgtgcatcactaagaggccctttcccagtggcctctggctggctgcaggctggttccagtgtgaaagattatactgccttttcttttttttattttccttttgaaaacagacaacaaaagacaactgaaaataacttccccagtgagcaggcaagaattctcttctgaaaaatgacgtttgtagttctttcccaagttggccttcaaagagcctggctgcagttgagccagaaggagatgtcttgtgtgaaggctaaagtggaggctgtctctgaaatctccgtgagcaggtggccctaagccatggtggtggatagatgtgcagctttctgcatctctgccccttggtctgtgcccacaggtggccggcgtcagcctccatcccgagcacatgctccgcgggtctttatgtctcactgttcttcacacataggaggaaagagataggagactgaggaagggatggaccctgagaaagggcccctccagcctggctctcacacagtattttgtctttgattctgaataaatttttttttgtggtttgtcttttggtttttttgcggggatggatggctggtcgttgtctgttttaaactgacctcttcgaagaaacaccttggttatctgtggttttcatgttctgtccctgcccctgtccccactccttttgagtggggcaactcattttttgtgtaaagagtctctcagataggaggtgaacacagccatctggaagacccgcaggatccttgtgcctgttgcttagcttcgggtcaccagctgagctgtgataggaataatctgaatggaggcggcaaacagctgaaatgaacattcctcgtgcagccctgttcacatgaagagtctgatttcccctacccttgaacaatgatgatattcagacaaggcattgacgttgtggtaagaatatatatatatagaaaaaatacatgtccccaaacagacaaatccaaggctgtgaggtaaattagtgcatttggattccacaaaaccaaaatccatgttgaacagagtgaagtccgtacactgtaactttttgggtgaaccctgcgtgcctgtccattgtgtgtgaccccgagccctgtttccctaggaagatactttgagtgacagccattctcctcaggcaaaccacatgtctggagcacaaacggccctctctaagtaactgatgttacgcatttactgtttatggggcaaatgtctgactatgtactcaggtgtatttcacagcattgtggactgactgcaggcccctgtgtttgccagagataactgtgctcaacatagaggttttactctactcaccactgcaacttgcacactgctccggggacacatgggagcctgtgttctgttccctgtaaatggaaatgtgctctgagcctgtctgcctccctcggctgtgcctggtcctctgtaccagcccctaggggtgtccacaaccacctgggacagaagaaggtggaatttcagacagaagcttgattgagtcttcaaagacagtcttggactagctgtggcccagacctcggccctgcccagaattgccaggaggaggctttgagggcactgggggtactgcagggcctgcctccctctgccgagtccagtgggcacaagcaagctggcatgtggccaaaggtggctggattgtgtcatagccctcagacgcctttccttccacctttttaaagaatcccaaataactcactgaagtgtctcaaaggcaaacaagttctaccaaaatgaatcctttttcagtgaacagatcaaatggatgaattctgactctctcaagttcctttccccagttagagtggggaagtggtggagtgctaactgtgtgattcattgcagtgtcctaccctaaaggcacaagaagatggaaatgcaacctgtggagctggccttgattctcaagtcgcagtctggcccccgctacaggaggctaccccgctcagggagagatttaataaggaattggttccggggccgggagatgtgattgagactggttttccagctgaatgagatggaaggggttagtggagggtttgatgctacagccagttgagagatttgcaaatgcgaacacattcctgtgtgaggcacattatcctttgtcagttattgtgaatatgtgtattttaagcagtaaggtgctactggtcagacttttctaggcagtcttggtgatgcatttcctgtgctgagattgttcggaagagtgactataaccactgtgaggagcccaaataaaaattgatcccccctccgccccaaaaaaagctgttagcagagctggttcccttcaggagcttctaggggagaatctgtgtcctttcctgctccagtgtctagaggctaaccgcattctttggctcatgttctccttccatcttcaaagccaggaagagatggtcaagtctttctgacatcatataactttgacaataactcttctgtctccctcgtccacaattaaggatccttgtgactacattaggccaagcagatgacccaggataatctccctattttaaagtcagctgattagctaccttaattccatctgctactttgattcccctttgacatgtaatttgacctacagattctggggattagaatgtgaacatccttgggagaccattgttctgtctatctcagtgggtaagttatttgaatgctaaatgcttttgaaaatgctttctgcaatcagagtcccataactgttcttgattcttgatttggagagtttttatttttaattggactgtctgtgagggaagcagaggcatagttctaaatttaagaattgaaatggagcaagtagccccagttcagcatgcccagagtctgctgcctttggtttttccaaaagaaggcagctgcaaaaaaatctctaaacactataaaatataccataaaaaaagcagaattgcaaaaagatggctaattgaacacacactttcactctctcctaaactgcactgaaactatggtatggtaaagggttttttgttttgttttgttttgtttttgtttttgtttcttaagcataaacctataaggatacagtgaacatgagaagaaatagcaccaactttttgaaagctacaaaacagataacaggtggtatggacttggtaaaactgatgaaaaattgaactctttttcctccttggttccaagaaccaagtcaatttaaaccaccaaataatcaaggctcaggcattgaaggcacaactactcctagaaaagaggggcagggctgtgaaagatgaaagaaggttggttgaaagctgttggagaagcagttatatccctagatgcccctctcttcctccaaatgctgggtgatttccttccctcaccccagcagaagacagtcttcctctttgaagagggtaaaacagagggtgtgttttaacaaacaaaaaacaggagggttaagtaaatgatgtatgcctactaaatgcaaaacttcctcctcatctcagaatgacggcagcagttatttacttccaggcagaacaccaaataagtcttttgtaggtgggaatctatcagacccaagaagaaagatccaaatacactcacatggatgttgacatcagggcttccccaaccaaaggcccaggcagctcaccctacaggaaatctcaccatgatcaagcctcacctacttactcagtttccaggcagctcttgaagcctccacttttaaatatgagcaggtaatcaagcatgagagattcgagaaacacctgaacaggaaaaaaaaatatatagtgaaaacagaaagcgtgcgggaagaacaacaaaactctcaatgtcttcagaaacgtcatgaatttttattacaatgcactcatgaaatcagaattgaaaagtataaaaaaaaaatttcaggttgctcacacctataatcccagaattttgggagactgaggcaggaggatcatctgagtccatgagtttgagaccagcctgggcaacagagtgagcccccatctctacaaaaaaaagaacaataataaattagcaagatgtagtggcacatgcctgtggtcccagctacccaggaggctgaggcacttgagcccagaaggtcgagaccacagtgagccaagatcacaccactatactacatcccaggcaacagagcaagaccttgtctcataataaaaatggaaaaaaaaaaatcagaaagtaaaaaagagccctcaggaaaaaataggtctcactaaatcctcagcccaatgcccaaaaataaactgtcttattttgtttgtgctgctataacaacattcctgagactgggtaatttataaagaacagaaatttattttctcttagtactagaggctgaggcatccaagatcaaggcactggcaggtttggtatctggtgagggctgcaaaaaaggacagacttcctccatcaagcccctttttcagtgcatctaatcccattcacaaggggaggagccctcatcacctaagcatctcttaagggccccatctcttaacaccatcaccttggccattaagtttcaacacctgaatgttggaggggaggggacatattcaaaccatagcataaaacccatactgatgaataacgcacaaagagaaaattctacacatttccagaaaacacaacacgcaaaggttgaggtgaggcatctgaacaagttcagatttcccaaaaggaactctggaagatagaagacagtaaaacaatgtgatatggtttggctgtgtccccacccaaatctaatgttgaattgtagctcccataattcccacgtgttgtgggaggaacctgatgggagataatagaatcatgggggctctcccccccatactgttctcatggtagtgaataagtctcacgagatctgatggttttataaggcgtttcccctttcatgtggctctcattctctcttgccagctgtcatgtaatacatgcttttcgccttctgccatgattgtgaggcctccccagccatgtggaactgtgagtccattaaacctttttttctttgtaaattatccagtctcaggttatgtctttatgagcaatgtgagaacagactaatacacaatgctttcaaaattatctccaacctagtattctatgggccagtcaagttgcaaatcaagtatgagtgaagaatcatacttcaggcttgcaagttctcaaaagctttacctcccacatacccttttcttgggaagctagtggatagaggatgtactccaccaaaaggatgggaaaatatttgagaaaggagatctacacagagagaggcagaggtctacaggatgttggtaaagggagactgttagctgtgaaacagctcagacaactttgggtggggtttttttctagaacatgaagtttatcagatacctgatgtgaatcaacatactgaaagacgtagggataagctggagaattggggttgaatagtgatagatattactggtctcagaaaagaaagcaagtaatgcaagatgaaaaaacaaacaaaaaaacaagacaaaactcaaaagaacaacccctcaccccaaaaaatgtctagcaaataaaaagtaatagtggtttaccacacaccttcattcttttttttttttttttttacctttttctttaagcagtagagacaatgtctcactgtgttgccagggctggtttttatttatttatttatttatttttgccccattgcaatcagtgtgcacaggcttctttctttctttatttttttgagatggagtcttgctccgtcacccaggctggagtgcagtggtgcaatcttggctcattgcaacctctggctccatggttcaagtgcttctcttgcctcagcctcctgagtagctgggattacaggcacacagctccatgcctggctaatttttgtaattttagtagagatggggttttaccatgttggccaggctggtctcgaactcctgacctcaagtggtcctcctgcctccgcctcccaaagtgctgagattacaggcaggatacactgccctggcctacaggcttctttatataggtcatcagcctgtattcacatttccatccatttctaatgtaattacattaacattactttagcatatgactttgccttttccagaactctaattaagattttaaataagatgtatgccactgggaatctctcattcacgcttgttaaacacctttcctgtttgattataatttcacttgctaattatttctgactttggttttccaaacttttcctttttatgacttaaacacagtttgaactggtgcagcaaatcacttacaatccaggtgtaagatagattggcaaactaaatagaaaagaagacagtcattgggtggaaaacagtgaccaagtttacctcagtcaatctgtttattaaaagaactcataggccaggcaaggtagctcacttctgtaatcccagcactttgggaggccgaggcggcggatcacaaggtcgggagatcgagactatcctggttaacacggtgaaaccctgtctctactaaaaatacaaaaaaattagccaggtgtggtggtagacgcctgtagtcccagctacttgggaggctgaggcaggagaatggcgtaaacccgggaggcagagtttgcagtgagctgagatccagccagtgcaccccagcctgggtgactgagcgacactccgtctcaaaaaaaaaaaaaaaaaaaaacagaactcatactgctgagcatggttgcatatgcctgtaatcccagctacacaagaggctgaagtagaaggatcacttgaacccaggagattagcctgggcaacatagcaagaccccatctcaaaaatataaatatgtaaaaataaataaaaggacttgtactttttaataagcactcaccatgtgctaggttctgattgctttatctacttctatgccataaacttttttcaaatttattttgcatatttttagatgcctgctatacactgatccttgtgataagagcagccaaggttccttgagcactcaccatgtgctagggtctaattgcattatgaactgtttgtcatttaaatattgcagcaagcccatgaagcaagtagtaatattacccccaattttcagataagaaaaatgaggcatagagaatgtgaaaataaataaaatttaaaagctcttggaaccccagagaacacattaagtcttgagagatgtgactgtgatctcagccatggagcatggagttgtaatttctgctccttagattatagattaactctcttcttcagtgttcttcttctgtaaattatgaggagagacaagagaccagacctccttctaatcactgatctttgtgatagattaactgcctccttttttgtacctgtattagtctgttttcacccattataaagaattgcccaagactgggtaatttataaagaaaagaggtttaattgactcacagttccacatggctggggaggcctcaggaaacttataatcatggtagaagagaagcaggcacatcttacatggtggcagacgagagagagagagagagagagagtgtatgaaagggaaagagccccttataaaaccatcagatctcatgagaactcactcactatcacaagaacatcattggggaaactgcccccatgatccaatcacttcccactagtttcctcccttgatacatggggattatggggattataattcactatgagatttgggtggggacacagaaccaaaccctatcagtacctaactcagttaaggtagcactaattacctcccaaattttatatcttcagtgtggaatgttaaatagacctttcctgaaaagaaaaatattaccttgtctaattggattactgtaactatacattcagccatatacagaaaaatattgaaattctgttaagctttctaaaccttatctatgttaagtgacctcaaacttctacacttcaaagtgctgacttccattctttggaatctgtctcccaggccatcttcaaactttgtacttgaataaactctcttcaaaattcaaaataaactctcttcaagtcaaactagattctgacgcttatttcaagttgacattttggcaaccatgaaaggacctaaagcaagcctctgttgattccccactgcattgcccacagttaggatcctggtaccagcatgaacagttttcattcacctggcttcactggagccagcagagggtctccggtgaagaccctctcaggttttgaatctccctgatttgggttgagaatcagactttactcaagtgacccaattccacacttgatggagctggaattgaagctctactttaaggtaagagtttttgtctgttctctagatattcttctgttcacagatttgtggttttcacttttctctaaggttaagtgttatttgtaactgctcattaacatttgtacagctttttctctcatttgaattttggtcagggaaagaaagtttctctctctgaaaagaggaagtgaatgtggcttaagcaaaatttgcataaaagaaaaaaacctggctaaactctgaagcttggttcatttgacatatctaaagttgttttgtttgtttctgagtgaccaaaaagaaaaactttctatgaggatggccaggtgcggtggctcatgcctgtaaacccagctcttttggagccctaggcaggcagatcacttgaggccaggcattcaagaacagcctggtcaacatgatgaaactctgtctttaccaaaaaatacaaaatattagccg

SEQ ID NO: 1193 - DNA, 1265 bp, Homo sapiens
tagacctggaccccggcaccctcccgccggggccgcacttagcagtggaaagtctgtcctcctgaagaagttgcgctccgacctccaagcatcaggtcaaaagtctaactcattctctgacctgccgccaattagaaaacaactgttgccaataaacgtggtcgcgccgcctgtgacctcagccgggacggacccgcgggcgggagcctgcggggcgtgaggcggggtggggccctggctcccctcccccgcccagccgcggcgtctgacgtcccgcgcgtcggcggccgcggagcagcgcagggagccaggcgggctgccggcgggtgtgaagaaaaaaatgacactccaatgggctgcagtggcaacctttctttatgccgaaataggactcattttaatcttctgcctaccttttattcctcctcagagatggcagaagattttttcatttaatgtctggggtaaaattgcaactttttggaacaaggctttccttaccattatcatcctattgattgttctatttctagatgctgtgagagaagtaaggaaatattcctcagttcataccattgagaagagctccaccagcagacctgatgcctatgaacacacacagatgaaactttttaggtctcaaagaaatctttacatttctggattttccctatttttttggctagttttgagacgtctggttacgcttattactcaactggcaaaagaactgtcaaacaaaggtgtacttaaaactcaagcagaaaatactaacaaggctgccaaaaaatttatggaagaaaacgaaaaactaaaaaggattttgaaaagccatggtaaagatgaagaatgtgttttggaagcagaaaataaaaaactagtagaagaccaggagaaactgaaaactgaattaaggaagacttcagatgccctttctaaggcacaaaatgatgtgatggaaatgaagatgcagtcagagagactttcgaaagaatatgatcaactcctgaaagaacactctgaacttcagaagcaaagggagatattaccacacagaagaggagaaagcacagtgaccacagaggcagagattggagtgatggagccgcagcaaaggaatgctgacagccaccagaagctggaggaggcaaagaacagattcttccccagagcctcttccagcaggagcatggccctacagataccgataaaactgatattggacttcctggcctccagaactatgggaataaatttattgtttc

SEQ ID NO: 1194 - protein, 309 aa, Homo sapiens
  VARIANT (1)...(309): Xaa = Any Amino Acid
MTLQWAAVATFLYAEIGLILIFCLPFIPPQRWQKIFSFNVWGKIATFWNKAFLTIIILLIVLFLDAVREVRKYSSVHTIEKSSTSRPDAYEHTQMKLFRSQRNLYISGFSLFFWLVLRRLVTLITQLAKELSNKGVLKTQAENTNKAAKKFMEENEKLKRILKSHGKDEECVLEAENKKLVEDQEKLKTELRKTSDALSKAQNDVMEMKMQSERLSKEYDQLLKEHSELQKQREILPHRRGESTVTTEAEIGVMEPQQRNADSHQKLEEAKNRFFPRASSSRSMALQIPIKLILDFLASRTMGINLLFX

SEQ ID NO: 1195 - DNA, 116422 bp, Mus musculus
  misc_feature (1)...(116422): n = A,T,C or G
taatgatctttccgtgtaatgacagcccctagtgtggtgcctaaagcagagaaagtacttataagtaacattgagttcacgggtgtattctctttttgagagctactacatacatcaattacaaaaaaatactccttaatgtatgccaaacagctaagtctccatattttttaattctggaaaatggctgcatctcaaatatcttcctaggctattcttattctgttttcttggtgcagctctcagcattaatatttctgattcattgggataggcaacaaaaatgggaaatataatctaaacccataacttggcccatgaaatagcatccctggaatggtggtgttattctcactgatgacaaactcaagccctgactgcctacctaagagcttcccatcctctctggattattgcacacctccaaaggcatagtccatgggtctctttaaaggtggcaggttctatttaaacacatagagaagccctggcaggctgtgtgactatcaagcctgaactgcaactgtgaactgcaacactgcagtacaaacgataattttgctagcacccaacactcctttaatccttcctcatctggggggagaccttgtgaaaataagacatggtttaagagaaacctccaaaacaaatcacagagttagcaacaattagaaatactagtataacgtttactttagagccaggtctgacggtagaggcctctaatcctagctactcaagagtcaaaggtatgaggatctcaaattcaagcccttcgtgggctaccgggtgagttcaaggccattctaggcagctcaaggagaccttatatctcaaaataaaaagtaaaaagggggacgagggggtaggacagtgccaattaaaggaatgtctggctagcattgtgaagctctagattcagtttccgacacctcaaaagtttttaactttatcatgcgtgccagtgcatacaagtagaagataaagcggttggtattctaaatattgatgatcttactttcatatagtcaccaagaaatcccaaacagtactatttgtccaaatcctctctcagtatctgtttatattttataaacttcatgttattttttaaaagcatctatcctcctaaagcacccttattctggtagaatctatggtgaaaaacatatttcccaagaaaacagaatccttctgacagctgtggctttgtaccagcagtgtctacagaaaaggagtcaccaagatggaaccctaggtgtaccttgagttgttaggattcctcaaagtggttctctttgtttctgtgtagcaaggtaacttctttgaaaaggctatggttaccaagtagatttatagttgatggtgtgcatatattctactgatcctaattctaccactaagagactgggaaatcttgggaaggccaatttgaatctccatttatcctcatttttttctcatgtagaaaatgaagatgttgaacaaaaccaatggttctaaatacttagcaacaaaacccttcttgaataagatattttgtcaaagcctgagaaaaataacatgaccaaacacttgaaatagaatataatttcaattagctcaccttaaaatgtaagattattttgtgcccatttgagtatgaaatatactaatccccattcatatattatggttccctgaacatctgcactttgtataagtcctgtaagaatcctcctgcagcactgaaggggtttgcaaacccacaggaagaacaacaatatcaaccaacgagacctcccccacctcccggagctcccagggactaaatcactaaccaaagagtacacatggagcgacccagggctccagctgcagatgtagcagaggatggccttatctggcatcaatgggaggggaggctcttggtcctgtgaatgctggatgccccagcataggagaatgccagggcagggaggtgggagtaggtgggtgggtgggtagggggacaccccttcaagaagcagggaggaggggaatgggatagggggttttggaggagaaactgggaaggaagataacatttgaaatgtaaataaaaaataacctataataaaaaataaatacagatatgtttattttttaaaaaataaagaaagaaaaaaataaataaagaatcctcctgcaatcatgaacaggccaggcaataactcttttcttccagatttctttccagagacagactaaatttctccacaagtaaaataaaaaaacataaaacaaaagtgaatgctcagaataggacatgattatgtctggtcatagcatcagaagtaatcatgagggcatctgtactgtctcatttgaccaaaggtcagatttatgagtgggcaaggcagatgaagtagacagacatggtaagtgacatttcagacgtaggaaattgaagagccctggccagagaagtgacagtgtttctgtgtgttggtggtataagtgaagtaagaggagtctgaactaaagctgggaattagacataatcagtttctggttcataattaagagattgcctttatcctccacataatagaaagccaaaggagggttttgttcctgtggctctctatctctctctgtctctgtctctttctgtctctctgtctctgtctctctctctctctctctctctgtttatgcataaaatgatgcaaacaaaagtaacttagatttctcaagtaacgcataagtagtaataaaagagacttggaaacaagagggctaattaggagatcacagaattgaaggaaagtgacaaagatccattgaaggacatgtcttgcaccaaattatgtcgattcccacaccctccaaattctcacactgaaaccgatttcttcaatgtggtcatatttggaaatgggtgtttagtgcagaggtaggtgaaacatggccataaggataagggcctagccaacagtactggtagcctgagaagaggaggcgacaccagagtgctctctttccatgtacatgtaacatgaaaaagccaggcaaacacattaccagtcataagagaaccccaccagcactcacctaggcaggcaccctgttgttgaacatccatcctcccatatgataaggaaataatcttttgttatccaagccaccccatgtttgttatatcagtccaagctcactaagatggacaatgacatgagggacacagagagtagactcaacaggacatgacagctcatccactcaggagtgtggtccacaaaagtcaacattggctttgagagtctagggcagtgtcaggatgtcatgatgccatttatagagccaacgaatagaagagggaagaagactcattctaagagacaaagcttgatgttcatgtcaaacaaatggcttgtcgaatgtcaggtggaggtaacacagccatctataaccttccagcagttagaggtgagggttttgtggttaaaagccaaacacaaatcttatgtactttgcaatcatctgccaaagtatgccaccacagactatcatgcatgatcaaaatcactagggtgtagtaacatgcagctgacagaagatgttatgtgtccagtaagagaaggtagctatttctgtgtgctacatagacctggcttacatgttttcatgactctagaacttccttattgaaaaaaactgtgaaaagtaagtttaccttcaaaatggtaaataccacgtgatttagacactcccaaggatcccttgtgttctgatagatatccctgagaaagactaaacagagtttagtggaccacacagttcaacaaacaaaagatactatgaccttgaagtagggtaaatggcaaactgttttccaaacaaaggacacatttactctaagaaggccaagcacacaaaacaaggcacattctacccccacggggagacagattaggaagagaattctacacccaggaatcttgagtttcaccagtgcaatggaggtacttctgttagagaagttgggccaaagaggaaactactgaaatagaacgtgatattatgaaacaaaggggcgcttcataaatgttcaactgagaaaagcagagggtgtttagagagtgcagcgaggaccctggcctgttaaaagtgagtccttacacttgaagatgcagctgggaattcccactcaatgagcacctcactcccctcgagacagaagctgcagcatctttgtgttatggtttcagagacctggccatgaggggtccttgtaacctcattcttactgtagaaagtgatttgggcaggcagcgtgtcattcccacttcttccacggccttgcaagctatttctcttgctgtttaagtgacatgtttctgaagactgtatgctgttatttcttaattctccagtttagaattctcattgactacacattacagaatatctggatttgctgttttttaattcaggacttcctgtgatgtgtccttcattttctgcattgagcccctatgatacctagacttgtcaagtggcagctatagtggtccctctccactgccaccccaggaatcatctgtatagaaatggtagttcaagctgctgggtttttataagatcactcagggaatatggacaaagattttggggtgcttcaatatttagggggcagggagggtaagaacaagtttacttacaggacagaagaaagatcagttttggggatagaaaaagaccagagaaacggtgatgctctatgagttaaggggataaagtgtttctgtgggctcccttacaaggagagagcacagaaaacctgttccttcttaattgctttcccctgattaagtcaggcccaagataatctcccttttgattaattgaaaaccaacggctttgagactttaattcatcccttttgtcatactctattggttagaagcgagtcagagttagcactcccacgcaggagagaggattattcagggcttgactagcaggagacaagaagcaggggacatcccagtcagcttgccttagaatggtttagttggagaggaaattgtgctgccgcaggagggattgcaggagcaatgatgtctgatgggtcagaggaggagggagcagtcactgtcctaccaggagacacaggggctggaggcaggacggtggcatgaggaccctgtcacctctatcccctccataggtgccagtgcttcagtgagacagatgtggtcctccctgttggctccctcttgctgagtcctccctcacccaggcccacctttctgcactgtctagtttggttaagtatgttcaaagttcgagtagacaattctcatttgcttttgtctcttctctgctgtctttctctgattaaattttccattaagaattaactgtgaggaaaggggaggtgtagccaggttggggtacagcttgagaggagtaaagggaggaactgagagtaaatatgatcaaaattcaaaatacatcgtctgacactgttaaagaattaatagaatatatttttgaattcactagaaaagtaaacatagtacagaattgctgctttatccattttaagaatacaatccagcagttaaatatattcacattgttatacaaccaattccaaaaccctttcttcttacaaaactgaagctttttgcccactaaaacaagaaggctgccttctgatgtccccagcccctgtcaacccacccttctttctgtttctacaaattttgatggttttatttgccttgtgtttgcagacccaaacagtgttattttcttaggattggcttgttcaacttaatataacatctttaagcacatgccagaatttttttttccttttaagacagtaaatttaaagcagttattttaattttatgggattctcttatttttctgcttatgagatttcccctactcattcatttaactattattttgacggggattttaaaaaggagaggtaaatgtgtgtccagtcttttcttcaaaaggaaactcacattctatttgtgaaacatgatgtttaaggacagactcttggatgctttttgaaatcaccttaacttttcaggatcaactgaagaatagaattacagaaggagttaacaattagtctgctcaaaataagagtctttttgtttggtttggtttgctcgtttgttttttaagaccgaattgtagaccatgctggccttgaactcagagatctgcctgcctctgcctctgaaaggcctgccccagaacagcatttcaccaccatcatcaccaccacacctgccccaacacagaagttcttaggctccacctccgtctattgaatctgaaaggggggcgtgtcctgtagcaccagcattttaatcagccccctagaaaatcggttcttctagaacttgagaacctctagtcttctagacataaccctgtagaactgcatctagagattcaatattttacattgattagtccaaactctaggatttccagattgtgagatcacttttggcagacaatgttgtgatttgtgtataacaccttttttttttttaagacagggtttctctttatagacctggctgtcctggaactcactttgtagaccagggtggcctcgaactcagaaatctgcctgcctctacctcccaagtgctgggattaaaggcgtgcaccaccaacgcccagcagtctataacacttataatccactgttttcagtagataaggcaggccatgtcaagtatgtatattgctacatcttcatcctacatcccagtggctgcacttactggaccaccacagacaaggtcagatagtctacaagatggtcaagaccgtctaggtgggtttgatttcttgagaaccttaatagatctaacaaaaccatagtcattgacaaaatactgaaggtataaaaccaaagctttgggcaagcacagttccaatatgcatatttttatttcttttaattttcctttctctatgagtgcatttctgttccttataccagaattatttgatcaagatacaccttaactattgataagaaatgctaagtgattgattggccatagttattattcttcattgtaaagcttgcccaaactattggcttccctttgatactgccttgttttaagtggttgcattaaagcgatttgatatctctgtccaatttttccgtgcagaaataaacttggtagcatttttattgcatttcagtgctgagcatttaaatccttttgcaactgcagttagtctgatcctctgagaaacaagtgcaaattgctttgtaaatcaacaaccaaagaatcaatagcaatgatgttctttaaaagaattccagatgagtagtccctataaaacgccgtcattacactcaaacattcaaaagcaagtatctttaaaatgaaggaaatcataaaacattgtctcaaagattatgtggcagtgattaaaagcccgaacaggatttgagaagtgaaaatttgttctgagaacagttctagtgtagcataacgggaacatgagaatgaagcttttccttttcaggtcatggttattggcttaaaacttgatgcaaacaaaaattaccagagtgatgattgccaagatggtttaaatccaacatatctgctcttagtattattctcttggaaacctcccagaacgagagaccaacaacaggtcacttaatccaattactaatttcatgcccgagtcacttctacagctctaaaacaaggggagctcctggcattgtggctaatgaaagcgagccatctagcacaccctgtataagaaatctatgatgttaaaaaaaaaaaaaaaaaaaaaaaaaaaaaaaccatgttggagaacgatacttaaaaatgtggttccttgcttcctctgtttttgagaaaggtgttgaacatccacagactaataattgtccctatacttggttttcctccacctctaagcatttgcttgtacataactgctcaaaataaagaatattttccccaaatttctccattgtagcatttaattgctattgctgtgcaacaaactaccaaaatttcaaggctaacacatacctcctcctgtttttaagggttcaccaactccatggatcagaactttggtcaggcacctaccagagggctagagtgacttctaaatgcaccactggccaaagcagtcacaatcccccttgcgttgcactccgggcttaggaatggtaaagttgttctgtggaagagcacatgggctgggaggtaccattactcactttcagaaaataaaatgtatgtggtcagaagttgtagccaaaagaaaagatgagtgtttgctgccggaaggaggctcctttctcttccccactttcctgttagctgacttagaggaaatgactggaggtggaggagccacaaagccagaattacacagcaatgagcttgaatgagcgaggattcttgatcgacattgaggaccgcaacgataaaatcccatcttaactagtattctttgcattttctgctgagcagtagggagaaacatgatagaaatacatcttagattattggatctgcaaaacatttcggtagagaacttgactaatactgtgttccatatggcctcatgtgaagaccacatttttctgagtttatttcttatacaccacacaattacaatttagaagtatgttatttaaaaaaaaacacacaccagtattattattatgaggttaagaaactgaacttgagaaatgaattcccttatgaaaaaaaaaagataaataaacattgtaaacaaatgggtaagaagcaatttttaaaaaataaaacgaaatgatatttttgatttctaggttttgggtttcgtgagtcacatattttccttatgtgtggtcagaaaggtaagtgagaacaactaaggaaataaaataaaactcaataaataaataaaacttaagaataaaataaaactcaagtgagtttgcacttggactgctttacaatgaaatgggcatcgtagaaaataaagtatgcatatttatacagcgtttaatttggcaaaagataaatttttctgtttcaaaattctcagaataggctcgttttaaagacaagggttttctttaaaaagcacaaatgtgtagttctcttttcctttttattgctatattcaaattttggagatttaattgaagtgacgcaaagtgtcaggaaaggttttaaaaataagcaacaagaggctaatcaggtaacacacccttagttgtctgtccagctgccctgactaccctgtatcctgtcttgaaggatcaactaactttgttaagtgctacacaataaatgcggcctttgtctcagtaaccagtaggaaatgtactaagcagagtgtggcagagcatctgtaaggcaaaccatcacagccacgaggctaaaaggcggaattaaagaaaattttgtgacagacaagtggcagcatctcttttatccagaagagaaccagtagggctgtgcgactaacaaaagacaccacgcacgtttctcttggggttggattctaggaaaaggaaaagccaccaaggtggaggctgaagtttcagcaggaattgcgccgcaccaacactgcgtgggacagggagaaaggtgcgtgggattcgctcagggagctcaggtggagcgcgcggcctcagccccacgcccctggctcaggctgcctccaccctggggccacttgagaggcggcagtgctcccgcccgccgggttgccatggtttccggggatcacgtgggcgcgcgggcggaggcggggcgccgggcggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctcgccgggggccagtgcgccgcgctcgcagccggtagcgcccggggcgctcgctcgggagccgcgcagcccgagaccggaccgcggatagggggcgagggcggcgtccaggcgcctcggcgtgcacgggcaggatgagcatcgagatccccgcggggctcacggagctgctgcagggcttcacggtggaggtgctgaggcaccagcccgccgacctgctggagttcgcgctgcagcacttcacgcggctgcagcaggagaacgagcgcaagggcgccgcgcgcttcggccatgagggcaggacctggggggacgcgggcgcagccgccgggggcggcacccccagtaagggtgtcaacttcgccgaggagcccatgcgctccgactccgagaacggcgaggaggaggaggccgcggaagcaggggcgttcaacggtgaggaccggccccctcgcgccctgagccccggccgccgcgtccgcctcactctcgaaccccgcctcgctcttgaaccccgggctgagctccccaccttccccgtgctctccaccttcccattacgcccaccccctcagcacccatttcggtcgctcccactcgcccaccttcctactcagctctcttgtcatgccctccctttctctggaggtggggaaaggagaggttgcgctcccgctgcccctctgtcacctctctttccggggcgatttagggtgggcatcttgctggatcgttaactttcccgtggttggagatgtctcaggctccgggagtaccattgtgcatgaagggcgcttggcggcctcttttcagccctttagatttattaatggagtgttactgggagaaagggcgaagcatgtaggactcagtgagaagagtgtgaaatcggactcgctgaggtaaaacaaattaacgataatagctgtgacattcttggaatacgaataatttattttccagtttttccaataccatgtggtggcgatatttttggacatataacaaaggagcatatttagcctgatacctaggggttctttggcatgaggaaataggccaatgattttctttctttaaaaaaaaaatacaaaacatatattgaataattttgatgttctttttaaattgcgtggaaaaaaaaataacaccatgggaagttctaagagctttgtcagttgtcttaatgaaaagccagccagcatctaaggaccacgccagacactgaagctagagagaatgaatgggagagaaagggattgttttaaatagctgcttttggcgagtcccaccccttatgcttcccacctctccctgacacaccagacacacatgcgtgtttacacaatatgaccaaaccccaggttttgcaggagcccgggctgaaatgccgtggtgtgcaaatggacaagtgttttccttggtggtgtgaggcgagcatgcatgcagcttttatttgttgatgctgctgttggtgtggaatttgtgtgtccacaatgcctttcacacagtgaaaacactaaagggccattcacttcatttcccttacgccctcctcccaggaagattttcattcctttgtagaattaattatatgttgaatgggttataaaattaatgcattcttagcttgtttaaaacacacaaaccctggatgttagtgctctgtgaatgtgaaagattgctatttagatttttaatttgggacatttgggtgctttgagaatagggtaatcatagttttaattgttcccacaccaaatcagatgcttgtctcactaggaaggggaactagacagcatcttacacagatggtatagaaaggacagtgacgtctaatacttgtatgcacacacatttgtgcacatgctatgtgtctgtggcgtggggatgcaagcgcaggcaagcaatgcacaaaggaaaaggggactagtgtcctgaatgggaggcaccaaggagaagggaggcttggtagagcctctgtgctctttggaatatagtattaatacagtcaaacctaattatatctaattctcttgaagcactttgctttggtttaatttctccttgcaagaatgtgtatcttgcacattggaagaaagaagtgcttttgtaatttttatgaagctttctattccccaagtcatcttttctataaaaatcactcaaggtcagttgtaataaatgcttaaccagttgccttttaacatctctacctccaggggttttaaaacttcttgactataacacaatttgatctttatccagcagatgtgtacggacatgtgtatagccgaaactttggcattggtataacctcaattggggcaattctcttttatatttttctaacccaacactttagttatgttagatgtaaagtgtgttgagaatcggtttaaaaaagaactgtgggctacaaaacgcttgtcaaactgtttttgtcaatggcctttcagactttgtgggcatcctatcatgtgggtcttcttctttttaaacagccctttaaacaagtacactctatggagcttgaatttgtacaaggccatgatgtatccaaacctgatcatagggaataaatatatatgtgtgtgggggggtgtgcatgtgtgtgtgtgtgtatatgcacacacagacacatcaagatagagtcatcatttatggaaagtttgtggaattgactgaaaacccacaaacctattaaggttctgtctgtatgcaggagaatgctgaagaaaacccagcaggcactgggcagttctcttggcacagtagagaaagagtaagtgttggatgacaacagtccctgtggtacagcacagcattgcaggatcaatgactttacatttcacatgaagcttgaagcttgattcagaaatatcatgatctagtacccttcttaaggagcttttatgaataggtaagacacaggcttgcttattttcttttcttccttatttatttatttttttccggtcaacaaacatctctggtttctctggtacccacagttccctgatcatactttgaaagccattagtcaatggatcatgatgaccataatgtgtctcgtcttattaatggttagagaaagggctgctatttgttgacatctgtggtgtgctaggtcctccgtgaaagccttcgttcatcatctcagctgcatgggggctctaatgagactgtcatttacttcgtgtttcacagccagtgtgctgcaggtccagagctggcaccggcgggcctgacttcatccctgtactcctgtgattcaggtctatctccagaaggggctgaggccaacctaacctgagctagccccctcatgtcaaactctccttgattcttaatgtattttctttaaggctttgaacaattaactcgttcgaggttacatgcagaacccaaagtagcaaaaccgggttttttacatctgtctgggtgaccttgaggcgcataccatcaggaagttcttaaatgagatttattctgtgggttgactcactggttgggtgtcccaggttttttccagtgttggtatggctttgcatggctggctcttgtcttatgagtcatttttgtgtaagtgattgtattataatagcttgaggttaaaggcaagtttttgaccatgaaactggtacttgttagattcctataaagaccaagcctgtgaccttggcctcctataatgtggtagtttaattagaaagccagatacctgtagttattggaaaagcggtcgtctgatccattgttgcagtggtgtggccagagatgatgccagataggtaagggtggccttttacttcctgcttgcctttcccatgatcctttcatttgttgttagagttcctgtttaatcttccatgttcatggtgtgtgtgtgtgtgtgtgaccccatcctggctttcaggtaaccttaggtggtagaatgctggtagttttggtgactctctctagggaaactcccagaagctagaatggagacagtttggcattcctttagcctgccccatcctgtcgaggcatatcccttctctgcaagggtagtagtatcccttaactgatgggtttatagtaggccaaatcgttgaatcaatgttaacttggggtaaaatgagtggtaattagataatcatcattgttggatctggtgttgttcagaatttctcaagtgattaaaaacaaagtaaaaatagttcaggttaccctgctggattgacaagtggtaaagaacaaattacaaagggtcacttgtgggagcagacagtgtgggatgaaacttaagcaatatatagaactagtcttctctgttgcagggggaaaagaactaaaattaaaaatagatacacaagccagtagagccttacacagcaagaagcaagaatgtcaaagatgtatgcatacttgcatgcccctccctgtgtgtgtgtgtgtgtgtgtgtgcacgtgtgtgagagagagaaagaaagacagacagacacagacagacagacagacaatactatgtatgcacttgcttcccaggtggcaactgtgacttcattctcttaaacatgtgaagtctttgttggaaaaccttatctcactttgatttttacagcttaagggggtacgaagaacacacaagatacaattagatcttttaaaattaatttcataggtatgcataatgcattctaattactccgaccatctctctctcacccccatcacccccatcagtctctttcccacatttgtcacttgtggttttgttttataacccatttcacttaagcagggccatctgtgggggccttggttagaactatgcattggagcttgatcaggtccccgggtggtatacaaccaaagacaacatcacccctttctcaataccagctggtttagcaatggggggcggggagggctttttatgtctttaaggacatgtgaaattggaacactagacctcgtgctcatggcatggattcagagagtaaggctatcatgagaagaaaggaggcatgcagttttgagcaagtgttctttacttctgatacgtgtgaggactaagaagctcccacggtagcacgcttaacagtggaagcctgtccaaaatggttcctctgatttcctacaagccagatggtgcaagcaggaaagggtagtctgctggcttcaccagagcgtgcagaaccttctcagctggctccttttacctgtggagttcacagtcgctctagggaatccctgtgtgggctgaccctggctggcctggaactcctgtgtcaatcaggctggcctgagctcagcctgtctctgcctcccaagtgctgggattacaggcatgcatgtcaggcctgctttactacctcactaagaacctctggtgccatgtggccatcagaagattggacatgaagcagccagtcattggcttttgtttcctgatgtgttaccaacaacacatgacaaaagacatttatttttggctttccagttcttttgtacaacagagaaaaattataacagccttttaaaatatatcagattaattttaattttcagtatgtgaatgttttgcctacatcaacatatatgtgcaccatatgagtgtttggtgccatcaaggtcagaaggcataggattccatactggagttacagattgttgctaaccaccatgtaagtgctaggaactgaacccaggccctctggaaaagcagcaagtatacttaagccccgagccatctctccagcctcctaaaagagcctcctagtgtattttgaaaatttcaagtacatttagtcagtttgaaaacattcataaaggttatattttggtagtaactttagatttgggcatttctggagaagtgccatactgatgagctatagagctgatggtcccgacttcacaaggtcattacaaggataagtgagttagtatttgtgaggtccttagggcagtgtatatagcaagcactgatgacatgttaaatgacatagctgaaagtcctgcggagttacatacttttgttacagagtagtgttctcattgtttaatttggaagccagtctagtctttctagttttcggaaggccgaggtacttagccccctttgggatttaatgtgaagctacattgcacagtcatacatgttgtaaccttcagcttacaatctgtggctaagaggctttttgtagtaaggagatcatgttgccttcagctattagagatttccttacgtgatagctttaaatcctaaagtggatgacatcattcatgccaatcactaaaatattgaaggcattgttttagttctgagtgtaattcagtagtagtcttacagaagatttgtgatgctcacaggagagcagttaaacaggattccttgcagctagttacaagtactaagtggattgcttttaggggttgcaattaggacattagtggcctcagagaagtccccttttctgctatccacctacaactgtgctttggcaggagggagtcgtgagggagaaacagctaagggagctgagaaagggagataagaggagtggggcatgtgtgtgagaaactgaggcagggcctggaaggacagtggaggcttgaggtgcttctgacgtgtgtgtgtgtgtgtgtgtgtgtgtgtgtgtgtgtgtgtgtgtgttaaaatcaagcttgctttctgcaagtcggttaaaagctttctgttgaggccgcctgtgctgtgttcaggtgccgagagaggagtaagtgttgaatggttagttactgttacagatcccactccgtggattccagtaaatttccagctgtcaagattttgtttatagctgttacaaaaaaaaaaaaaaaaaaaaaagaaaagtttccttttcagcctttcaaataccatcaggagaacagtgaatctgtctattaggagtttatttatgatcccttaaacaggtcatttatcagcagtagtagcgttagagaaggcccccagtggaggctgaggattgagtgaggaggggagggactgagcacaggagatggaggtaactggctgcagggtctctgtcaggggtccagagctccagagggaacaacctgttaagggaaggaatggctgggtgtggaaagcagagggctaagactggacatagaaacttactaagaaccaactcctttctcctccctccctccctccttccctccgtcctctcatctgtccctccctctccccgctttccttaatctctttctcccttttaaaaagagacatggtaattctgtcacatttactctggatctatgagttaactcctttgtgagagtctgttcatagagcatgcgtgtgatttgtttagatgaaacaggtgagaggcggaagtccctatctgagtacggttggtccgggcttgtgagttgagccgtgctcataaactgtcagtttgcgtgctgtttggaccactcctataccatgcattctttttttgccttcctttagggtgctaggtaccgtctaaaagcctgaactagagaaaagaggcagctttaggatttctagggttcgtttgctctgtttttcactgcagtgaacgtttataacagaccattagcctgcttaagaggcgatggggaaaaaagagagtgcggtgagatcgctgggtttgttcattttctagccctttgtagttctgtctgtactgtccagttgtcatgacaaaatcctacagtaaaacctcacagtgatgtgatcattatcataatcttattatgagaacaaattttgtgtgttagaaatttagaatgatatagacgggtttattatataatatgtggaaataactgaagctaaaaaactcaggtcaaggtttaaatgaaaacaaaaccaatttttaaaaaatcagctataaaacacagttggtgagacatttatgaatgttccagcagtaggttctaccatgtgtggcttaatatgtttggaaacttaaaaaagtcaactccagttgctgccgtttaaaaatgtttcttaattaaaaaaaaaaaagacaaaagatcaaaatagaaacacacattccacatgaaagtgaagccaagaagatatgctgtgtacagttattcctgtgtctgtttgggttgggtctgacattgtttagtttatgtcagctgttccaagagagaacagttcatgggagtaatattgagggatttttctttcagggaaaaaagcttccattgggctaaatactagtagaccctgaaagcatcgtttttaaaagatcaagttaacttaagtgtaactcggttaatttcatcgtagagggctaatgttaaatggtgtccctttacttactaataattattcttaatatctggggctccttacgtccccttgctaaccaagggctgtgagaaacatgcagcttcatcttcccctgagaggcaagagtcaggatttggggctgatggctgtggttctaggccagctgcggcctggcggggcctggggtccatttccactgtagtgacaggcttgagagaacatatgaagaagcgagctacctgctcttgccttagaaagcgcacagcccagccttgtaccaggccctccccctttacaatctaatcattccatctgttccacccagattagtccttcagatacttctgaagctcagtaaaatattttgaaaatatgatacttagaaatatatgaagatattctattttgaaaaactcattgtattatataccttagctagcaaaatgtattttggtgtatattcccaatatgcatttatagatcttttaagtgtaccaatatatcagtgtgtgtatgagaaagtgtcccacagtatatgatccggagaggagggagtcttttttttttttttttttttccacctgcctctgcctcctgagtgctgggatcaaaggtgtgcgcctcaacggcccggcctgaggagggagtctttatagacatgctctcatttctcccttggcctccaaggattgctttgtacactgctccccagtgcagaaactccactgtgaggaccacagctgtaaaggctgccgctgggactctgttaacagagggtagctgtgatttgctctggtgtccagattgaagcatctagactacaaaggacccacagcgagccatgacactagccatgtgtgcactagcccagaagtttggtgggatatagtgggaaattttgtcttacactaaagacataattcactttatctaaaaagcctctcttgtaagtctttctgtgtatacgttgaactgtataggcaagaagagacaatcctgtcatagatgcttaattaagggtcatataattgtaagaatgccagtcaataatggacggaagatgaaactttaaaataaatgcagttgcttagaagatttcagaatctgagcctgcttccttctccatttcctgatcctgcttccctctccaaaccctgagcctgcttccttctccaaaccctgagcctgcttccttctccatgtcctgagcctgcttccctcccccatgtttttgagcaaaattagaagtcatttcgggtttccttgttgatactaatagtgtcacctgtccttaatcacgggagttttgcagattgccaacagcaggaagggcagggaaatactgtcccgagagttttttctctgtgttatattgcagttcgccagtggtaggtgattgtactgaatggttttgtgtgtcaacttgacacaacctggagttatcacagagaaaggagcctcctttgagaaaatgcctccatgagatccagctctaaggcattttctcaattagtgatcaagggtgagggggcccattgtgtgtgggctatctctgggctggtagtcttgggctctataagagagcaggctgagtaaaccagggttagcaagccaataaggaacatccctccgtggcctctgcatcagctcctgctttctgacctgcttgagttccagttctgacttcctttggtgatgaacagcagtatgaaagtgtaagctgaataaaccctttcctccccaatttgcttcttggtcatgatgtttgtgcaggaatagaaaccctgactaagacagaggtcaatttttttcagttaaaactcagttaaagctgaatattaaatatctatatggaatatatgcaaaagagtagaaacagtctgattcaggtaaataatatgcctaatgctagctagtctgcggctagcatttaaagagaatttcatgaaatataaaagctttattctgtgttcagtctcatagatttagatttcattatgttaaaaataaaactgttttgtctttgaagctgacctttgattgctctacaacatgcagagaaaacggacaccagtcatgacttgcccgtaaagattacacattcagggtgatttaggcaacattttgttcccaccttaaccccagaaaacaaaagagtggcaagaaagccacgagttaaagcattgtttttatcccactttctcctttgagaaacaggctgagttatgagaatacgtttgtgtttataaatcccaagtttatattttaacctaagctttaacaagtcactttgaaccaactcggcacagagtggataggatgagttaaaaatgctactttatttgaatgagacaggtgctctttgtagagacaggaatgcatataaattaataaataaattaatatatatcaacattaactgggaaaacctttgtgcatagtgagagcttgctgccgtttcttcctgttgtggtatttaggaaactcagctcactgaggggcagcttcacatctctccacgtcagcgtgactctgtggtttattccgagaactgataattctagccttacacaactgggaatcgctgatatcttaatatggtataggagatggaggatccttctggctcttagcttacagacccagatgttcacagatgtttgagttttacacttttgttgtgagagtagccttgacagttaagccatctctccagccccagatctttgatttctaagttgactgctaacaggttacactaggaaatactagggcttttagttcttataattttacagtacttactttataattctttaaaactaattcaaaaggtatttgagtgtttgaactttaacaaaaatctctcttgtaaaaataattttatgacagggctacctgaactaacctggtggggctcaggtcagcatagtgggagattttttactttcaagaaagaggtagaagagaaaattaaggtttttttttttttctttttagattatgaagtacctccaggacactaagagaaataagtatgttaaataactttcacaaaatgcatccccttactctaacagctgttccattctggtacccttaggctttttgttgttttgtgttaaggggatacacttaacactgcatattttgcattagtactacccaggaaactatcttagttagaaatagaactattataatatattccatgtttatatgaattgtgctcttaagaaagtttcttttacacagattatcacacttcagcttgtttttcgaatagtgtttgaggagttacattgattcatgtagctgaagcctatttaaactgctatgtagtgttgtcttgtgtaagttaacactataaattctctggtaaatgttggcaatttttttgctagagtactatagtggatatgtgtgtgtgtgtgtgtccatgcatgtgcacatacttattagtaagcaaatgtacgagcttttaaagagtttccagtgtgatcaggagactcctgccactccaaaccctttcaggggatcataggatggaaattatcataagaagtatgtttttatttttcttttatactttaaaaaatacatagtgaagttctcctgaggatattaatatctaatattgcagtaaattaaatacagaacctatcctgttgtaccaaatttggaaaggaatataaagtaaaatcggaaaaaaaccaaaaaaacaaacaacaaaaaaagtaaaatcatcctaacgtttactaaaatttgctttggagctggagaggtagctcagctgtttgagactaggctcacaaaaaaaattaatatttccttcttttggaaaatacaaattttaaattaaaatgttatttataacatttatttttatcattaatatatatgtatatataacatttatcaggtttaacctcccttaataaatattgacggatataatccggataagcagtttttaagagtctaaagaaactttgagatcaaaaagttttaaggactgttgtccctgggtctctgtgtgagttcctggtcttagagcatcttcctgcctcagtctctaaaatagacaaggcatgcatgcagcaccactaagctttcccagtcattcatttgtttgtgttttaaggattattttatgtatagagtacactacaccagaagacggcattggatcccatggcagatggttgctgggagttgaactcaggatctctggaagagcagttagtgcttttaaccactgagccatctctccagcccccattcattagtttttaaatataggtttccatgaatgtgtaatcaaacttaaagtctgtatgctgttttactgacttagctatcttttcattggtgcctctctttcaaaatcagtaggactttacgatgctctcgtatgagatggtaattcctacctattgtctttcagaattgcttaattagttgaaggcctttatggaaattttagaacaaactcccaatttgtagaaagtctttagtgagtgttgttttggagtggcattgaattatatgaattaggagaggacaaatgttctaattatagtgagtcatctatccatgaacatcatatctctctttttatccattcaccctttccgattcttccattttattttgtcatgtttttcgtaaaggaagtttccatctcttatgagttctatttttaaatctcttgtcacttttgttatgacatctggaattttctagaacacattctgtgctgttttctattacacattctaatcaaagatagaaatttagggcatatcaacaaagaagtcctaagaggggctaaccagtctattcatatggactagagagtagtggttttagttatcagagaagtgaaaattggagttgcaaggagacatcattgcatgtgtaccagaagggctaaaaaagacagttctttctgttagccatgatgcaggatagctcagatccgtctatgtgagccgcaagagtatgacagagtagacaagaactgcacactccttgtgcacattcgccttcagtgagtgaccaacagcaccttgtgtggacatttcttcacgaggtacaaaactataggcttatacctatagtatattctgtaagaatatttactgaagccttatttgaactggaaacaactcaatgtctatcaatatgaaaataaagaaatgaattatgatgcattcatttgaagaggtactactaagcaatagataggaaaaaaaaaaaagagctgcaaatgctatcagcagcaagaagcaccctcacatttaagtggcgttcccagacaggtaaagtgagatgggtatgcagacattatactagaggatcctgtggggtggcagggactgactaccagcatagaaactgcccagtgctaaagtgcttaacattgcattgagatgtcatgtacatgacccaggacatttgtcaaagctcattggatggcacacgccattgaatgttaattttacttcagctcaaggaaaacagaagcatggatggttggaatcctgttttctggtctttaattgagaaatgccattattgtgatgggtcttttgtaaagtcaatcaatccttccttccttccttccttccttccttccttccttccttttttgtcttgtagaccaaaacccagattccattttcataataatggagcatacatgagaatgttttttgacatttgagggaaaggcaatcaaagcgttgtcagtttttgctacctttaaatctattgaatgtttccaaccaggactgtaatatatcagtttcaccaacttaatactttgtgattatcgccttcatttgtctggaaaaaaaaatcagtagaagtcagggaggacctctcagggagcacctcctctcaaggagcacctctcagggagcatctcctctcagggagcatctcctctcagggagcatctcctctcagggagcacctcctctcagggagcacctcctctcagggagcacctcctctcagggagcacctcctctcagggagcatctcctctcagggagcatctcctctcagggagcacctcctctcagggagcatcacctctcagggagcacctcctgtccatactttttcatcagcacagttcatctagatttactctttctaacgtgtatgcatatgtgctagggattggtaaccacactgaccagggacaagctgaggagttagtgtgaagaagaagacagcacaggatgccagaggtctttagctagctgtttgctctggaggaggtgacatggtgtgctgtgatggagcagttgaaaggcttccttggtttaaggctggagcggcagcgacatcttcattgtttgaggatgttctctgactacctttaggaggaggccattgtcatagccctactggtttgtgcgctgaattcatttcaaagcttttgtattttttaacatggcctttgtgggaaccttaggtatgaggctatttgaactctgaacttctggaattggtctgggttattagctctcccagactgcatgggtctctgcctctgcccttccctgttgacctcaccgtgtcctgcctgctctgtccagctttggtagagggctcagtgtggagaaaggcaggggctggatttctgtagtttggacagtgtctctttcccgagtagagggtatttaaatctggagagagtttggaaacattcttcacttggcctttgtccccgtcttgcctctgtgtggttttataaggttagtcgtgttgggactcctgtagctgcaactgtgcttccttccttgttgtgtaagagaacagtgttggcaacgtccttgtaaattaaaagagaatcctgttcactcctaagcaaaaagtgatttctagttaggttttgttttgttttttgtttttgtttttttttttttttttgcgttctatagtgatattttaaaatgtcgggtatatttggaggtatttggtttaataagtagaacaaaattgtatgtgttttggtgatcattcacgttggaacgttctagaagctaagcacccgtatttgaccctgtcctacctccatcgacaatccatgtgagtaggttagatgcacacctgctctatgtccctcttgctgtgtcagcaaaaagaaagccacggccctcagatgcccacctctcacacagcccaactaaggccaagatgtactctgaggtacgtggtttataatccatgtcgcttagggccaagcagttagggtttgaaggccctccagttgtgattctgctctggcgctccccgctggaggccagtgcaagggcgtgtgggactgtaatgagcatcttggagacccaccggctttgcataggattatggaaaataaattatattttcaggaccaagaattaaacacatgcaaagtatatgtattctttgctaaatggtgaaatatttatgttttggggtcatttacttgcttgtttgctgttgaacttttaaaattttagttctttcttggttcaagagtaaattttcctttatataatttttgaaacaggcataagttaatttattctgaactgagtattctgtcaaaaataattagtttatgcattttaatttacaattttctcaatcttttatttaggcagctaacagactaaaaaaagtttctatttctaaagcaacaacaaaaaagcaactaatatgaagacagagatgctaattgttttatggattctaatagggttggagatattttactccagggcatatgaacacttttctgcaaaaggcacatttatctaatgtaattctagtacaaatgaagtggccttttgttttgtgtgtggcgtgtgcacgtttgtgtgtgtgtgtgtgtgtgtgtgtgtgtgtgtgcatgtgaccacagaccacaacccagttcatatttgtttagcttggaatgtctcttacagcaacatgctcagaaatgaagacagtgtctatgcattttgaaaatcggtctcattgcttcctgcttttaactgatggcttctattttgtgaactatcttgcttttcagccttctctgaattcttctttcacctatttttcttctaagtgtggtgagctctggaagcaattgtatggaaatatgagtagacctagttcagccctccgggcagagactgctggaatgccagtgcctgtgtccacccatgtggcaggaattaggcagaagcaaacaggcttgctctgtgtacttttcagcttatccaccagtgtgtgttaactcagccagggtaaccttgggtacagagagtgaaatgtagccgtttctgtggacagagttacttaggcagctgtagaaggctggtctctctcctgggaatggagggacttcttcagtttacctcagggtgaggacttttgctcctaaggatactccagattggaggaggacttgagtcagttatagttctggtctcctgggagtccaagagctaaagggagtttagtgtgtctagtgtgtctagtgtgtcagtgataggctctgttacacaagcataaggatgcccctagtgtggtacaaggctcacagtgtttctcaggatgggttctgggagaaagcacgtacacaaatagtctgctgttttctctgggaatcctctgaggacttaccttttccaaaatgtaaggcatttcatatattcttaaatcacacctgtctcacaggtagacagtgtgtttcctctgtttttctttctagtattttatattatctaaatcatttatctcctttctctccttcctctttgctcctcctctccctctctgtattctatgaatttgtgtgtgtgacacacacacacacacatgtatgtgcatccacagaatatttattgaacaaagaacaactgaaaatggaaaccaagactgagaaaactcaatttgtcacacattagacgtcttcatttgttaattttgtataagtggtgtgtgtgtgaggccagaggatgggtatggttggagtgtttctgatgctccagctcccaataatgaatgacctggagactttttattatttatgaaaacgtaggcattatagcttaggcttgttcccagctagctactataacttaataacccgtttatattaatccacgtttgccacgtggcccgttacttctccttcagtccctgtacatctgactttccctgtgtctggctggcaaatcccatgcctttcaattcttcccacagttcctgtctctgcctgaatgtctctcctttcctttcctgccctgttataggttgtcagctctttatgaaaacaatcagacagtgacagagaagagtttataaaaacacctagacaggcagtggctcagaaaaaaatagcagtaccaaagttcggatagtattcaggtctctgctggtacagaaatcaacatttgagcaatacaaagaacctttacacagttcacaagaagataatcccaacagatgggcgtcctccagttctctctgccacattcttttgaggcagggtctctcactgggcccaaacctaggcttgtaactagcaagccctagtaaacttctgtttccaaagtgctaggggttggggatttgaaccaaagtcctcaggcttgtgcagcagcaggcgtgcttacactgtgagccatcaatctccttagtcccgtgtttatttacttttgagactatattgctgttcacttttgtatactttagaaatggtagtattagttacaacaagtattagtcccttgtcgttggtgagagtttatagttgacaagcactgtcaaaagatacaacttgataaaatcctcggaaagcagagcagtatttattgttcatattttgtaggttcatcagacttcatggaagtggctcatggggcagccacgggccaagggcccccttttcgtgtgtgcttccccaccccttcctttctagccacacatgacttctgtgtgtacttgcactcctgccttcctcctgcctcacttcctggcacacacagcaccgtataagttacatgtaccaagaacacgtacggcattgcttcgctagatcacaatgacttcagatcttcttccctttgttgctagctagattaaaactctagagtaagcgtgacgtcttaattcactataagtatatgtaggagatacttgtgttacttttgactcttagagagggcgtgggggatatggatgtctattggagtgtttttgatggtcaggcatggtatgtgcagccttgactactgaaagccgcctgccctgttaacatcacttgtcttgtttactgaccattcttaggccccatttattgtcaagtggtgagaatcatcattgtgtggcttttacatgctcacagtttggaagtagatacagtctctacaaagactgtcaaagataaacaaaggaatgtaatttgtggtgctttagtagctacgtgctttagcatgtgaggaaaaagtcttaacatagttatagattttcccatctgtgtgaaactcttatgaacatgaatgccatgtgtggagtctggccaaatggattgttctggttacccacataccatcaatggcatggcagtaatggggtgggttgttttctaaagacatgtatgttaaaaattatagacctccccgcagggccatgccctcgagtgccagtatcatgccaaactgtctgggcacctggcctctaccccatctcagagtgacctagagatggagtcaagggcctgccataggtgacaccctagagccacctgcagctcacccctgcacacccctgggtatgtatacccacattctgtagttggttttgttatgtgagaatatgctggagataaattctctttctgcacacacacacacacacacacacacacaccataataacccgtttttccttccccagccttgggtcccaggttgatgattctgtgactaaatatttattaataaaagcctgcctgagctttggctgttccttgactagctcataccttatttaacccatttaaacgattctgtctagcatgtgctggttacctctccttcaggcctggccctcttcttcctttgtgtctcctcagcatctctcggctggtttacatcagtctcgccattgtctcccatctcatctcttgtcttgtctctgtggctctccccgtggctctcttttatctcttactatttcctagaatcctctctcttcctgccagtattccacctcctatttcctgcctcagctctttagccaccaggtttttcattgacagatgatgtttataagagattccctctaccctctacgcatgtaattgtaaaattccagacgaaacaaaatacaagagaaaaggaaatttaattctttgatttatattgttgttctgctggggaattttttttaaaaaaaattgttattattgtgtgtgtgtgtgtgtgtgtgtgtgtgtgtagggagtgtgcatatgtcacagtgttcatgtggaagtcaggaaacagctctatgatattgattctgtctacctttgcatggtcctaggaatggaactcagatctgcaggcatgtgcgacaagttccttcacccagtgagcaatattgataacacactaccagggaaatgttgatacatagtaaagttgcataaagtagtcatgtgtgcatctaaaacgctattaggatctaggctcacatagttacagatagtctcttgcagacgtgaatgtccaacagggggcttgcaatgtgaaagagcttaacatgcaagtgcggggacctgagtttgaatccctgaaagccacagagagtcacggaaacgagagtgggcctgcaatctcagtgctcctatgtggaaatggatagcagagagttcctagaagcctgtgggtcagctagcttggcatatgtagagaggagaaacaaaaaccagtaattccaagagactgtctcaaacagagtggaaagtgagtatgaaaaatacatggacacacacaccataacaataggagtcatacagaacacaagctctggaatgctttccttcttgtgcagaagtgtcctggaggttgactgtcagggttgtgctctgaatcagtgtgacaactgaagtagttcccacaaattcagaaaacagactctggggtaaaggagtgtggtagggtatgtggatagcatgttcacggcccttggctttgatccctccctcagaggaaaagatgttctagctgacaggatcatggtgggaaatcttccttaaggaaaaacacagacgcataaggtctctggagaacacattacagcaaaggccacagtggcttcatcttctgaagaggctggcgggggcagagcacctgtgttctcttccaaggctgtggcaggccttttaccttcttcacctgcccatgttccccatctgcattcttgtggttggattcaccagtgctgtctcaagacattgtcctaggaagccttagagggcggctcttttaagagtcccttcttgtacatgctttggcagcacatagactaaaattggaagagtcccttcttaaggatgcaaaaagggggtttaaagtgttcatgaaacgttttgtgtgtgtgtgtgtgtgtgtgtgtgtgtgtgtgtgtgtgtgtgtgtacagcttacctggtaaagttctttgtgtaagtaatttgtatctgctgaattactgtggtgtataaaatataaatacattttgtatcttggacaatttggaaaatagaatttgctaccatagactaattaattgtttgacacaaagtctcagtgtatggccatggctgatgtgaaactcctgaggtggacaagatagatgtctttgaactcagagatctgcctctttggtgccgagattaatggcgttcactgccactcccagcttgtgtattatctcagtaggtgggttttgtgttatttcacagtaaacactttaggatagtgaagattggcacggggaaagcattgacttctcactgtgcaatttcagaactcagtagttcctcccttcctcttgccttccatttcctaggacagtgcttttcaggtttgtgttttccagttttgctgcagggtgtgtgtatgatctacctcaagttcatcacctaaaaaaaacccctctactgtactatttattaaaaacacaaatatactgagtgatgctcaaagcttgaagtttctgccccacagagcctttcccctaaagcttgttcccgcagtaactaacatattcttcatgaaacaacagtgctgagaagagtgtgtctcctccgtcaccacagcatagacagcactcctccttgctaccttaaacatcaagtagagtgttgttaacacatcattgtgaatgcaaaactctttgaatgggcacgctggccatactttcctaaagccagccattcattcatttactcacctctcttaaaaaaggaaaagtcaaaaagaacaccaaaccttttctatttctggagatattggtgtctgcagatccaaaaagaaacccagagctgagtagaatcagtgggcagatagaggatcgaggcgcagaccgtcctgtaacgcagcgctctgtgggctcagtagtatgctgtggacagcttgcctgctattcagtctaagacgggcaaggaccgactatccttcacctaagctgagtttattttccatggacgtttccagtttgtttcctttagacaaggctgtttctttatatgttgcttttcccttctctgctagtacttcttcaaactcacctccaaaagtagattgtggaaggacacatagcttagctggcatttgatatagtcgctgctttgtttttctagtggcatttatagatttgttctattccagctacgtggaatcaacctactttgatggagagttttttatttaaagtcttaagtggaaattaatttgataggtgaaaccctgattttaaaaggacttttatttcctttatgggtattgactgctttattcctgagtatttaatttcatacagtttatatttcttatattatttatacatttaaatttatgttggaattttgggattacttaactaattgagtgtccttttggttttgggaaaatgagatttcaaaatctaatcatttttttttctgactcttttcttttagctccagttataaaccggttcacaaggcgtgcctcgggtaagtctgattgtcctgtggatttccctcactaatgctggcatttcaaagttttattgaatgaaaatatacaaggaataatttgtggggagtaataacttactcgttgatcttttttttcctaagaagaaccccagtgtgatataaacatatattaggaattatttgaaaattaattaagccatgagtggttatgttcaagtcccactgtgacccagactgaggcagacttcatctcaccctgtacatttctccttacttttgacaaaatggctactcagatgactttctcatttaccggtgacagtttagaagcagtgatgtaacagatgggcaaaagagacccagagacaatgaggaatgggtgtttgtaactgtcctagtagaccctttagaatgggagcaagccacttgacatttcagtctgttttatattccctggcaccctgctgtatggccaagggagagccctctaccaagtgcctaagtgaggtgtggtgtgggccccttgacctgtggaggaggaggggatacagctaaaagtgtttctatccacactaatttcaggaaagggagttgggtggggaaatggatcagtgacttttctagaaaattcaccccatgggctattgtctcggaagagaagagaaatgaagagtattccgtttgctttaagagagttactcttcctcttatgtagaggtagaattattttactaaaaaatagaaggtatttcagacactacatttttggagtcagatattagaaattaattctttatttcataaaactgcctaatctcaactgtgttgtaatactcaaagctctttaaggctgatttttatttttaatttgcctgcagttattggaataattaattcttgttcacaatgaccaggcctgtaatgacagaaactagggaagtgtactgcatttggggcggtggctaccattctcggctgtctgtgatctctgcgtatttatttattttaaacaatgaaagcaaaaatgcagcttttcatgccttctgtgggatggggctgtgtttatgtctgcacagtgcagaattttatccagagcagagctgacttgaagcatgactttcagaagtgatagacaccagggaggaacaattagaacctgtgtcatgtgccattcctctgtgatgtgcagttggtcccatagaaatagctatggctcatggagctatctcccttcctgccctgtgctgtatgaagcgagacctttatttatgagtaagttccattagtatttgttacgagatgtattcatcagtaattgatggcttagtatatagattagttttcaagcaccgttcttttgcttctcctcccttaaatttctacccattgcatcccatcaggacctggctggaattgtagggcttatggagtgctacaaagaaatacaattaaaatgtattcattcccaggatgacagacaattggaaatgcgggagaaagcaatagggaaaaaaaggtcattataaaataacaatatgtttaaacggggtaaaactgtcctagtgtatgacgaacaccattatgagaatgactcttgatgttggtttcaagtacaagagacgcttttcaaagtatcatggccagtctgctcctgtgcatctttgagtcttaggaaaaatgttatatatggagaataaggatatatttaatcatctacatgtctatctttatcagctttcttacaatttttatgaaagtttgtgtacatagttcctgaccaaacgccataggaagagtctgagagactttggagggtggttctaagctttgtcagtataaggcagtttagtggaggagccaaccttcagctctccataaaatagcatttcatggaaataaaaaatagatttcttgttaaaatatagaaaattgtgggtgattactgagattgcttaaggagtctttttgggtggcgtttaatttctgtaatattttccttttagaattgaactgtaaattttaaagtttttaaagaagtagactctataggaaagaaaaccagttagaaaatatccagaagtctttgactttgtttctttgaaaataataattcaaaaaagaaacactattaattacggaataggatagaaacacatcgcgacatcaaatgtgtgcgacttgcttgatctatgggtgcttggtctcaactggctagatgaaaacgtagtgagatgcaatgtttctcatttccaagctcctcaaagcttagagtttggagcttttagtatttatatcgcatctattaaaagtaattttcagattttgataatttaaataaaaggttccttttatactttgttgctatgattcatgagggtgagaagtatctttattaaaatacttagcatacacattatttaggttcatgctcctttttctatattcacttttatttatattgatgcatatgtgtatgtctgggggaatgcatgccgtgtgtgaggtgccctcagaggacttcagagccctggaactgtagttaaagaaggttgtgagccccgaggtggggctgggaattgaactctgatcctctagaagaggagccagtgctctttcctactgagccgtccctccagcccctgtttttatatttttttagtagctccatttctgatgacttcttgtgacagtgttgtgtattttcagcatttgcccagggacctgtcacttactggttctgtaagtaaaagggccagttgtagtccacattgctaatcagaaatcttatgtttttaagaccttagttttcagaatccagttcactccttaatacagggctgtggcagtctgactaatggggatgggtgaggaccttgttagcacagagtctggccacacaggattggattggttggataagttctgcagaggtgaagatggtggccagatgtcttctgcaaaacagctacatacatctttgtgtcttcctcatggaacctattttagacacagcaccttatagtcttgttattaaaattaaaggtcttttgtttgttttgtttgtttcattgtgggttttagtaaatacttttccttgtttgtaatttattcttattttatgtgcattgctgtttatacctacctgtatgtctgtgtgagagggtcagatcttggagttacagactgccatgtgagctgccatgtgggtgggtgctgggatttgaacctgggacccctggaggaacattcagggctccaaagcgctgagccatctctccagcacctagtaaacacttctttaaaaatacaaggaaatgtttttcttctcctctcctctcccctcttcctcctcctccccccttctctcccagccctctcattaggaggctaacagtaatattcaagtttgtcctaagggttaagtggtttcaataaaaccatcaacagactgtctaccctctccaaaatattagtgtgagccctgttctatagaatgctttaaaccaatcaataaaccctcacagccttgtgccttagcctatcaggaaagaagtcttacctgataccagtgttaatcagagcatctctttcttgttgtttgcacattgcagatttccaaatggaacagaggttttctgtgtggttttgtgtgctctgtgctgagataaactggccttgcattatgaaggcaggcttcttttgttgttgttgttgttgtgttgttttgttttgtttttttctaatcataagattttatttagaaaaatatgtttatagaaaatttcaaagactgaatgatcacgtttacccagattccttgattgttaattcatcattttgacacatttacacactcttctttctttatacaccccacacatatgcacacatagttttggcttctgaaatgaaggagcccaggccagctttgagttcatgaccttcccctctccctctttccctcaggctccttagtgctaccatacccaatcaccctttttattttttattgacctgttcataagtacttgagtacatattttctaagatcaagggcattcttgtaggtagtgtattattcctataattaatggtatataaacttgatattctttattctactgatgtgagagtcacactttttctattgtctaactgagggctccccctcactcccattaaagactttgtatcttagtattacatttaattattgtattttgggttttcttctttttcgtaaattgactttctagaattttgaaatttgctttttttggagttttagaggttgatcctgacattgacctgttgttagctactgtgagttcacagacactgcagctgactgacatagttggtctgcgagaccctttgatgcccatggagttttggtgttcgtgtttggcattgctttcaaggtctgcagcagagcaggcttgctctcagaagcacttgtttcatgtaacagaaatgcacacacatatccagataacaaacttactttcttttgttgtaattctgtctttaatgctttactacaagtattgaattgtatagcacaattttaacagaggtaaatttcattatttttccctaaaattagcataaagaaaaatttagagctgaaattaaagttgggttttgggggtggggggtaaatcgaaatttttttattggaaagcaaatatacaacttggaatggatttgaggcaaattgtgccataagcacattttctttaagtggctaagcaaagtctaagaagcaagtaacagtaaaagaaaatgtttctggtacaatgccagcagtacaaaaagtcgtgtccgagtacctggataaaaaccagctttgtattcgtgcagcctcttaagtacatactgttgactgtccacagtctactcagttatccacacgtcaacaacatgctgacagttcctaacagctgctttaaaaaaggcgtaacccagatgttccctcattggaccaactccatctaaggttagacttgcagaagggcttggatatatccagagtaagccacctgcaacatggtgcttgatcagttttctaaaataagggtaggtctccgctgcactaactctctgtaaagaaacatgtttttgtttgtttctttgttttgttttcctaatgcattacagaccagtacttttgtaaaataagaaacttctatagagatatcagagagcgatagtggctattgtatcgtcctatttctggattttattgtattgtagactaccatagcttaggtgacacgaacttagcatgacctacaggacatgcaaaagttcacataaaaaggtttcacaaaggaaattgtgaatttaaccttaaaaaggtcattattcagaaaccaaacattttattttaccagactggcattttgcaagcacgcattgctgcaggaatgaatggagccctttgtagtgggtggcacaaggtagccgtgttctgggttgtgccacacatgctgtcacctctgtgtggcacgcatgcctgttcttgttggcagtatgtcacaggcttctctagactggccttgtacagtgtaccctacccacatttctagccccagcattggctgttgacactgcagcgtgtgcactcctgcggctgttactgtcatgtgtcatctatgcaggaatttaattatcattgttaccttttgcttattcctgctttctaatatgcgaggttcgtcattaatgaacacagaaaaaactgttcttctggagtaggtcgaaataaagaaactgctgggagttgactctgagagttcatgcatggctagcttgtgtgaagctctgggttccctctcccccaactctccacagaacgaactgtaggaaatgagagtggcacagcaaacatgtcagtcaaagcgagacttgggatttctctctctctcttccttccttccttccttccttccttccttccttccttcctttttgttttttgagacagggtttctctgtgtagctctggctgtcctggaactcactttgtagaccaggctggcctcgaactcaaaatccgcctgcctctgcctcccaagtgctgggatcaaaggcatgcgccaccactgcccagcagcccacggcttgggatttctgaggtagactgctgggaaaggaagaacttattacactgacagggcaagcagcgtagggtgcaggaggttttcctggaattaaggaagctgaattgacgactgccactcaaacaggtcatcagctcggtcagccactgaagtcttcagtgatggttgtaaagttggagtgactcaggagggcgtacctgaatgatgttaatctcgaagaagcgcaagctttttcacgtgtgtcccaggcaggatgctggatggccgtgtggggaactctgagaggcccttctgtgctgcaataggaaagtaatattcttggtcagaaatattttataaaagaaattgactctggtgtctgtggggaaagtgttagaaaggagaggagtgggtaggaagagcccacagatcagcattgctactgagcactcagcaccattggcaaccaagcggtaagtactctgaggtatccttgaggaagctgcaggcacaagagaggctcagggagagggagatgggctagtgacatgatgtctgtctgaggggtcctcatcacaaggatgaccaagggtacagagcagagggcatggttggactgatggggtcgggtagaatttattatctgtgagtgcttgtgtaaattaaaggctaactttaacctcccactacttcatactgcagaagacaggatagaaaagagaagaggtcagagtggcatggttgtcccactgactgattaaatattcagtaagaacttacagtgtggttagccccaggctaagcccaaggaaggcagtgatgagggtcttagatccataggttattagctatgtgattaggacaaattacctaagctgtctcctgtaaaaatgatttactgtgatgactcatggaagaatgtttagagagctgtcagcatgacccctgccgccgtatattctctctctctctctctctctctctctctctctctctctctgtatgtgtgtatatattagtttagtgtatcaaagtttaatggaacagaatatcctaacattgattctgtttttttttctcttctgtcacttcctgctcttaattttaattagtcaaaagacataagtacataaatttggggaattacctagtactaccccaagtttgcatgatcactgtaatagcacatgtgagaatttctttagctatttaggtaagaacagaagcacaacttctgtcccctaaattatcagctggacctataaactgttgttctgaagattgcaataatagcctttatgtttcaacctgctattttagcttgtatgtacatgctgccaccttaccccatggctcccatcagatttatccagcctgcagcttttgagccagtaactagaggatgaacaatattgtgcatgggtgctgagtccctgagctcagtaagctatttcatcctagttaacagtttgggcaagcattttgatatttaaaaaattaatgctctggttaaaaaacaaaatgcattcagacctcctgtttcttttatcagttgagagtcagatggttctgggtgcagtggtgcccacctgtagtcccagccctcaggaggcagaggtggaaagagccctgcaagttataagccatccagggctacaaagcgtgcctctgctgtgggacagtaaaaccacaccaggaagcttggtaaggtagagcaggttgagacccagaggcttggtgggcacacacctgagacttaggcgactccccgctccctaccagactcctggcctggaacatgtaccacgctcctcacataaggaaatgtgacctgtgggtcacataggcccagaacagagttctccatgctactgaggtacctagaggcccagagggcttagccagtaagcttcccttcccagacattcctcctgcaaaaggtacttaatcccaggtccaccctgagaagtgggtatggttagggtcaggtatgcatccattttccaccatgaacagtcagtacacagtttagaaccacggactgccccttgcatctaccaccaccatggggaattgcaggtcctcacctacacaactgcagctaaatctcctgtagagggcttctctgtgcttccagcctgcctctgccaggctaaggacaccatcatcagaaaaggtggcagagatcttggatattttacattggaatcctaagtcgtcttccttttcaagacagacttatgtagtttaacatattccttgcatggccccaggtaaacctttgagccaggagggtattttctgacagctcctgcccggatgctgtgtgaggtctacgcaggttgtgcatggcagctacagcaggggaagctcttgtcctccctgtctgctctgtggctctctacaataaactgttgctttccattgtgcttctgtgtggtatttgtactttattttaaattttgtgaatccatttactgcatcaatgttattttatacaaggggatccatctagtgtatttttatttatttatttattacgtattttcctcaattacatttccaatgctatcccaaaagtgccccataccctcccccccacttccctacccacccactctcactttttggccctggcggtcccctgtactggggcatataaagtttgcaagtccaatgggcctctctttccagtgatggccgactaggccatcttttgatacatatgcagctagagtcaagagctccggggtactggttagttcataatgttgttccacctatagggttgctgatccctttagctccttgggtactttctctagctcctccattgggagccctgtgatccatccaatagctgactgtgagcatccacttctgtgtttgctaggccccggcatagtctcagaagagacagctacatctgggtcctttcgataaaatcttgctagtgtatgcaatggtgtcagcgtttggaagctgattatgggatggatccctggatatggcagtctttagatggtccatcctttcgtcacagctccaaactttgtctctgtaactccttccatgggtgttttgttcccaattctatgaaggggcaaagtgtccacactttggtcttcattcttctagagtttcatgcgtttagcaaattgtatcttatatcttgggtatcctaaatattttaattccttgttttttaaatttgaaagccaaaaatatttaaaatccataattacatattattgattaacatgttggtaattatgttttgccactagcagttacctgaaattaaaaatgtttcctttagttaagtggctgcttcagagggagtttatgatgcttggttgtaactgaaagggccaaagtgcatgtcagattgtgggcagagatcactctgagatggctcattaatcacaaatgttttccatcagttttcaataattctcagtcttttttcatctgtcatcttgtcaaagaataaagttctctagtgaagataaggactgttggattcaagtgccagtgtttgccaccaggagccctcagctctgcctccctggtggtagctagagagtccctggcagctcttgcagggggactttaggccatcctcatttcataggcatagagactgaagcataatgagtgactcagtccgcatggttatgcccaaggtcgcactctttttattttcaacgttatcgaaatactgagtcaaaatagttttaaatctgttattaagcaggagtaaggtcaataaatagatttataaaaagggttgtgtacttcatcatccaatcatgcaggtatttgtgaacattctgcaagaaatattcaaacacttttagtctttctttttttgagacagggtctcatgtagcccaggcctcagcatcattaggtagccatggggacggccttgacctgcagatcctcctgcatttgcctcctgtgcgtgagtgtgtgtgtccatgccccgtgtatgcagtgctatgtacctaacgtgtgtgtgtgtgtgtgtgtgcctcctgtgcgtgtgtgtgtttccaggccctgtttatgcagtgctacgtaccaaacctagggtcttgttcctgttgagcctgcactctgcctttctaacctgtaactacttttctgttgtgattttcattctggactttaaaattatgttaaatattttatgcttaattccagcaagttaaaggcaattgttgaataatttccaatgtactgtttttctacataggctcttataggtgagacagctaaattagtgttattattagcagggttatggttgtttctactatatgaaaaatgttctttgattttatcctattcatcactaaattttctgcactctgaattactagtttacatatttatgttttcagcttttaataagtgattcagattaattttgatctaaatttaactgttaccaattttcttttagttagaaacctgaaaacagcccattaccattcaaatgattggagatgtactgaaatgttaaaattataatacacagacctaccaacatttctacaaactatttgttttcattttattcagatttattatcaccatttctcattgaagaaggggaataaaaactttaatgtctggaaaattcaaattcaatttaattacatactctttttgcttgtttaatgacaagatcttactgtagtctgggtggcctggagctagctatgtagaccaggctaaccttgaactcacagagatttacttggttccctcctgagtgaagggattaaaggcatgtgccaccgtgcttgggttttatttatactattcaaattctgcaactcagacagtaaattaatgtataggtaacaaccaaggatgactttaaaaactgaatgtttttgcttgattggtttacagcattgtgattattaaatcctttgtaatggttaatcctataaatgataaatagacctactaatttctgtttgtatagtatagaaactgatatcataagccttgtaagtagcctggcaactaaaaatggtaaatatagtctgttgacttagaaaggaggtgagacccttgtactcaggagtgacccagtagagctggccctggacgtgggggtgtgggaacaggagatcctcctcccctacttaccaggtagggacatgagagctggagagagctggccctgccccttgccaactgcagcattgggtgagctcgctggagcagtactggaaagctcaccctggtggggtgggtgcaggagagctggaaggctgacttcccaggctaacagctaccaccagcaaccacccagccccagatccagggctttgagttagcccatcccaacatgaagggccctgtcttgcagatccaaagctgcagggtttccatggcatggggcaacaacaggatatctgagaggagtctcagtgaggtgtcagtactgatagagtagtagaagccaggggcctagaagcagaccaatgactcactgcaatgaacgtttgcaagtaaagctgtttgggctaaagggtgtactgtgtgacacaccatggcactctgcagcttcctcgaggatattttgtctttgtttttgttttaaggggaggttacagatataaaggaacagggagatgagtgagattggggtgcgtgatgtgacgttcatgaggaatcaataaagtttaaaacacaagaaagaggtgagacaaggggacggggtatacagggtgagcctctgtgagaggtagggcttagcttctccagttcagatttttaatttgaaatggttcccaggttctatattgtcagtgacagtgagtcagaattttttttcatttaattttaaatttagaaattttaaatttaattttaaatttagaaaatttaaatttaaaatgtttttaaatttagtttcaaccatgaggtcatgtttcctactatagagctgaagtattaatgctttccccaattggaatcccgtgaatcaatattgatgttttcgtagttgcagtgagtatgtacacaaataaacagtactccctgagcttagtgttctgaaacttgtccaatggtgaagtttagagtgcagacacaatacattgttgcataatcataccataaaaatatattcatacattatgtattttagaagtagaattgctttgttgaggctgtaagaatgtgaaatttgtccatccgttgccagatgccctctaaaatcaaatacgaattcatcttcctttcttgagtttagcagagtgtaaaacagaacatttaaatgtttctaaatttgcaggtcagttactcagatcgtatttccttactctccaggataacttagcctctgcgcatctcgttcgccacttgtatttatctgctcgtggcctgctcagtcctgaggctcctagactgtgaattcagaccaggacatgcctgctcattgagtgctcgaccctgagatgattgcttgctctctagatgtcagtctaacaccagtcagatgtaatagtggatgtaccaagcacgtggaatgctgttgtataatgagataactactgtaaagtacttaacacgttttgtgaactgtggtgagaatacggtgtatacttgctaagcgttattaatactataaaggtctttaaaaatgaatgtcagaatggctaagatcaaaaattcaggtgacagcagatgctggcgaggatgtggagaaagaggaatactcctccattgttggtgggattgcaggcttgtacaaccactctggaaatcagtatggcggttcctcagaaaattggacatactactaccggaggatccagcaatacctctcctgggcatatatccagaagatgtcccaaccggtaaaaaggtcacatgctccactatgttcatagcagccttatttataatagccagaagctggaaagaacccagatgcccctcaacagaggaatggatacagaaaaatgtggtacatttacacaatggagtactactcaactattaaaaagaatgaatttatgaaattcctagctaaatggatggacctggagggcatcatcctgagtgaggtaacacattcacaaaggaactcacacaatatgtactcactgataagtggatattagcccaaaacctaggatacccaagatataagatacaatttgctaaacacatgaaactcaagaaaaatgaagactgaagtgtggacactatgcctctccttagaattgggaacaaaacacccatggaaggagttacagagacaaagtttggagctgagacgaaaggatggaccacgtagagactgccatatccagggaactaccccataaccaacttccaaacgctgacaccattgtgagactatgctggggcctagcaaacacagaagtggatgctcacagccagctattggatggatcacagggctcccaatggaggagctagagaaagtacccaaggagctaaagggatctgcaaccctataggtggaacaacataatgaactaactagtaccccggagctcttgactctagctgcatatgtatcaaaagatggcctagttggccatcactggtaagagaggcccattggacacgcaaactgtatatgccccagtacaggggaacgccagggccaaaaaaattgggaatgagtgggtagggaagtggtggggagggtatgggggacttttgggatagcattggaaatgtaattgaggaaaatatgtaataaaaaaaatgaatgtcaatgttgacattatatccatataattggtgggttttccttctttacaatatagtaaccagataagttatgttaatatattgtctagttctggactaacctcatattcacggaatgagctctgattcttcacgcatggttaattatgctcttaaagtggaagtgacacataattgttcttttagcacacaccagaataaacctttgatcccagaaccaagctcttgagtctcgggcacatgttagagggcatcattggatgaccacctctttctttcttagatgaataagtgggagctggagctagcaattgcacagctggaaactgttcttgaagaacttagtgatcacagtaagaagtattgatcatctataagatatgctagttagtgcaaacagtgaacatcacatcccacaagaaactatgtgcagagtggcattatgtgtctgtctcacagtcttatgtatattaagattactaatgtcatatggcatttaaaataatagtcacggtgtcattttctaaaactgcaaaagaacttttcccaatagtaggaaagtgttatgtattctaatttgcatcttctagggacataatgcatctctgaagtagtatattgttttgatagcacaaattctattgtgtttgatttcattttaaactgtgaatataacagaaaagtggaataaatacccaccccttcatttccataaatcatgtttgtatgaagtgagaacgtcaccattccaaggtatggtggagggggagttttttgttgtagatgtgaggcagagcacagccagaggcatcgggaagagtccagagccggaagagaaagtaagaggctaaatgtggccagaagattggaccagaccatgaggggggtggggtgcagggagtgagaggacaaagagagaagagcaagagagtgcaaagacagcctgtctgaaatggggggttctgtggaaaggacaagctgggggaagggaaacccctgggctggaaaaggttagggtaggaggccgaattaggagagttaggatagcaacatgagctctctaaccggtatttaggatgctttggtagctagtaggcaccagggatagcattgtgtcccttttggacctgacaagatctaaggactcaaatgtattctatcctcttacttctgcttttttttttttaaatcttgaaaacactattatagtgtggcatgagggaaggataatttataatgaaaacataaatacatgggttccatgctttgagcccactctgtatacagacttataatataactaaagcctggcattccagctggacatggtagtgcacacctttagtcccatcactcctgaaacagacaggctgtgtctgagttcaaagccagcctggtctacaaagcgagttccaggacagctagggctacccagagaaaccctgtctcaaaaactaaacaaaagaaaacaaacaaaaccagcgcagcattccacagggaaatacttcaagtacgtaatagttaaatcacttactgggtgttaacttgagacaagaactttcctaagtggctttgtgttattgatttacgtggatttgtgttgttgtgttattgattattctttaaagaaactctgtataccaggcacttttctagtattaaagataaacagagtcactggccagttctttgccttggttacctagcaaccagtggcagggacaagactgagagtcagacttactgttgacacagttttgcactgtataccaaagtcctgtcaacactggatattcccaagggcggctccttactttatagatgagactctaattcatattggttagtagtgtgcaaacattgctgagatcccaggatggaggagggtacagaggccagttgcggttctgaggtctggctgcttgtctccttcaaaacaaaccagaacagggaaaatcttggtgaatcggagtgatttctcttccatgtggctgccactgggaaggtagatctgagagttgtcttcagggatggtggaaaaagctcactcctcaggaggaaaggagaaaatgcagggcaggaaacacatagctgagcagtcttggtcacactgtggtctgattgatcattatcagcaattagaacattcctgtcactggatgtggtggggtgacagcaccagtagcactcaggagatggaagaaggagagagtcctaagtttggagccagtgtgacctattggccgattcagtaagaccttcttgtcttgggggtgaaagaaaacaaaatagaaacttgctgttgtatggagtcgttttgattcttgcccaggacacttgcagatcgggtgagtgcagggggactgcaggaagacatgacttgcagaaaaggatgcacccggaaggcaagatagagttagtgaggccgctaggcttaggatggtgacttgaaggcactgctctatggtctggagcacaggatgttgtgaaagttggcagttgacagtctgtcagtagtgggtggggagacacacttcccttagtagcctgaagagctccctagcagggagtaaaactggctccctgactgttgtcacagagatcattacggatgagtcagagtgacttggaagttgacaaagttactcaaacccaagctcccgtggggagggacaggactgatgggtggcctcatcagctgtggaaaaggacagttcacaccggacgcatggatgtcagtgctccttgagagagccctgattagatgtctcggtagtcgctgtgcacataattctgtgtctctctggtttatattgctcaaggggtgccatttatgacaaagtaaagtttaaatagtatgtaaaaataaatggctgttttccttatttctcttatctgaaagataaacatggaattataagatggtttcatgaggtgtgttgtttagacttagggatgaaaggagtactggccacaaacatcctggccctgtgtaaataaggttctctgtttttaacatccttgtttgagccgtctttgggaaaacaagcaccaattttatgggcagtttagattttatcagttgtattgaagtctctttacctagccagcaggaaagacaaggtagatagatcctgttaggctttagaaaggggccagggaagaggctaggatgaatgtcttttaacttgattaactctatagcaagtggtgtggttcagtgtgtgttgagcgtgagtgtgtgtgtgtgtgtgtgcacacgtgcacgcaaattcgagtgcatgctctcacacgcgtgcatgtctctcacttagtctgtcttatgctctacaagcaggagaagcttcagtctctccagaacgtagagcctggctacctgcaaaccataagaagccccagaaaaaggttccgattagctcagtcatcaggggttagggttgcctcatttgtcttagggttcattatagcctgggtgggcctagaaattcttgactgtatctgtggctaactttggttgacccagctaggattattagactcatgtctgctagctgcttcttaggttaaagtggctgcctcgaagaagccctctgtcaatcggtctttgccactgtcttaaacacttaaaatgagagacactggccaatccagagctcctggtatctagatgcttgctccacctgtttcaccacttgccgatgtggcggcaggtggcccatttggatgtgtgtccttttctgttgagaaacactgttatttatagtagaatattgcttcgtgaagaatgacaagaaataacagtatggcacagatgtcactgttctttaaaagaataggcccattatcttgcctatcagttcacccaactgctgacggaagagtttgcagagaagaaataatactttactttatgtcagtggctttaaagagatacagttggggtgcaaggtcagcctcttgtcttaaaagcccccccttttttgcatttgtttagctgttttaaaaaagactttctttcattctctctctctctctctctctctctctctctctctctctctctctctgcacactatgtgtgtacaggtacactcagaggtcagaacaggccgtcatagctcttacaattggagttgtaggcaggtacaagctgcctgttgtgagtgctaagatgaaacctaggtcctctggaaaagcggcacacactgttaactactgagccatctctccagcccccttagactgtatttgtaatgttattttcttaatcaaacaaccacttggttttttcacaatatacaaaataaaataattatactttaaaattagatggggggtggtttttttttcttttagttgaaagcacctcccactttgtaagaggactgttgcttcctgcaaagaaaggtaattgtgtggaatgattatattttcataattacaaaaacagtgctttataatcttattggttattctgctgtcattctagttaaatgaacaatcatttagtatttattgcttacaagatgctgttagctgcatggggtttctaaactgttatgttaaggaaggtgaagcttaggggaacacctacatagtgtgaacaggaaccaggtacacactcagtgtgtctgtgttctaccatgggcgagggagccaggaacctgccatccctgtaggcttgctggcccgctctcgagtgcagctgttctaggctttaaaggcactgacttgaatgctaggggatttccctacttcttgcttgaggttgctctctccatatggcatgggatacaacctgccacaggcccatgtgtcacggcagtaaccactgccagaaggagccgcacctcctcttctgcaagcttttagagggaggcagtggtgactgctcctgggggaatggcagtcagggatgtgatggatgggctttgagaacctgtgtatctgactccatccatggatccctgtgggatttatgaggataatgctgattagtaacactttcctgtgcgtgttgtgtttaggattcatgccctgtgtaaaatgagatatgcatacagtgccttctgtttctatgcaggaggcggatgtaattcgaactgattgtttctttagtggaaagtgagtgtcagggcttatgtggcatttggttatagctttgatggaaaagcagggtttcagtcggcaggagtacattgtaaagaagtgactttccccggtatgtgaaccatgtaagacgactttgtggttcaggaagaagtgatctaactaaatgtcaagtacatagactctcatatggactactgagaggagtatcccacgtgagagctgggtccaggccagcggagaggagcctgggagagcagtgccaagagtttgggtgttttctttgttgtgtttttagttttgtaactaattcatcaatctatttactgaataatttcgtcttaagacagagttttgatctgtcacccacactggccttgaacttatcatgtagcccaggctagcctttaattcagccgttttgcctcaaccacttgagacctgcaactgtatgtgtatgtgaccctaactgctggagcttggattttattctgaatgagaggaaccattagaaacgtgttgtttgtttggagttttgcttgtttgtgtcagataatgaatttagcaaatgattcaacccctggacaacaggactagaatgttaaagtttcgaaccaggtcctgtagtgcctgctactcatctggatactgtgcaggaagcagctttgaggagcccatctctcacaggtgcagctgtgtgtagggatccagttgtcttacagaagtgcgcgtggacctggaaacgccaaaggacagacatcctgagtccactcagtgtttcctgaacccgtgctgcttatgttagaaacccgcagcttcgacattctaatcattatttttgagatcttttaaagaaattaagagacgaggaaatgtacttacggagtcttacatttatccaaatacatgtcatttaaagacattgaaacttttaatttaaaaagattttcttggatggcttttgagagagtgtgtgggtgtgtgtggaggccattgaccaacttcaaatgcatttgttttgagataaggtctctttctggggtttggggctcagcagtgacgttagcaggggtcttccataagcattatataagccaccatgcctagcttctcatatggattgtggggcaagaactcgggtcttcatgcttgtatgacacacactttactagtccatagcaccctccagccctgagatagggtctctgtaggccaggtgagtgttgaacttgctagataactgagaatgaccttgaacttgaaattctgtgactccatttgccaagtgaggagatttcaggtgtgtgccactacccctggccactacctctagtgtagtactggagattgaacccaatgccttatgtgtacttagtctaattaccatctaaatctacatctcaggtcaattttcattattttttgcaaaacaaaatttaatggtttaagcattatcaggtgtttggttgtgcggcatcaagtcttcacattgatgtccactggtcaacaccatctgcccacagagttttacgccttagctgtaactgtctgcatgaaacattgaactccttcttcagtcccttttcctgtagccactggcaaccaccatgctccgttctgtctggctctgtgaaggtgagtactccagatgtctgactggctacacttagtcctgcggtaaccgattcatttcacttagcgtgatgcctttaagggtcatccacgttataacacatgttaaaaattaagtacattccattctgtgtatattctgtattttgtttatacgtcagtttcctggttgacataaatctgcattttgattattatgctattatgaaaacggatgtacaaatatctgagtctccactttcagttctttagagtgtattccccggagggatttactggaacatatggtaattaaaaatggttttttgagcaattgtttattagtttctcttctcttgatgtgataaaatgtcctgaagaaaacaacttgagaaaggctttatttttgtcctatggttccagaagagatatagttttgtcatagcaggaaaggcatggtggcagcaggaggctggcctctcatggcctcagaagtccagaagcagagtaaacaggaagcagggatagactgtaaagccttagtgttgtgatgatgcttcctccagcaaggctctacctcctaaatataccatcacctccccaaacagttcctccagccaggagccaagtgtgcacgcgcaagaactgtggatggggctggggctggggctgggcttggggctggggctggggctggggctggggctggggctggggctggggctggggctggggggtggggctggggctggggctggggggtggggctggggctggggctggggggtggagggcaggtcatgctcaccatacagcgtagtgtcatactggtttccacagtgccacacaatgttgctccccagcagtgagagcttccagaatttccatagcctcactagtgtttgcctttttttttttgtaaatgccaatcaaatgttcctgaagtattgttttgtagtgggttggcttaccatccctgaatgatttgtggtatggagaaaacatttttcatgtgcttattgataattttcacatgattgaagaaatgtctattaagtccagtccccatttttaaactaggctgtttttctcttgttgagttctttataaattctggttattaatcccttattaaggccatggtttgtggttttctagcatttttgtggaccaaatattcgccatttctggtgctctgcacttgtttccttcctcctgaattgagcttctgtctggcgtcacttccttggcctgaaagacttcctgtgacctctgttgcacatatgctaacagtgcagtctctgcttcctggaatgagttcacttcatggtgggttttcacacacacacacacacacacacacacacacacacacagtgtttttaaagcacagtttttctacatatagacttgttggaggggcatatttttctgtcagcacttacagcatgtcatttccctgccctctggcttctctttgttatactgaaaacttaggtcatgttaacattctatttggaagctttctctggttttgacttttaacaatgtgaataacccatgcttagtatgggtagtgtctttgtgtctgttctgtgctgaggcccataggacttcttaggtctaaacattgatgactttttgtgtcttgtcctgtttgcgacagggttttaagttgctgtactggctagttttgggtcaacttgacacagctggagttatcacagagaaaggagcttcagttgaggaaatgcctccatgagatccaactgtaaggcattttctcaattagtgatcaagggggaaaggccccttgtgggtgggaccatctctgggctgggagtcttgggttctataagagggcaggctgagcaagccagtaaggcacatccctccatggcctctgcttcagctcctgctttctgacctgcttgagttccagtcttgacttcctttggtgatgaacagcaatatggaagtgtaagctgaataaaccctttcctctccaacttgcttcttggtcatgatgtttgtgcaggaatagaaaccctgactaagacagttgcccagcatggctttggacttcttatcctcttccctatacctcataatgctgagattagagatgtgtatactatcttaggtaaatgctgttataaaactgtaaaacttgtttgcctatagatgaattatatagtctatctagcccacataaaagacacagaaacttggtattttgtttacaagctataagcctaggttgggcgggttctgtgctgttctctcacatatacaaaccctttgtcccttgtgactcactgtttgagtctcgctcaggctgcttttgctccatcagctgtccttggggtgcacttctctgggccacgtgctgctggtccatcttgtctaatggaggcctcctgatctctttgtcttctttttccatcttcccgtggtctctctcattcgatttttaagttccacctctctctctctactatccaatcacaggctctagccttttattaaccaatagctttaaactggggagcaagggttacccaacaaaggccagtgtatgtgagaacacacttgtctggacaacaaccagatcttggggttgagactttagcaatggcatacatagtgacagaccaacccccagcgtttgccaacatctctgagagtttcttcctctcctctttgtagcatgtttgagagggacttccacacgctgtcagtgtggtgcacagtgtttcacagggttcttagacaactcatctttgctcgctcatttttccagtggaataatttctattgatctgcctttcaagttctttgattctgcttttaacattggctctacttgtttagtgtctatagaaccgtgtgcatgtgtgcacatagagatgcagaaatacttgcctgcacatgtgtatgtgaagaccagaggttgatggtcggcctcttcctcggtcactttctaccttactatttgagatagggtctctcactgaacccgttttctgactggccattgattccctgggatcctcctgtctctctactctccagtgctgggcttacctgtgttgtgtgtcctgccatacctggctttacttgggtgctggagacgtgaaatggacctcacgcatgcgcagcaagcacttactcactggccatccctctagccctagtcttcgattcttccttccattgagctgttctaatgacttcagaaccaaaccaaacccgagttgttacatttttcaacacgttttccctgtgaccccttcttgtaatgttctctttaatgaagctgattactgaatcactgatcagccgatcagatatggtttcctctgcctccacgaaggaaatagcctctttgaagtcttctctgtgtccagtcagttctttgtagcctgtgggtcacatctactttttctctgcatgtgtcatgtttgctaagagctggacagtttaggatctttacggtaatgtttctggatcccgagctcccctctccaggttgtggacagtttaggatctttacggtaatgtttctggatcctgagctcccctctccaggttgtggacagtttaggatctttacggtaatgtttctggatcctgagctcccctctccaggttgtggacagtttaggatctttacggtaatgtttctggatcctgagctcccctctccaggttgtggacagtttaggatctttacggtaatgtttctggctcccgagctcccctctccaggttgttgcttcctggcaggtgggagagccgacttgtctgtgcttaaattcctgtgttccagctcgctgtggtttgtggctttgagggttggcttgtgtctgcctgatgttatggtcaaaagccactcacagctgacagatcctgtgtgagtttgggaacatttaaatttcaggcagttttcaaggggaggtttggcatttactctctgctgggtcatctcatgtcccctctgcctgcacagagatggtctctattgccctgttgacttccaggtgtaggtagacggcttgggccctgccagtttcttctatgtccccacaaagcataaccacagctcagacacatgggaaagtaaccagactcctaactgtctcgctttccgttacatttctagttagtttactgaatctagggatgacaccatcttatgctctctaagcttcaggcctcttgcttgtctttcacccaggtcactgtaaccagcagtgctcagggcaggaactgtgtgtggtaagtgagtgtgtgtgtgtgtgtgtgtgtgtgtggtgtatcgtgtgtcgtgtgtgtgtgtgtgtgtggtgtgtgtgtgtttgtgtgtgtgtgtgtggtgtgtgtgtgtgtggtgtatggtgtgtggtgtgtgtgtgtgtgtggtgtgtgtgtgtttgtgtgtgtgtgtggtgtgtgtgtgtgtgtgtgtgtgtgtgtgtgtagtgtgtgttgtgctgtttgttgttatgttttttgtctgtttccatgttcacctagaatggcatagcgagcagccttgggcagggatgccagtgatttgcactgtgttaactgaaaatctggtctttttatgaataaatgcttctatatcatatgcctttcatttccagagtgctgatttcctcccctaagttccggataactcctctctgcctttttggtggtgggggtggggcaggacctaccacgttcctcattccactaggctgtgcctggaacttgctgtgtagaccagactggcctagaaccggaggtctacctcccaaatgctggggtgcaaggcatgtgccaccatgtctggctaaagatgttttttttttttttaatgatgcattaaaattacaggaatgagatagacgtggtgttcatactgaggagtggcccttctgtgctagtcaaccactggatcactgggctgcatcctacccaccatgttgttctttcaaataaatggtgttagttttattagaaacagtttttagttttactgtggcattgttaatgagttattttcctaaagtatttgggaaaaatttggcaccttgattctgttagttttagagatggtatgtttttaggaagtataaaatattaaagccaatttgagaaaagatgagataccttaaaaaaaaaaagatggttagtaagataccgttcttgtggttttaattccttcttgtacctgagatgggaataatttgaggcaatttagtaatctttttgaagtatggatgtttaaagatgtttgagaatacattttaaattattatgatggtgatgatggtggtgatgatgatgatgggtttccagacaaagtttctctgaatagccctattgtcctgggactcaatctgttgaccagtccggttttgaactcacagagatctgcctgcctttctgattgtaaagtgaaaaaaaaaacatggaagggtaggtaggaaaataagaatagtcataatctttctatagagcagtacctgctatgtaaacattggtatccaccttgacagccatcttttatgcatacgttttttataaatatacaatatacacctgcattgcaaatgactataaaaacattttataagatattattgaacagcaaagttcttaatcgaaaatgaaaccttatttactttttttttttaagagtatctcatgtagtccagactggcctctgatccactgtgcagccttgaattcctaattctcctgcttctccctcctcagagctgccgtcacaccgggttgctatggtgcctgggattgattctagggcctcctgcatactgggcaagcactctaccaactgagctgtactcttagcccctcaaagagtaatttaaaaatattaataacatacatgaatacatatcttaattattttttatttattattggggactctttttaactatcggtttttagatggaaggacttgaagagtacttactgaattgaccttgagaatgttaaaggctttatcttttaaaagatttattttatgtacgtgcgtacaccgtagttgaccttcagacacaccagaagagggcattagattctgttacagatggttgtgagctgccatttggttcctgggaattggactcaggacctctagaaaagcagttagtgctgtaaactgctgggccatctctccagccctcaaagcttttatttttgagataggatcttaatgtccagagcggcctccgactcagctaagggtgactttgaaccccctgcttctgcctctggggtgcagagatggcaggcttgtaccgcctgccataacaaatttatgtggttgtggggatcaaacccacgccttgtgcatgctaagcaactcctctcctcgctgagctacatccccagccactttcaaagcccgtgatacttttcgaatctggcgtcttccattccattcccacttctcaccagcagtgctgaggaatttcattctaaacctgtctttgccatactgtcttttaacttaaacaaattaacaaaaacaaaaaagacccaaagaactttgctaatttatttgacacaaatgtttagtagtttgttcctagattttaatttttccttattatatcattctatcttaatttaaaaaattcacttgattcagatcttggtcagagaaaaatgacagctgataaaaaagaatttctagcaaaagagaaattaggatacatgtcattatatattattgcttttcctaaagacacgtaaaaattagacttgatagaaatatgttaggacctacaaaactttcaccgaattttattttcttagaacagtttccatgagatagtatagtttgaacccacaggaaattcgtatttttttaaaagactgttgagtttcattttaaaaatgaaagtggagtcagatatgatggttgtgggggcctaataacccgagcactcggcaaggctgaagcaggaaaaaaagagaatagtttatttagacaactttaatcctgttattttaaataataaataagtcagactcttgagttccatatcttctcaccgtgttctatcattcgagtctttgcacactaacaggcattgtgctgtcacacattggtaagcagccgccgtcttgctagatttctcatgattgcaccaagaggcttggataggagtctcctctggtgctgggttggataagtcgggacccacaaagttccagtttcccatcctaggacaatgtggtcaaatgacacttgttctggaatgtattagtgaattagaagaatacctgcggcttctctcattctctcatgtgtgtgtgtgtgtgtgtgtgtgtgtgtgttggtcagcattccagaaacagaagtattcaggaatactgttctgagtaataaacgaaattatttagtgatgctaaataatataatgtagggctagacctaatattttaagggcagagttatattatgactatattagtgtattggctagtatttctatttgtttattttagtatataagaagattttagaccaaaataaataccaagagataatcatattccctgaacaatgggagccttttgacaaatttgggaaccggtcagttggtatttaaaccaaaggatcatacttgccaaggaagaaatggcctcccccaaccccttctcagccctcactatttgtggcaggcaggaaaactggctctgccccttgccagctgtggcattgggtgagctagctggagcagtgctggagagcttgatcatcctgatggtgtgggtgaaggaactttggcaggctgaccaactcagctaccacccaggctcagatcctggtctttgaattgatccacccaactgctgaagtccacgaaggggccagtcctgtagactcaaagctgaaggatctctatgacacagggcaacataggctacccaagaagagtcccagtgcggattcagtatagatagtgtagtagaagccagaggctcaaactagaccagtgactcattacaatgaacatttgcaagtaaaggatatactgtgggacacattacagcttccacaataagatgtgttttgttttggtgtgtgtgtgtgtatgttttcttttctaacctgagggtggagtaaggttaggttgcaaggaagatgagtgtaattgggatgcatgatgtgaaattcataaagaatcaataaaaatttttagaaatcaccttgactattagaataatttttaaaactttttcttagatttatttttgtttcgtatattagtatcttgcctctgtgtgtgtgtgtgtgtgtgtgtgtgtgcgcgctacatgtatgcctggtgtctgtggaagtcagaagagggcactggatcccattgaattggagctatgggtggttgtgaaccatcatgtgagtactaggaaccaaattcaggtcctctacaagggcagtaaatggactttgcctgatgagccatctctccagcccttttccttccatcctccccttttatgagacaggatctcactatgtagccctcatactaacagacccacctgcttctgcttcctgagtgctgagatcatgcacccccatacgtggttccttggctgtcagtttatcaaaatgcataatagtcattaaatataatgttcataaatacttatggaccagttttagcaaaatacaaatataattctgttctgatactgttttctggtacaaactaacccattcactgctcactgcttggttatattttggagagactccttgatgaattctgatgattactaacaaacatgtaattggaatttataaagttgatgtttaggaggcaagggatgaggctcagaggtagaccagttgtctagcataatcaaggacctgggtttactctccaacaccactaaataaccaccatggttgttaaatcaggatcagataaataatcacaacagtcccataacccctaaagaaatagaagcagtcattaatagtctccctaccaaaaacaaaacaagaacaacaacaacaaaaaaatgcccaggaccagatgggtttagtgcagagttctatcagaccttcaaagaagacctaataccaatactcttcaaattattccacaaaatagaaacagaagggacactacccaatttgttgtatgaagccacaattactctgattaaaccacacaaagatccaacaaagaaagagaacttcagaccaatttcccttatgaatattgatgcaaaaatactcaataaaattctctctaaccaaatccaagaacacatcaaaacaatcatccaccatgatcaagtaggcttcatccaagggatgcagggatggttcaatatacagaaatccatcagtgtaatccactatataaacaaactcaaagaaaaaaaccacatgatcatttcactagatcctgagaaagcatacaacaaaatccaacaccccttcatgataaatgtctttgaaagatcagggattctttttcaaaggtactcatgaattgttcttcaggcttatttggctgtcccgcatctttttattctttgaatagaattaaatggaatgtttgtaaaatacaccaaaaaaaggcatctgtcttttctcagcttctatatgttgtttattctcttatatcttcatattagcaccattggaggtacaggagataacttttcctttgtggaagggagtagagctcacatggtttgtcttttattcttgaacagcacaggctactcattatactcatggtggagttatgtagaatatttgagcctatcctacactagagtcatcctaatattctattagaaatgttcctcattgataagattctttctataaagatgctgaatgcactgtccttttttgtttgtttgttttggtttttgtttgtttgctttttgtttttcgagacagggtttctctgaatgcatggtccttttacttatgcctccaacctacataaggtacctgctaaaagaagtagttgatattttatagaccagattttacatgtagagcaagtgattggaataaaacatactaaagacagataatagtgatttggttacatactaaaacccaaagttttaaacatgggagaaataactgctaaaaattgatccaataaaggcatgagttctagcataacgttttgttttactcctagaggtagttttagaaacagactttaaggagttgatttttatccttagtaataaatagcatgctatgaggaagcccttcctgtcctgaagccctagcgctcatttgtgtattccagtgggtctccttcccaatgggctgtgagagcaacagcccattgacagctgctactggttcttgaatatgcagtcagtaaaaagaggagaggtgtatatgtgcaaacgaatcatctttagaaacataaaaaaacctacacagaagagtgagtcaagtttatggctgtattctaaatacctctcctattaagggacaataaaatgttttgggtactactagtttcataatggatagtggcagtgtaataaaattctttaaatatcaaacatgcttatgagatgttacagtgctttatagaggaaacaaaacagcttgaagaagtttttagaattgataattatatatttgggatgactaagaagctattgaataaggagatttaaagcggagtttacaatgggtttgtggatagctatttcttaaaattttttggttgtgagtccagccttcaatggctgagctgtctccctagctttgggtagatgattcttaaagtgccagtgataaccttggctaggagtggaccattctaggttaagtaagaagtgtatctctgtccttttgccaaagcaagattatatagttcagtaccttggttaaatctatatagtaaagttctggcataaatataggtgatttgggaactaaataattcagttaagtaccatttgatgaaagttacttaaatgattaatgactgcctaagtgataatttatatagcttcttgtagacggaatatggatggttaactgggttatggcacgtgtgtgtctacacatacctgtctgtttagacaagatcttgcaatgtagctgttttagtgttctgtttctgtgaaaagagatcatgaccaatgctgcttatagaaaaaagtcatttagttggcaccttgcttacagtttcagtgggttaatctgttatcatcacggtggagagcatggtggcactcaggcagacatggtgctgcagaaggagctaagagctacatcctgatccccaggctgcaggcagagagacactggcctggactctcaaaacctcaaagttcactcccagcaacatttgtccttcaacaatgccacacctcctaatccttccaaacagtacctcagctagggactaagaatggaaatcaaattatttaaatgtgactgttcatttcagagtttataagttgtaattctttagagaattctgtagatttttttgggtcaagaacttactcccttttttttcttttatctttttttctttttatccttcttcccttttcttcactacaggacttaactgaggctttgtattcgtggtgcactgcttggtcacactgccatgatatccttctttcatgacttcccattttaaagtgaactgtaaagttgatttcggtctctcttccactcgatccctgagtctgtgagagggagtgaaggcgagaagaaaatgggaagtggaaaggtggagatgggaaggcttcctgggtttgctctcatctggtttccttgtggtcagcagggcttagtcacacaatgttctagttttctcaccttcaaagaccctagacatactgtacttcctgtctccttgatatcaggagtgcttgtgcgtcttacacatgtctgtcttacacatcccttctgtacacacatcttagcagatgccgaggttctcaggtaagcttctaaagccactgagcagcatgctgctgccttaggtgacattccaagtttaggggttccatcagtctttgacctcataaagactattcagaaaaaagcacctactatgttgaggagggtattccctgtgaggacgacgtgagcctgtaatgtcaccgagagtgaggacacctgttcatctagtctgccctgacatacaggttctctatgtccaagggtaaggagtcctgttttggaagctggagagatggctcagtggttaagagcactgactgctcttctagacatcctgagttcaattcctcgcaaccacatggtggctcgcaaccatctgtaatgggatctcataccctcttctggtgtgcctgaagacagcgacagagtagtcatataaataaataaatcttaaaaaaaaaaaaaaggaattctgttttgtttcatgtcattttgttttcaatctgaggcagcccatgttatagtggacagaaggcacaagctactggaactttgcttttaagtttactttttataattttaattttttattgaaaacagagtttctcatacaatatatttccctccccaactcctctcagatccttcccatctccccacccacccaaatccataccttttctttgtctcattagaaaatgaacaaccgaatatacaaacagaaaagaaaaccctaaacaactgaatacacaaacaggaaaaaaaaaaaactagactagactagaagaaagcaaatgcaaccctcccccccccaaaatgcacaagaaaccgtggagacctagagatacacagacttgcacatacagaagtcagaaaccataatacaaaaacaaaagatctgtaaagtttaaaaaaaaaaaaaaaaagaagaagaagctcagacaaagcacaaatgccactgagttagatttgtgttggccccttatcactgcacataggacctgccctcaaaagtggtttgtatacccagtgagactcccttggagaaaaccaagtttcattcatgagcgattatcaacgagatagtttcagggttagagacggggcttgtgtctacttcctctctcagccatgggaccccttctagcttaggcctgcgcatgctgccacagtctccgtgagtttgtgtcagcacttgagtctggaaggctttgttgtcttggcgtcttccatccccactggctcttacagtctttccttctcttcacaaagttccccaagccctgaggaggggatttgatgaagacatctcatttaggacttagtagtccaagctctctgattctctgcacctcttccagttagttgtgggtatttgtttccacttcctgcaggaggaagcttctctaatgatgatgactgagaaacagagtgatctgtgagtataacaggatgtccttaggatcattttatggctgtgctcctttagtggaaaagtagtatttggttttcctctaggtctatggtgtatccagtctcaggttcttgaccatccgataaggagtcttaatcaagggaaaattggccttgtagggcattttccctgttggtgattgctgtggaagtgcccagcagcaagtggtcctgggttctataagaaagcaggctgtgcaagcctcgaggagcaagtcagtaagcacacccttccatggcctctgcatcagttcctgactccagctttacgccttgagctctggccctgaaaacctagatgatgtactacaagctataataagtaaatgcttttgttcccaagttgatttggtcatagtgtcttatcacagcaatagaaacactacctaaggcagacagttactgatggccgagcacagatgtataccagactgcccctgtagatgaatactgcagggagcctgtggcattgcctcacagtttcccttccttagcaagagcaagtgcctttcactctggtgctctcagtctctttatcaccctccttgcctctgagattgtactgcagttacattgtgcagcttatgcatttggtgtataggctctgctttgggggtggggggactaggaaccatttaatttggtaagacacttgccttcgttgatgatataaaaggtaaagttttttctcagatagaagggcatttccaccccattaagctaagtttagcaatcttgagtgagacttctgttgtctaatacacctgtgctttttatgtgcactttattttaagctaattattgtttaaatgtgtatgcaaaaatccgagtgcatcgagaacacaaaaaaattaacctttgtgcattgtatagaagacaattatttttctagattaaaaggtctctgaatcacaaagtctttgtggagaggccatatttgcctgtcatttttacaatgcatacttataaagggcatattgtgtataatacgcatcagtgttgagcacccagggactcatggaactctttattctttgacaaccaaggtgccagtgtgggctgtattctaatgtcaggttatctgactatatcgaatctcacaacataaccagcaaagtgaagagggatcttccttttgaaaaaaaacaacaaacctcggagttggcataaccctttgtctgccacactataaatagagagcatgagaagcctggaggccaagttcgataggatgcaaagttgacgcagatcttctcttgctgtctgttctgcaatctgtgacagttgtctggctacaccagtgcacatactctgtctgcagggaaggaatatgcttaaattcctagaccattctcaacaaccaggagactttccaaacacatatgtgcagaataacagtgaaatttaaatatatcttaagactgtctctctctactctttagttgccaaagagtaaaggatacggtttgagcatgagcttcagatggtctcgaagatacagggcaattgtatttctggtagagtaggaggcatcacaggttacatggagactgtcttgacaggccatccagaccgtctggcattcatttgttttacacaaatatttaccaaatcccttaatctctgtgctttttggtgaatacgatagaaacccccttttcacttattctttgtgtccccacttcttgaacaaataacccagaacagcttaccagtaatctactcagaatgtgtctgagagtctgaaacaccggtatgctactggaagctattagaaacagtgtcccattctcaaggaccatggaagattgttcattagtaagtctttcccacatacatcgagccaggcagtgtgccctctccttgctagggaacaagaatacccagccattccctatagggtcgtgagacaaacacattataccatgtttgaaagaacatagtatgttaagttatgacagtgagtcctcccacatctctggaggagcacaaaaggtcctttctgaaatgaatgcatctaaattagctctgtgtgggtgaaaggttaagatctgcccgtcgccccaatttgtgggtgtgttggcgggagtttgttgtggtagagattaaactcagggctccatgggtaccatgaagccctgtaccattgtcccatatccacaacccatgactcttgatctgacttttaacttgtggctggggagaaggggtggcttggagaaaataaggtgagttctaatgaaagggaactgcaggatggctctggagacggtcaggcccaccacagcaacctttcagagttgcacgtgtcatttaggtataggaggtcagttctagtcagtgagacaactgaagcagtgccaagaatcagtcacaataccgacaagtactccagtgaaactgatggtctaacacaaacacacattgcctgataaagatactcacattagaagggtgttaagtaattaatgacagggacacagttgataagctgtttgcaaaataacagatttttttccacctaaattccaagttgttttggttaggggatagtggccagcggtttggaaaccagaagttgataagatgctttctgtgaactgaaatttaatataacactataatgagtcaggggacatagatcacaagtcattggagagcagaataagttagatgcttcgtttcctgttgagcatgctggtcatgtcagcttgtcaccttcacagtccccatgctcacagacaccctccatttggattaattttctcctttgtcatcctctgtgaagtctgagaattttgataaaaggcccctgctttcctttttgtattgtataattgataaagtggcccctctccccatttggttgtcactcatggagacagaaaattgcagagcctcgcctagaagaggttttcatcccctgtggaaagttgtggcctatccaattaaagtgtgtgagctatattagctaatgatatatcctgtgtgtgtgtgtgtgtgtgtgtgtgtgtgtgtgtgtgtgtgtgtgtcacaggcactatccatccagatattatttgacagattctcgacttcctgtttccttatcaccaggcaacgtcttagttatggtctggctgcctctgtggctttccggcagggagagaactgactggtcatgctgacttaacacttcatccaggaagttacttactaaattggcattctggctttgtgtatcattggaggtttttacatatgagcctgctctccagaagccctgtttctgctgggttctgagacacgcgctaaagtccaggcattgtgctggtacatttgccaaagtccttaggtcatttactaggatgtgtgaccctgacctatttatgccctggtcttttcatctgtgaaatggctgcattaataactattgtagggttatgggattgagtaagacaatacaggtcagggatggttttgttttttgtttttgttctgatttttggttgagtgtggttgggttactgtatatttaggcctttaaacagcatccctgacccaagtttactatatgtctgtgaccttccccaccccactacacttggatgatcaaattgtttccaggtactaacagatatcttctgtgaagggcaaaatgtggctgcacagagcggtgcctgcaggaagtaatggtgggttttataataatgatgataaaggcacagaggaggatagacgccattcatgatgctgtcctgagaccctcaggaccatttgtgagcctgttactatgatcatcaatcattgttgtcattattagtttcctgctttcagttcctgtatcttagccaagataaaccatatatataaacttgagtaaaataaaaacatctgctcttaaaaaatgaaagagcagtattaaatccttaggtatgcaaatgagaaaatggtgtccacgcttgtgagtgagtagtcctgtgatgttgaatggtggggttaagtcacattggggtgctttctgcctcaacacacatcactctattaagcatagacaaacaacaatttaaattattttgagtagtctaaccataaaataatgtttaaaaagttgactttgtctagatatggtggtgtatgcctttgatcctagcacttgggaggcagaggcaggtggatctcttatgtttgaggtcagcctgatctacataatgggttcttggatgtcaaagctacagagagagacatggtccaaaagacagacagacagacagacagacagacagatagatagatttcctcctaaaaggaaaaatgtattccccgtagatgactataaaggagatacacatagccaaagtatttgtaagttattcctttttaatagttttgaaacatttaaatcctttcttttaaattggcgcccagctctttcatgtagccagcaagcctttttatattctttgtagaacaatggatgggtacagcctcttgtagaaaaatatacagtaaatatgccttaagatttgtcatgccaaaaggctaccagaaataacttttgaagtaatgtaaaatgtctacatatatttatggttaagaaattttattgcaaaaatattgtaataaaaaaaaaagctagttaaatgcccagtattaggaatggagttaattatagtgaggtagcatactgtggtcctcaagaacaatgttcagtgtttctggtgacgcaaacattctcggtgttgaaggaaaaggaagcagatttttcaggctgcatgtgcagtataaattcaactccaaccaaggccaggaggaaatattctcagtattagcactttggtactgagaaagtgggttatgaataattcatgagagtttctcagagccttatgattaaatagatcatttcatagcaaacttagatgtttttattgttcatgttccctaaggtaattttaggttacaaatattttttgccttggaaataaatattaaaagggttaagttttgaacaggaataagcaaaaaccaatggctagtattttcaagtatggctttatattatgaacatttcatataaattacgatacataaacagttttagggggtagactcctagccttgtaattagtggctttttaaaaccatcatggtattctttatgatcattaattttaaatgtctctttttggttgagattttatatatagttataccatttccccgttctgttttctccctccaaacagtcccacgttctcctctttgctcactttcaaattcatggcctcccttttcattgttatcaacataaatgtgtgcacataatacgcattcccaaatacacacacacacacacacacacacacacacacacacacacacacacagacacacacacacagacacacacacacacacacacacacacacacacacacacacatatacaacttgctcagtccgttcctggataatgttactagtgagtatatgttttcgggtctcaccactggtagtggctaaacaggtgtgctcttccctggggaagactatttctcccgttctcagcattccttagttgcctgtagttatttgtggagttgaggcctcccactcttccccctatgtacattagcatgtctgtgggtgtcacccttttcaactcatgcttaggcagtcatgttggaaagactgtgggtgtaacacctgacatggctacacccatctaaccttgtaacacagtctcacagcaaactccctgatcctctggctttcacagtcttttcgcccctccttccacaatgttccctgagcctgtggtgtgcgagtgttttgtagatgtatccagcagaactaggctcctcaattctgcattttgattgtttatggtgttttgtaatggtctctgttgcaaagggatgactacttgtagaggagtgaggactacccttctctgtaggtataaggacacatacttagatgtagttagggattgtgctggcttagtaaaagggtggttgtagattctccttccatatcgatgtcttcagcagcccattggctaggtttcagtaccaggcatgatttccctcttggtgacaggtctgaagcccagttagagagctgtgagttactgccaagttgtagatgcgactactgcatcctcaggaggtggtcgtcacggttcatagggaccatattttggtgggactgttggttgcttccctcctttggaagcctgcatggcaccttctggtaccatggaagctagttctcggggaggaggctctcaagtcaggcccagcccaggggcctctgggttgtgtgcctgaagctcacggatggttacttttaaaggtatgtattgcatgtgtttgatgggcagatgtttacaatgttccccttttatatttgcagtctgtgcagaagcttataatcctgatgaagaggaagacgatgcagagtccagggtatgtgttaacacggatgctctcacgttacataaggaagtaattaatgatagaagtattaacaaacacaggctttcagcagagaaaaatcaaaggacttacctcttttcctcatcgtattttaatagtctgcttctacttcagattctgtagacttctttttaaaaccccagagtcgcttttggatggaatgaaacaggaacataagtgctccctgaaggtgcggcttcagtcctttcaccgcaggcgtcctgaggagggaaaatgttttgagctaatttccttatagccatagttatttgtaacaaatgctccgtgtatagaaagatcccagtgaagaccttctgctcctgtcagttgctaacagaaggttcctctgagagagacaggcctcgaagcatcacaaggaggctgccagcacggcgcttaccacacttagtgcagactggatcttggaggccctgatgactatgtaaggatttgccttgcgtagttggatgcagctcttaagttgtagccttaactcacttctcccattagtgatctagtaaaaaggaaactcagtaaaagattattgtgctcaaacatgaagacaagtaacaaccaacctatctccccctcctccctccttccctccctccctccctcctttctccctcattttccccctccttacctctctccttcctcctcttctttttctttttttaaaaattatttattttatgtatagtagtacactgtagctatattcagacacaccagaagagggcatctgatctctttacagatggttgtgagccaccatgtggttgatgggaattgaactcaggacctctggaagaacagtcagtgatcgtaaccactgagccatctctccagccccctccttttctttatgcatactttgggaaagtcttctttgtaccttctgccttgaaaggtatttttaaaagcctgtatttatagctctgaagaatgcagaaaggaagacagtgggcccccactttaagacgattaggctgctgaagtggacgcacactctgggcagcaatctgactcttcttgctaatttgaagcatgctgtcactacactgtgtgatctaaaaaccaccttgcctatcacacgcctcatccacgtctctacaggagacagtactgggtgacagctgagggctacacacattccttatgtttgtggttaactacatatatggtaaaattgtgtaatcaggataatttgaggtattttaaactagttttaaaagtctaaagctaaggcacatagtttgaaagcaacatttggtatctcactgcctcaaaaactgagaccttgagaggagtctgagttaagtaaaatggtttagctagttcattccattgtagtgaatattcacttagcagccaatcaaatggagttaaacatggaaactgtcagtgagggcttgtaggatacatgtttggacgcattaccaattccagaaagagtttagagtccacaccatagacagggccacctgactttagggcagcagttcccaacctataggtcatgtctcctttgggaattgcatattagatatttacattatgattcatatgtaacaaaattacagttatgaagtagcaatgaaaataactttacggttgaggtcaccacaacatgagaagctgtgttaaaggggcgcagcattaggaaggttgagaaccactgcactagggttcttcagcagcaaaggtgtagactctgagtggtattaaggacattcacccacactctcaccttattgttgtctttctgttcaaaatcctgttttcctgggagcttctgagaagcccatattgaccgtcaggggcaaggccagaaaatcaagactcagagaccacttgtataagtaaggacaggcattttataagaaagatgggcctggtggctagttccatggcaatttgacacaagccagagtcagttttggaagtgagacaatgcccttactatattggtctgtgggcaagcctgtggtacatattcttgattgatgtttgatgtgagatggtacagaccattgtagaggtggtgccatctctgggctggtggtcctggattctataagaaagcagcccaagcaagccatggcagcaggctggtaagcagcactccgccatggcctctgcatcagcccctggatccaggttcctgccctttttgagtttcttccctcaattctctggacgatggactgcaagatatacgatgaacccaatcttttcctcccaagttgcttctggtcggtgtcttcctgcagccatggaaaccctaagacactggagtctgcatagggtggggactcgctttaagccttgcccttcctaatacttcaagtgtctgtgcaatgcattaattacatactagtgattctgataaagtactttaaggttttgattaggttgaaaattacttcttctagctaacatactcaagattacatcttgcctttggccttaaaactataaggtaaactgaaccatagttcctagcaatgactattacagatgttagctttagatagatgggcaatgagatatctgtgaggaaaccatactttggtagagtaacatttcatattattatctggaatttttataatcaagaaatctgtaaactaataaaaatgggtatttatcttcatatgaatttaaagaaagtctaaatacttaagactcgttttggaaaaaaaactaatttgggttttagttggaattccaataataaaagagaagttaagggtagtatacatctagcatgtgacattggaggaaagagtagtaaattttctcattctagcctccaaaaatctctctgatgcgccctctgcatagccggccaggtgttaggtgtgctcagtgaagccctgacctctttattagaggggagtggcagatgctaacaagcaaattaatgagtaactacaaataggaggtgctcatagcacagccagacattgtatagattgaaagtctgaagtgactggagtctccttgaggtaagacatgaggcaggaagagagtcgtgtctgggctcactcttgcatctgggcctgggcagccaccagaaacagggtatgaagttgtgtggtggaggcagcggtggccagctcaggactcacacgaggtcagaaacagaaggatggaagtccacctcagcccatgtgtggggtccactgaggtttgcagctggagattagagtgcttttattggatgtttgagaggtctcctttatgtcttactggagagtgaagtggcccgtgcgcagggttccctctgtaacggaatatggagagcacggcgaaggaagccatattcgctgcctttctggtgattttccttgaaaggcgaagaggttcagagcaggagttggcaaatggctttagtgaggaatttttttttttttgactgaaaattcactactcctcaacatgaatatttaatatttgggagtcagaaactgtcttcaaactactcagccctgctgctgtggctcagatcagcacaggcaatgtgcaaatgaaagcatgtctgttgaactggaatttcttctaatttccatgtgttagaaagtgtgtgtgtgtgtgtgtgtgtgtgtgtgtgtatgagagagcaagacagagacagagatagacacagagacaagggcagagagacaaacagagacagagacacacagagattgattacaaaggtagagccactcagcttggagactcttcagtacagatgtgcttgtgggtgtggcttactgtagtaaggtctgagtgttcactgataactggcctgtccagcatgaatctgagctctttctgcagtttacagactgtgagataaaatcaactgggtgagtttattttctcacctctgttaccaggttgaaatgaatttatgtggggcccttaaaatattgcctagcatatatcaaatgctacataaatgcttgcttagcaggatttgtatcctgaaatgagaaatgttagtaaaaaaaacaaaagagcctgtgggctggtaaaaacaaacactgtgatgtacgttttgaaggtctctgtgtagcacaggccggaagcattgtgctcacctgtcaccttagggtctaggttcagatcagtgtgggtcagatagtaaacaaaggtttcatggacctcttccctgtgtagtgacaaacagtagcacaagaaaaaggggcctggcagacataatggaagggagtaaggcttgtttgggatccagtttctgggcaggtttagtccatcaggtgggggaggggtggctgtgacagtgacttagtccttggtggcaagaatgtcacaaggcagcatccaggaagaggatgctgttttggaaagacaggcagctatagaagggcctacccatagccttgtgcgtctctgagctggccctcacctgccaaggcccccacagtcgtcagagcagcagcaccaacatagggctcagtgtggggccactcagaatcccaagccacagcacttggttggtcggtcaaacacctgtagggatttattcactaattagtagtctttcttgtcacctgtaagtcccaggcacaggagtggtgcccatcagaatcctttccttgtactgtaatgccagcttttttaggcttagggtccattgcgtttttgtttttgttgttgttgttgttttaagctatgtcttcttctaagttgaatgtgcctgtgagtgttggtgtctgtgtgggcacaggctcagtgctgtctgattctgactgctctgatgggaacggtgaggcattcgctcatgagatcctacagttattctttgagtcaacattggaataggagaagtagtgtgttgggtctccaggaatccactccatccctgcttctaggagtgtcttttacctcattttatagtctcaaactacaatgttcacagtaaataaaaagccttttgaagttagggatatagctcagtggtggagaatttgcctaacatgggcaagcctttggattcagtctcaagcattcctatgctgtgaaaaaagaacccaacttgttggtccgttgagtctcacagaagaccctctggctgcttcactgtcccggatgaaggattcagtgagagtttagaacactggcctctcctgactttaccctaaaatgatggtgtcagtatttcttggagtcatttcccttgaatgcatttcccttgagggcaatccgtggttgctgggtcccttctctgaactccttatctgctatcaggaaagttacctgctgcaattttcctaaaattttctttaatcttgaatgaagtatacatttaagaatttgtttacttctgccaacattaccaggttttaatggaaagagctgtctctggcagagttttaagatcagtaacaacgaaatgaaggcagtgtctaactttccagtgtaactatgtaacactctgtcccgcatacatgccttatagactaggatgcatcttttcataatgtgcctgctgatctggggggaagatggtctttccacccagaagtggtggtgtcattgtcctgtgctcgtgggctaatccttgtttgccacccaaagcaaatgtcctaccaactgggagagtggactggagcgctaaccattcttctctccagcactcctttttgttggattttacctggtattgactgctgtgtttgctttctcgattttgctgtcttttcagataatacatcccaaaaccgatgatcagagaaacagattgcaagaggcttgcaaagacatcctgctgtttaagaacctggatccagtaagagaaatcataataatagaagtgggtcacgaactgggcaaggacctgagtcccccgctctccactcggggatcactcggtgatcacggtagaagccgagtggttacatgtgcttgctggcttgaatctgtggatgtgctgtgttaaggcaccaagggaagagaaagccatgcacctcaaacctagccctggggtgggacagggagggagaggccaggcccctgcctagccctggaatgggacagggaggggaggctaggcccctgcctagccctaggatggtgaaggaaggggaggctagacccttgcttagctctgggatgggacaggtagggagaggctaggcccctgcattctctgtgtagcatcaggctcttagaagggtcctctctgctgctcccagcagccgataataagaatccttgaatgtaattaagctctgtgttgttcatattttaaatggagtgtttcacttggcttaaggcaaggaaatgtttgattctttgaaagaattctgacatctctagtctccacagagggtgtttctagcataccacttggtttgtgtgtgagtgttcagacttcgcctcacactcttcagtgttctgctttgtcatcacagatagtgctttctgctgtctagtgacttttccattccaaatgtgaaggaccaactttgctagcttacttcaaccctaaggtttgcatgctcctcatttcctagtttgcagatggatgtctgagagcatcaagtcctactgttcttaagatgagggtccaccctcctctggacttttttatttaatttatcttttgaaaaattaaggaactacatcataccattttatataaggtcatgtttgtaccctgcaatgtttataagagcttcattggcttcttgtacaaccttttgtcgtgttctacaagaacatggtttatatttggactttggggcaaacagtaaaaaatgacatgccatccctgagttcagattaccatcttcgacatttctgattgaccaagcaaaaatctatatgttgcttcatttattcatttcttgagggtagagtacacattttttttctgcttcatttctctctttaagtagcatatgtccccagtgccttctctgtgtatcagtgtctcaaaaagaaaggatggcctgaaaccacaacagtctgagttcccgtttcttctttatctaggtatgcatacttagtaatattttggatagatgaggtaattttaataaagtgatggtatttaaaaatggcccagggctggggatagatggccccatgaataaaatgcccactatgcaagcaggaggaccagagttcagatccctagtacccatgaaaacaccagatgtggcagcatgtgcctgcaaccccatcgctggagggaaggggctgtctggggagaagaagacaggtaggtcccagagatttgctaataagcctatctagccagatgattcactcaaaatataaggtagaatgtggtagaggaagactcctgaggttaacctctgacatccagacagacagacagacacacacacacacacatgagatagacacacacagagagacagacagatagacaggttatcaaaatcaagtcttattaaaacttactgtgatctttgattgcttcagtagaggcgccattttcttcccagatgtttttgccaccccatgcttatgcagagaacctgaatttaactcagtcactgaagaaaaggaagtaggaggaggtcttgttgggatgttgttcagagggaggaagagagggtgatggggatgaagtggcccaaactcctcatatacatgcataaggctgtgaaaaaataaaaaggattcgacccacttgaaagatagtagggacagacaagtgtagctaaaaacagttacagtgcagcttgactgcagttctgctcttctggttggcgtcatccgttcaggctgagtctttctactccgtccactaactgcatgtctgctccgtgcatcactgagccagttatatttaggggtgggctcgttaaggatcctttactattttcctaggattttacatgggagaatctcaatgcctcccaagttttaaatacaactgtgaatcatcagggctgttagtaaatttggagatcctgatccagcaagtctgagtggagcccaagagcctgcacctcacaggtgtccaggtgatactgaggttaaggccacatactttaagtaccaagatgaggttccgtgtgaccatgaatacagtcagccatgtcctgtctcccatgcccgcgtctctaatgactgaaagagaaacggttgctagttaaacactgaaagggttttgctgcaagggtatcctggcaatgaggcaggggcaaggaataccgtaaaaaacggcactaggcaacgtacctcatgcagatttattggggccaagggagcacagaatggctatctctgagtggagatgaagacagagacaggccaggctgtgatggccggctttatggggctaaggcaccaggttgagggaggagccaggttgttagtgattactgttagcgggctgttggtactgagtcctggaaggtggtgtgggggatctccaaggaacctagtttggaaagccggcgaggacttttggccgttcttcatatacccaacataagcattcctgggatgttgtctactctaacctttattagatttaaattggcaaattgttttgcatatcatctgtctgtgtgtatcggtgtctgtctgtgtgcatatgggcaagtgtgggtgtaagtgtgtacacgggcgtgtgaggacacaccagaagagaacctcagaggtctgtgatcaggagccattcaccatggtttgggcgacagtcttacttttctgttttccttctttctacccactgagtcgttagtactgtctgtatgttcatgggccccggggtcatccactggcacgtgggggagccttccggtggccgaagcctccaaaggaagtggctattcctcccagtagctgtcaatcccagcagcttgtgggctaagggctgcgcctgcgcagaaagccacagctgctgtgagttcatgcgagccactgccccgttctgtgcagaggataacgttcctcctcccccatcctcggctcttatgttttgttttgttttttttaacatagtgggtacagctgaagtgtttggagcaggggatttatcagtcttatttgttccctttggcagttaaaggggaagtgaggagaagaatgtaggtatgtaggctaaaacaaaagagtgagcccatgaaggaaaaaccataccatgatctcggggagaaatgggcctgaactaaggtgtgtggggaatggctacaacatgtgcagggttctcagaccttggaactcaacagttggccttcctggggtctgcaggaacatctaggatgattgccagtgcccagctgcagtgactgtgatggcaggagggttccagaacgaggacagctccacagatgaaggggaaacagtaattgccaatttgcaaagagtaatgctggctttgtagttactgtctcatctgaatttatttcctggtgtcattgtttagtttgaaaaattcacacttctcagacctcagcacatttcctccgtggagtactgtatatttatatattgaagcacagatttttctaattattaatgtctttgaagatactcttcatgaatattttaatgctcaactcagtgggccgttttcctcctgaaatatttctaatttgaggctaactggaacagttttcttgtgctatacggtaggctcttccatcagttcagtgaattgttgctgcctcggtgactcagagcctttattgagctcggtcttgaatctgcattccctgagagaacttgacgtgggtttccaacagtggctgtcagcagcactgtaagcctctgtgtattaaagatttcctaagttctcagcactctgtgggtaattacagggggaaagtagattttgattgactagagcggacacctgtcacatagaaaagatttaagaagcaaaattctctgttttattaggaatttttaatatactagtatgagtgctttagctttataattaaaagtcattttcatgtctgcttaaaatggggctaattctaacataaccaaaaaatgttactgtagcaatttcacttttctccatctgacatttagagtcagaactaatcaataaagctgatattttcccactacccgccctcaaagaaacaaatcataggtagtaagtaagatgcagtcttagcaagccatttacttaaccttcagaatgttgataggtgaccatatgtcgcctcaggttgatgaactcatttgggtaaaagctccccgtggggctaattagcaccatgctaggaatctctgctttattccgtcctggctccatcctcagccctggctgctgcccatgaagaggagccagatctcgtgcacagccagggaggaataaaaaccctacaaccagtcgccggcatttcctcctgcttctttcttagtccatgggaagactcaaaatgttgttctctgtagagagtattttttttaaattaagaaattttaatcactacacataaatttatcaaaagttaacaaagaggatcttccctacaaccgactcccagcacctccgttcctcagtagacaaggtcttctatattaccatgtttctttcccagggctgtgcagtggatatgcaaatacattcttttttttaaagatttatttattttatatgagtacactatcgctgtcttcagacacaccagaagagggcatcagatcccattacagatggttgtgagccacaatgtggttgctgggaattaaactcaggacctctggaagagcagtcagtgctcttagccactgagccatctctccggtcccaaaatatattcttttaacattttagtggcagcaatatttaggcagtgctttgctctgttctcttcttatttaatgaactagataccatagagatatatgtacatagagcctctatttattattagttctttgcaagtttcatgtttcctacccaacatggtttaatcacattcactcttcaacccttcccagatccaccctccattccctaagccacccaactgtgtgtcagaacaaataaacctttcaagaccagtttgcaccgccccaaatatccttcgctgtgtggccttctcctggagtgtgttcctctgaccaggctgacctcttaggaaaactgattctttcttttccagcatctaacagctgtcaatcactgcatatctaggggtgggattgtgtgcccaacttccatgtctatgctgggattggatccagccctggacttgcacaggctttgcgagtgctaccacagctgctgtaagttcatctctggggctgccctgctgtgtccagaagtatctaaaagtcaggagtcactcactgcctctggcttttatacaattcctgctttttcttctgcagtggtatcagaaccttgtggagatgatgcagtatacactgtccctttaaagctgagcactggggactctcctattctctggctagttaaggtccatgtttgtcaccatctactgcacacaggagcttctcaggagagttggcaggcacattgatggatggatatcctgaacatttagaagcataatagtacaggctcctccctagggcttatgacttatgtacccataagctcaccttgcggagtgagctttagatccaatcagaaagtggttggttccttctatgggcatgtcttgctaggtgaactattgccatagcttagggagtacagatgagtactgttcactcctagtgcctgctcagcccctgccagcactgtgaaagctagctcctagggatgaagtttctaggtccataccatcctgatcttgtcatgttttatggctcaactatgtcatgtcttcagcaatacattcttagtgtcatgctctagagggtaaccaagaacagtggtaatagtttataatgtttgagggtctatgggatctcgttgcctaacagctccaaagaagaaatcattcctggagtcagtttttgttgtctaggaggaatattgttgccctgttacagggtaactccatatctgcatcttaactctctctgtgtgtgtgtgtgtgtgtgtgtgtgtgtgtgtgtatgtgtgtgtgtgtatgcacatgcacatgtgcacccacaaatacttaccattcaaaccaccccataagatgaagtattcctgcccttggatttaacagtggatttttagataccaaagcaaaaatgagaagagagaaatacattgaactttgtatcaacagaacattttaataagtcacaggacattactcccacttaaaaaaaagtaaaaagacaagctatagaatggaagaaaatatttggtggtcatatacttcaaaaaggtctagtgttcaaaatatttaaataatgtaagatatgaaaaaaaatctgattttaaaatgagcaaagtacttgaatagctttttccagagaagacaaatgcaagcaagcagatagattcctggcatggttagacattaagaaaatgcaaatcaagaccaaatgaaataccatttcatctccactaggatgtctataattaagtaaaaaaccaaaacaaactaagagtatcaacaacaaatgttgaggacatgagacattatgactcttgtgcattgctagtgcaaagtaagtggttctgctgtccagagttaagtgtggagatcttgtataggtcagaagttcctctcctaaacgttcagaaggggtgagatcaaacactgcttgagataagtactggtatacaagtattcatattagcactgtccacagaaactggaaggaagtagaaactatctaaatgtccatcagcagagtgtggaatctggggatcgaactcaggtcatcaggcccgtgtgacgtctggctgtcccagtaaactgattctaaaattgacatctaaaataggtaaatctggaaaggtctacacagtgttgaaagccagtctgtgaattgataatgacttcaacacttagtataaggtatgataccaatactggcaagaaatgcgtatgttaagtagcatagctgaatacagcccaagaatagctccatgtgagtcaacaggaggaaggagcaaaggcaacaagtggttctgggacaagtggatgctgcaccccaaagaatccagacaggttctatacccctcacaaaatgaaccccaaatggatcagagacctcaatgtaaaatgttcaaacctcctaaaagtgatagatacctggatgatctagactcggaggactatttagataggacaccaagagtacagtacatgaaagaagcagtaagctggacttaactgaaattaaatgttcctagggccaagtgtcatgctccaggcctgtaatcccagtgctccagaagctaaggcaggagggctgtgaggtacaggacatgtgtggctacatggtgagaccctgcttcaaaaaaggaaaacaaaacaaaacaaaaaccctaaagtttcaggactataggagatactatcaacagaatgaagaaacaaaccataagcagagaaaaaatatttgcaaaagatacacctgggggctagagagatggctcagcagttaagagcactggctgctctcccagaggacctgagttcaatttcccagcacccacatggcagctcacaactgtttataactccagtcccaggggatccagcacccttatacagacatacatgcaggcaaaatggcagtgcacaagagattaaaaataaatttaaaaaagatacacctgataaagagcagctaaacaaacatcctaataattaaaaacaaaacccacaaacttaacaataacaacctgattgaaaattagatcaagactagtgagatagatcaataggtaaagtagcgtgtcacaccgatggaatgttatccaggctaggaaatgcattttattgattatgctgcagtggggaagaaccatgaagacatgctaagtggaataagctgtatacaagaaaacatattgtatcatgcttttatattgaaatattaaaaaaattaggtatctatgtagaataaacagattcatggtttctaaggagttagggaaaagtagcaagtgactgcttagtagacagaaggtttcctcttggggtaacggaaatatttgggacctcatagggagggttgatgctctgtgcctgacatcactggggagaagcacatgaaaatcaaagcagtgagataatgcacacccatcaaaatgatgtggtggcgaaggtgcggagcaacaggaactctggctcactgctgggggattcagagtggcttatctgctgctgtgggagtgatgtcttggtcccctaccacacttacttccccacactccaactcttctgctcctccttacccacaggagtcaaaaacctaaggttcacacaaaaaccaggatgcagtcattcatagcagctttacgtacaattgcccagtgttggaagcctcccggatgttcttccgtggatgagtggataaactatggtacattcagacagcggaatattatttagtgaaaggaaatgatttgtggagccatggaaaggcacaaaggaaacatgtattagtaagtcaaagaagccagattgaaaaggctagccctacctgaacctgtcagacatccctaatagtaggtggagtctgtaaaatgggctcagtggtaaccaggactcaagggacagaaaagatgaacagctggcttcagactcttgctggggcagagaaactgtagccatgtcctttcacttgtgacttgattgagtgaaaatcgtgtgtctgtaggttcaaggcaacaaatggagccctttggtggggactaaagatgctgagggaggcttgttcaagtatggggcaagcagcttatgggaaatctgtgcatccctctctacttgctatgaaactacaactcctctgaaaaatagtaaggtctcgatgcactagttcaaacatgctggtttccactaatgttatcacttagtagctgttgtaaaggactaggtctgatgtttttgggaaaagggataaaatcagagatcattatgtttagtgatatacgccagcctatgtacttctagtttccatgcctgggaagtgggttaggaaggagactcagaggagacatgtccttaacttaaaggaaaggggaaatgggtgaggagtaaaagggtgactgatgtgaaagcagaggggatgactgggagatagggaggaagcaacctgtcaagggacgagggacagggggacattagcagggaaggagaacagatacacagataatgacactgtagcagagtcctgcgataaaacccgttagtttgtactctgacttcagaaagctaatgtcaaaatgtagtggcttaaacgtactttgaggatggagttggaatcctgttttgcagactgaagtccctctgcactaagccctgaactcagcacagtttgaaaagtacttctgtgcatgaggagtctgcgtttcagcattgctgcagctgcagaacacattagcaggacagctccgcgatcgctcttacacttgggcgggcctttacgctgtgttaaaaccccatgtttcgtggtcctgtggtcctcatgccggccttggggcaggactagcgagacggaagatggccagtgcatccatatgtgcatcatgctccccctgcccactcctctcagcaggttttcattttcagttgcacctttctgagagtcctgccacagccatcgactcccttggaaggtggaggcaggggaatccccacgtgctgaatgtataggaacatgtgcagtgtatttatttacccagcaccgtagggaggcgtcagttttgttctgtgatgctgtgatgtgtgaatagtggcacagcatatgtcacctcatggtggcttcctggagaaggagtggtcagagtggaggctgcacatttgagagcttactaaatgttgccatgatttgttcattccatttgtacttttccatagcagccagtgagaatgtctcttcctcgtgccgtcctccacaagtgaacgttgctaagtgagaggagtggaatcctatttcaatcttactgtgcgtgtctctttatttttattttgagagactttgggcatcttctttccaaaattattctaaggcacaccctccacagaagtatttcggatctctatacatggggtctttgctggccacaggagagcctaaaatcttgtgtcttctagttctggaaaattcattccatatttcttcatttttagtttcctcttccctttcttggttgacttcgtggtttgggttttactctttcttattttatatatttaaaataatccaattggggggccatgtgtcatttgatgtttgtcatacctataagatgtgtaacaccaagaacaaaccgtaaaggtaaatgcagaccagggtccgagagtcactgagcgctgatcagtcgtaacaaacctcccccagtgctagggctgttggtaatggagtaggcgggggaagtgtggagccctacagttgtctcagtgcacctgtggacctaagagaacaatagcagtcatgttttaaggtttttgtcttttattgtaaggatccttttatatgcctttgtgtataatgtcatcctgagccgtctctgggtgataagcagcactgtctaaaaccctgctttgttcctgggacacctatggcatggggttgcgttgaggctgccaaccaaaagcagattgagagccctgaggaagcagggcagcctgtgagctagctgttagacctgggagcgtcttcccggcagtgaagggcttgctttcccggcactggggtttggtgcgcctattcccgcttgtttgatttctctctgatccttgtctgggaaattaagtcaagtctgggctgctgggtgttgtctgggttagagggacttgatgggaaggttggtatctgatccacctgcaccttgaagccattctcgggctttcgtctttgtctcttggctgcaccctggtggagcacaggattttagtgtggatgcttcccacgctgttctcattggcccctccagcactgttagatgcggctttaataatccgtcaagagctttcctagagacgtagatgttggttttttaagggaaatgcattgacagaaaagacagtggcagattttgctttttgttttgttgttttggttttgtttagcttccctccactgcacctcggtctgtattttgttctgttttgttttgggcactgacacaaactgtaaaattgaagttaggatgtaatttcaccaggtgtttagggaactgcctccctagttctagtgataaataggggaggttttaagaacagatagtttacaaaaatttgaaacagttctttatcatcctagttagtttagcttttaaaatttttttcctcaagatgtgtggtggtttggtagttcttttccatgtaaagtggtgatactttgaagtgttctaaagtaggccaattatcattactttcattcagatgttgaatatgagaataaataacctcacttatatgtggtgagggagactaaatggtatttttttgataaaactcaatggtaatgatgttctcatttctttgaaatctctcacaaaaatataaaaattatacggttacttgaggaactgtgttctagatacacataaagttattttgtctatttaaaataggagcagatgtcccaagttttagatgccatgtttgaaaaattggtcaaagaaggggaacacgtaattgaccaaggtgatgacggtgacaacttttacgtcattgacaggtaagtcatctggctttactactgaagtttaaaaacctactgtgtgggctggagagatgggtcaggggctaagagcactgactgctcttccagaggtcctgagttcaattcccagcaaccacatagtggctcacagccatctgtaatggggatctgatgccctcttctggtgtgtctgaagacagctacagtgtactcacgtatatgaaataaataaagaaataaatcttaaaaaaaaaaaaaaaacctgtgtaaaaccctagcagttgctatgacaaccaacaggttaatctgataattgtttctcttcaaccttactactgtatgatgtaaacatctcgtgaatatatacaacagagctgcgccaggtcatgcaaggagtcagtttataaaagaagtaaatctgtaagtcacagaaatgaatgtgccttgatttgctcgttcatattgggcaggtagaaagtaatattgccatatagtagatgctaattacagtgagaattggagcaagacatggtaccaaagaatctaagtgatggtatagcccactcagtatcgccacaatacaatgtccttattattaactaaaagaatcaggtattccagaaggcatagggtaaggaagggagccttttcccctgctgttttagtatctttaaccagtagagtgagcagttcccgtgtcctcacagaaattgggtagtattatagttgtcttttaaaatgttttagagtggtttttgttttgttttgtttgtttttattttttgaaataggttttactatgtagctctggctggcctggcacctgctgtgtagacaggttgaccttgaacacatagaaaatattttattaaacagaaaggatatgcacttactagtattgacaatctgatttcagagatcttcgactgttttacctaaccagagaacaatatggtggatagatgagcctccgaccctccatagcacatgggcagggtgttcttcaccttagagtcaggcggggtttctgtggcagttggtgtccctagctgctcagttttgtgaggaacacagattgtctccccacctgatctactagcagttctggtcctctgggtagaattgtggtcagctggtaattacacctcctcttggctccctttcctaatcatataggaactgtgcaactgtgcatcctcctcctcctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctggtttaaaagtaattatccgtggaacaaattctagggtgtttcctcagaagcaccattctatccacaaattaaagggcaaccattttctcccgtattaggtaatgtcttttgtttctgttcctgtagatttctttactagtcacagtcttttcccaatccttaaaagcctgtccctgccagctggtggtgcacgcctttaaccccagcacttgggaggcagagtcaggcagatctctgtgagtttaaggccaggctggtctacagagtgagttccagggcagagaaaccctatcatcaaaaccaagaccaaaaccaaaccaaaccaaacaaacaaaaaactgtccgcttttgcactaccacatctttgtccaggatttttaccaacagaataaagctgcctcccaggtaccccagccagccttgaaaccatgttctctactgagtacagaatgtgggaagacggccctgtgcagaaaaatagcttatatgagtgtagggcctggtgacctgagcacagggacgtgtaaatggagtctgttttctcaagggaaaaccaacacagaaacatctacagaaagaccaaggccggaagcttggtctgatctcctaccactttctagtttcagcttggagctgacctaaagtgaggggtcaaggaaggagtgttaaggcttcatgggccaatatggcctaaaaattcaattctgcttgtaacccaaaccagctatgtaataaataaagacaacatttgtgttctaataagactttattggcagctggcctgggggcagctcctgccatagtttataaaggactcatcagcagattgttagaactgtattcctttaaaaaaaatgccattttctcttggtcttagaaggcatgtacttaatacatgtatgttaagtacgcagtcaatgacctggcatacctcacagttcttactgtctgagacaagtccagctagtgtttggtgtatgttgcagagatgactttctgcgcacactctatccctgactctaactttgtttagttcccttttccctgtgggttgtccctgtcctggtgtagttgatggccgtttcaataggtctggaacagatgagcacacactgttatcatcagggataagcaggcagcatcaagattgcattgcacggggctcttctctgaagctctgctgcactgtaactaatgttgcctgagtcacactgtctctgacttccatatgaatttatatatgtccaacagaggaacatttgatatttatgtaaaatgtgatggcgttggaagatgcgtcggtaactatgataaccgtgggagttttggagaactggccttaatgtacaatacacccagagcagctacaatcactgctacctctcctggtgctctgtggggtttggtgagtaaaatatttgcttgacctaaatgttgttgtttttgaaaattatcatggcagtagataggcagatatccccagtctgtattttaattttgattggtggttttatttgggatcacaagtcattggcattcgttaagcatttgctaagatgctacactgttaggcacaaagtctgtgctgaaccaaagctttatgtcctgtctctccccaagtcaggagcctgaacacactggcctttgggaatgacatcggatccacagtgttcctttcttgtccatgcttaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcacacatacgcacataccctcaactaacaagtatgaatactgtacccacacacacatagacacacaccacacacacatccacagcctttttctcaactagatctctgaagtaagtagtgtagtctgtaaaccagtgattttcagagtgaccaactgaaagtcacaactgggaacttcttaagaaacatcccaggcatcccaagagctcctgcaccaagaactctggaaacggggcacagcaagcctatactggcaggagccttccatgtgattctgatgtgtgctgcactttgaaaaagcatgggaaaagagcgaaggaagcaagcaagcaaacaacaacaacaaacaaaccagttctcttggtagtggtattcaatgattggcattgtagagtaaaatacctgttcttttcatttccgatactggaaaaaaagtcttgccgggattctacacaaatctgaccattgtctttgggtgggacatggatgctaggatggactgagcattcctaatccagaaactcaaagcttgaaatgcccccaatccagaacttttttgagcaccaacatgattccacaactataaaattctatacctcccctactattacaggtcagtcaaaatgcaaggcgtattacacttcttatactttacctttagaccatgtatatgagatatatatgaactatgaagttcatgtttagacctgaaacatgctcccaagcttcttcgttaggatttctcaggatctgggcagttgggagtggggaggaggggggagagtgggcggtgggtaggtggggggtggtctcaggtatttcagacaggagattctcaggctgtatctttaaataaagtctgaatggtagaaattctgttaagtgttggttcacagacatttttggctgaggcgctagaggagctgtgtgggttctttcaccaggtagcagaacgcagagctgaagggctaacagctcactctggctttaaggtggggttctcagtctttgtttggtaagcttgcagacccccctgggaacccacttacctaaaccctgcagattgcacatgtgggatctcaggtgagcctggacttgtttggagtcagctcccaggaggtgtccacactgcctggcgtcacacgtcacctcaggccacccggacgattgtttgggacaccaaacagtacatcccgtgttcatgaaacgcaggtgttaggtttccccctcagctctttgtagaagaggttgtaactgtccggttccagagggttgctgagttacagagtgtaccattcatctcagcctttgactcataaaacatctccctcgaaagaaaaaaacaagatacttcaagcttcttttttattggagccaagtagtcattgtatgcctattaaatgagtcatttttataagttatgggattgaaaaaaatggagattctttcacgtagaaagaaccacacccccaagtatgttaaggatgccttaaaactgacagaggagccgcatcggagcagacatctctgtgcaggaaggactcagagtgtggggtgggaggggtgtggggccaatcttgtttccatcatgacttgcttgatacagaaggggtaccctaaaagtcccactggagttgccagtcagggtgtcaaagaataattaggcgtcttcacacatccttagttcaagatcacatattttcagattgccccccaagcctggatggtttcagccctgatgctaatggtaaccaaggtacaagggctcggagtttttgtgtgcacagttcttaaacttctaagaaaaatttcagagatttcttttggtgctttatccatgttattgacatttataaacagtgatagtttttgaggcatgcataagtgcaatatcttgaaaattataatgagcatactttcatcatatttgaaacttgctttttaagaataatttgtatacccagtcacttctaggggaagttgaggcagagtggaaatgttagaatcccacagcctgcagcctgcccagtggttgtaagtgctggtgtaaagagaagcagttggcagagaggaatcttcatcttagagcctcactctggaaatagcaccctgcagctcttagccctgagagattagctgaagtcgtggccacaccagtgactcagaaaggccattgtggaggtgactgggaataaagcttttgaaattgggcttcctggatttgttcagtcacagtggtttgtgaaatggcaggcagttaatagacaattcttcctgagatacacaattcatgatttatttctaaatggctaaactatttcaggccttctctgttttaacaacaacaaaggtctgtctttaaaatgtacctgcttcccaaatctgactgtatatgacaatcacatgggacacttttatagatataaattatttcatcagacatgtagcgattttgattaaccaacgtctttagttttaaaaattatctcagcaagttctgagacaggcttcaaaagaactcagtatttttgtgaattaactcataaaatttagaaatatgctttattatatttactttttattttgtgtactgggggacccagatgtagaggtcacttgtgccctgctgactgaaggcaggccattaggcttgacagctggcgccaaagcacagctggcatctaaaccaactctggaaacaagatgtttaacttcctagtgtctcattctgcctggctgttagcacaagccaccaaagatggcgcaggcatcgacatctcactgatctgggggttgagaactcttaagattcaggcacaagaactttggtgcctggaagagggccagctcttagatgtcctcattagtgggaggggcaaggcagttctcaagggtcttttatgagaattatctaattctatgacaactccacactcgtggcctaatcacctattaaggcctactccaaggaccatgctgagggttaggattgcaacacacggacttgaggatggacacattcagttcaccatggctagagttatatctgtcgtatattggcataacaaagtattgattaagtaatatccagttttaattttactaaagtggtatcattattcactggtgtatgccaaactatgtgattatgggatatttacataagaatgaaaacatcttatgagaatttctggaacatagctttatgagatgctttgtgtaaacatttttgtcattcctaaattaagttctgcattttctgagatcataaaaatatgaaacaattagactgtaaacgtggtaaattctgggaaaagacctcagccaagaatactgtttgcttgtactttcacattttcaaaaggaaaattatgatattatatgggtataaaaaagagcctaataaagaatgaattctttctggattaattcttttcacagtagtgtttcttgtagatttcgtttccatgcatgtatacttcaagaacatgggagccagtacctttatttctgtgtctttatgtcttactgaagtagatatttaagaaaataatactacaaagaatacactcccagactgagtctgtcctatttcgttttttatataaaaattcagatcttgtcctgtctacttaattgaatttgttaccctgccatctacagggaggcaacggtactgggatttttttttttttatagggtgacagtgcctccttgtggactctgtctgaatcagtggtttcaccctttaatatcatgctttaggttgtagtgatccctaatcctaacatgattttgttggtacttcataactataatttgctactgttatgaatcataatgtaaatatctcatatgcatcccctgtgaaagggttgttcaaacccccaaaggggttgtggcccacaggttgagaatcactggtctaaatgctactttttctaagaaaaaagaaagaaaattttatatggttttatagcaaattttgtgtctaaagaaataaaaatatgtaattttttattagttgattataattatgctataatcttttacttctgaagtctttagttactgtgtatgccttgtagggattccttgttccaacggtaactccgtttgtatttgctgtgctctctttaggacagggtgaccttcaggagaataattgtaaaaaacaatgccaaaaagaggaagatgtacgagagctttatcgagtccctgccgttcctcaagtctctagaggtgagctgagctgtcactctgctgtgctggctgctttgctaggaagcactcgtgtcctgaaaagttcttgtgaccgtcttgtgaggctagccatgctgggaacctgagtttaatccccatatgaaggtgggaaatgtctcctgatctccacacagagtgtgtcttatagtaccctaagaaataacgataatgaaggtggtaataacgataacaagagttttaaagtatattatattttactatgaaaagaacagatggcgatataagatttttactgctatttcttttactacatgtaacaacattttatcctgctttttggaaataaggctcttttttggactttatagcaagtctacaggagctgtttatcagataacaagtgtaagcaggtcagcatccactcggttttctccccactagcactcatgtgtcgaaaatcatctctaccctgtcttcagaatatcttcagcatccaatcattttgttaacttcaccagccccaccttctgtaggtatcttcattgcctcctgtatgacttttatcagccacctacagaagaatccttttaagttccagatcagggcagtcttgctaacaaccttcccaggacaggataactttgaagaaggccaccgaggtcccttgtctgtacctctcagacaactttgctaactgctgcacttccaccctgccatagacattagcttcctgctgttgcatacgcatgccagccctcccttcagatctatgcatgtgctgtctgcctaggacagcctcccccacaactccatggcttctccatgaatctccttcatttcttagctcaaatgcctcctcagtgagaccacctgtttcttatctttgaaggttcatgaaagaaccgttaccttacaaattcggctctgccaaaattcattgtgaaagtgcttttctagacattttataatagataaagcctcatatttgaactctcttgaaagcgattatagagaactaggtacatgttcccatggtgtcgtaaaatagcaaatgttggcgtggtcgtgtctctgtgagtcgccggtttatgcctgggagaaacttggccatgttgtggaatgcgcagacagctgatcttctttagaaactcctgtcctcaaatagaatgtatcagggaggtaatccagtcagatagagccatgtgacgtgacagaaagcaacccaggaagggactttggcaaatcggagaacatgtgctccctctaagggaacagctgccattccaccatagctttactgctgccatatggaaatttgggctgggggttggctgagtcttctggtattttacaggaaactagaaatacgattttgtctacttcaggattctagcagttaatgtagcaactacacaagggaaaacagttgggtttatttaactatgtaggccgtcccttgtaaacatgtaaaccaggtaaggctacgtgattggtcggtgtattatcaggcttccccagaggaacagagtttatatcatacatacatgcatgcctgccacttattagagtggcttataggctgtgctcccacaagtccaacaaagcctgtctcctaatggaaagtgcaagaatccaatagtccactaggatgggtatctcagctggtcttgagtatactctagaatcctgaagaagtaggctctaatgccaggctgggaatggacttgctagtgtgagagagtgaaggcaagcaggcagagggagcaagagcttccttcttgcacgccctttatttaggctgcagcagaagctgtggcccgggtgaaaggtggatcttcccagctcaaaaactggattaaagatgcatccttccaccttaaaaatctggattaaaaacgggttttcccatttcaagtgacataagggaaaataatccctcccaggtgtttccagcctcttgggttttagttaattccagatgtagttaagctataaccagaaatagacaccacagtctctaacacggtgctcttctttgtaggtttctgaacgcctgaaggtggtggatgtgattggcaccaaagtttacaatgatggagagcagatcattgctcaggtacggtactgagctgccattcctttaggcttacattccagaaggttcaactttgttttcataattggtacgcagtattagattaaatgaatatttcttccaccagacaacttatcaaaaatgcttttgcagctggtaagtaatctggatgtttttgtttatataatttatttctaatgactgtgcattaaaccattacctagctgagtagtttgcagtttgtaacatgaaatccgcatgtatagtgggagtaagatgtcttgtgtaagagggaaaagtgggggctattccatgaaattaccaagaacccaggtccacaggcagatgagttttgcgtgattagctcttgagatctgcttccagataacactcaccagaaggagttcacattgtaccatgtgcaagcactgaatgcattaataagaatcccctctaaccctcatgtttttctgaactcccagtgggcgccagttgtattacagtacctgctagccagagagctcgtagaaagtaggctgtatagacagttgaagggtgcgcatgaatgagtgggtttctaacgagagttcatgcaaaaaccaggaatactgggggtgtacgtagagaaggcgcctttcgttcccagcagtcttttcagagccggaagtacactgtcatagactgacatgtcagcttggtgcctgaaggccgtaaaagctcatctattgcttccgaaagctcccagttgcttttgctcctggcaagtctctgtgctaatgctagttgccttgggtggacacagtgctactttcctaggattgcggaatgactgacgtagcctgctggtgggaggggctgctgggacacacagcagggaacacagaatgactgacatagcctgctggtgggaggggctcctgggacacacagcatctgctatcctttcttgtaaactgctcagcacaaaattttgaggttacttgccatattttctggtagagaatgtattatttcgaatgcctaagaagttactgtagaattatcgtaacctcaggatgtagtctggtctatgacttcactttacggactggaacctgtaggctggcttcaaaggcatgatttcagagatgctgtggaacttgaacattcaccctgcatttttgttttaatagggagatttggcagactctttcttcattgtagaatctggagaagtgaaaattactatgaaaagaaaggtaaacagcccccaaattcctcatatccacaaggaaaatatggatttttttttttaaaaaagaacgatctcagacttcaatgtaactgacttgttggctccttagggacactatgcccctccttagaattgggaacaaaacacccatggaaggagttacagagacaaagtttgaagctgagatgaaaggatggaccatgtagagactgccatatccagggatccaccccataatcagcatccaaacgctgacaccattgcatacactagcaagattttattgaaaggacccagatgtagctgtctcttgtgagactatgccggggcctagcaaacacagaagtggatgctcacagtcagctaatggatggaccacagggctcccaatggaggagctagagaaagtacccaaggagctaaagggatctgcaaccctataggtggaacaacattatgaactaaccagtaccccagagctcttgactctagctgcatatatatcaaaagatggcctagtcggccatcactggaaagagaggcccattggacttgcaaactttatatgccccagtacaggggaatgccagggccaaaaagggggagtgggtgggnnnnnnnnnnnnnnnnnnnnaaaaaaaaaaaaagaacgatctcagaacttcaatgtaactgacttgttggctccttagggtaaatcagaggttgaagagaacggagctgtggaaatcgctcggtgctttcggggccagtactttggagagcttgccctggtcactaacaaaccaagagcagcgtctgcacatgccatcgggactgtcaaatgcttaggtaggggtcacggtggctggttatgtctgtattccaggccttcctaccatacaggtgctgcgagccttacaaagtatgacctgggttcagacttactttaactattgacataaggactcccggctagcacgttttgtatctgtgtagtagagaaaacgccacgtgttgtgttcctcaagagagaaggctaaaacggcacgttctgtgcagtccgttatgaagttgcagtgccagtgtggggcgcacgcccccttgcccaggctttaggtctgtggaagcattacctactgctcttcttcagcttcttcttgctgtcttctacctggggagtttggcagaagtgccgctttcagttggtatccgtagggattttgtgtctgagaaatcactcactttggtaatgaaaaacacggttcaggaaataggaacataaatgacatttaaaaaaaataggtttggcaataattatcctctccacgttcctcacagttcagaaagataaaagttagtttcagtgcttttaagatccccaagggtcctcagaattaattccttacagagtcactttgtaaaagatttttcaataaatgcaatattagtcaaatgatactttggtaaaagaagagaaaaactgacagtaattctcagcgctcttggctgtcgagtgaggatgatgtgagaggtttcttactttatcctgtaatagctgtattaaagggtgtgggagaaatacaggaagttagaaaaatccaggaaaagctaagacgcccgtgtcgcaccgtctgcctgtgctttctgctactgtaattcctttctgttcgatctgagtgcattttctgtttttaaacatgtttctactataggcattttattaatacatcaaatttttgcattctattaggtaaatacacacacaataaattgtgtaatcactcactggtaaatgtcgttgggtccagtttgtgtgtgtgtatataaatgcatagatggcttctagtttttccttagaagtggttttctgagcaggtcttctgaaatggctctctttaattagtatatattacatctagaagtagcactttcatgaacagcatgagtgttgcatattcaccatcattatcctctccttctttctcctgctcttcaggtagggacccctcatctttcagggaaagttttttaaaaactagattctaaatctgaaggaaaacctacagttcacttaatgtgagggatctgagctttgttcttttttctgtaaatgatgcaatttaattttctttatagctgagtaacattccatcgtgtatattacatttccttttttccatttgttgatgggtacttaggctgattctataacttgactatcgtgtatacacaggcaactggatagctctatcgtatgataattttgacttctttagacatgtgcctaggattggttgagcctggataaaattgtaggtctggttttagtttaatgaggaacttctaaaccaatttcctagtagctacaataatgtctattcaggaggccttgccagcttttactgtttgttgatgacaggctactttgactgaggtagatggacatctcagcctgtgctggtctgatttctcaggtggctattttttttttttaatctattggctacttgtttagagaagtagttcgtgtgcctatttaatgactcagtacacgtggccaggccgcttttatcttcactcatgtgcctgatatactatgtgcgaatgctcataaggcctataaaccttccctctttacctttgcaaatttgagagatagagtttgacatgttagagcagagtgatgtttactgctctgtattgtaaactcagttttcagatgcatgagacagccaggactgctgactcctgtctgtaattccaacacctgacgcatgagaatcataaattcaagcccagtttgttcaaggtcagcgtgaactacatagccagactgcctcaaaaccaaacactcaaaataaaacacagggggcagacaagcagtgaatcacattaacaatggtataaatgcattaagcatcacagcagatgtagtgtaaactctgagagcagggtaggaaatactcttgaactacctttggggtgtttatcatattaggatgaagcagcaaagcttaccttgccatattgagaccctcatttccacatcatgggccagggcctcccatcagctgtgtcactgtcaaagtattttagatagactgtagccagagatggccctatttcttttcttttttttttgaagtagaacatttcaactttttttccatatttttaaaatatctacctaaaattctcttgcattgttactatatcaaagccacaacatcataatggaatatcatagtagaaaagagtgacctagcaattcctgagtttttcaaggaatgctatttttaatttaatttttttcttttcttagccatggatgtgcaagcatttgaaaggcttttgggaccttgcatggaaattatgaagaggaacatcgccacctatgaagaacaattagttgcgctgtttggaacaaacatggatattgttgagcccactgcatgaagcaaaagtatggggaagaagaccattagtgaaacagttccgtagtagtggttagtccactgagaatgtgtttgtggagatgccaagcagtttctgtgattccaggtttttccttttttaaacaaacaaaaaaaccatttacaatatatcagtaaacagtagtgatttaatagtcaataggctttaacatcactttctaatgggtagttcataaattaacataatcataaaaatgactttctatttcataaaactgactgaaggtttattcaaatggttataatatattgaaagcatacatgtttaagaagataattaaaagatgtactcataggccaatctgtatgtttggattattcaagtatcgtattagtgactatgctcctttaggggggaagctggcagtggctcatgcgctctaacgtggtattccattctttttataattcatcagatggtaaagtgtcaatcatttcattttctaccttttctggcttgataacttgtgtgttagccttggcctattggtaaaatggtgtgaaaatcatatgcaattttgaaattttttatatttttgcaataaagtacatttcaacttctttgacaaatgtcagtcagcagcctgtgtaatcgagtggctttggaggccgggtaagttagtcattatggtgattgggcaaagagtcttttaagatgaaagatcatcactggcatctttcactatcaactctatcttctcactgcttaccattttttatttagcaacctgctgtattctttataaaatgcattttgacatttaatgtcacaaaggttgtaatttttttcaaggcaatttaatcttaatctgacatttttttgtcctctgaaagtcctgaatcttatatttagaaaaaggaaatgtttcctgtcagtatcaagaggcatttgggattcttaaccacatgcccacaagatatggctttgctctgtaaggcccgagggccgcagccctgtgcgtgtctgtgcccacagtcctctgttcttccttgtcctgaacgtcaaccagcaagctcattgattgatcagtagccaatcaagtgtggttttgttttccaaactctcctacagtggtggaaataagtttgtgtataagcaaagccatatatagtgattaatgtaatttctgtctatattgcatatcattcgaccttatccctagctttaaagtaaactcacagtcaaaagtacactaagtacaacagttcctttggtcaacagatgcttatttttatggcaaatatgatgaattgttatatacaaccaattgtaaaagcaatatacttttacgattttcaggccccatgaccaaatgtttagagacattaactctcgccagttattcacgtttaaatgggtaatttcactttgggaaacatgtttgtaaggaacagaggtatctatgtatgttaaattcatctatggctgacatgatcttataagagaatgttcatagtcctctttgtacatgaaatcgtggctagaatgttaaatggataatgtataaacaagaagtatgttatactgctcactatacctttagctgtgttttgaaatatagttttgcaaaatctttctgtaggaaaaggagcactctctacatgaaggtcacatgttttctatttcagagttcagaagctctgtgttaaaggaggaacaattcccaaaacagaaaaacaagaaaaaaagccactcagattcctggctcctcctgtcttctttcctcagtttcccaggttgcattgcagaggctgaacgttggcgttcacggaacaggaaatgaatgcctcggctatgaatgccagctctgttctgttcagtattgttggttatatttaaattttccttataataaagcacacttttataataaatgttccaagcatggttttcttctttattatggcttgtctagtgtataaattacaacaacaacaacagcaaaatggaagctataaccccatagcatgcagcagtcagaaagtacagtcttgcacaactgaggtctgtgtaagatcttaactacttgtttttaactgttgtggtatgttgcagattattttggccgaatatgactaactggggaatttatgtgtaaagatttccagtgttgctgttattaaatctgtagcgaggaaccttactattttgatgaggtttttgttcaaaacggcacctcttcagtacacacgtgtggctgaggagagtgctaggcagtcttagagaacaagactcttcattttgttttaaatacgtttagaagggtatgtgtgtctcttgctcatcagtatgaatttgggcttagcacctatgttttaacaaaaatattacgtgcagtcgaaattggataaatatatttgggatcctgttcacattggtatccaaaccacatagcatgtttagtgtggagactgaagagaatcaaggacttaggattttactaagaaatgtgctgagttgttttcattttcaaagtatacttaacaatgcagatagctttttcaggaagtgttacggcgagcagatagctttctgtggtcttcaaaccccatggaagcttggaggcattgcactggggcttcattgtgcagctaatgagagacttcacatagctaaaacgcagcactccagagagaagcaaggatgctggcttttaaagttaacagtgatgtgaggtgcagactaaaggagaggaattttagtaagaatttagacagcttgacccatcccagaataattttacaggcagcacagctggctaaacaattaaaaccatagttgtatttacaactatttgaaaacaataagcagtggtggctcacacctttaatcccagcactagagaggcagaggcaggcagatctcaggtcaaggccagcctggtctacagagtgagttccaggagaaccaggccacgcagagaaaccctgtctggaaaaaaaaaaagacaaaacaaaataaaacaaaaacaaaaacaaaacaaaacaaaaaaacaaaagcccctaacataaatagatcttactattgtaattcatgatttgtgaaaatgtaagcaaccagatacactgttttctgaggaccctatgtatctaacaataaccacaagagtatctctgatcagatgcataccaaggagaatccatgacttcatcaagactgttgtacgtcagtggcagaactcaggaagaactgagatttcttttcttgctaaaatcttggcctatgatccaattaatgtcaattataagcctagtcgtacttaacagtcaattttgagaggaaaaatttttagtaaaatgtgggtctttattttttgtgtatggtaaatttacaaacttaaaaatgcccccccccaacacacacacacacaatgcctttaatcccagcacttgggaggcagaggcaggcggatttttgagttctaggccagcctggtctatagagtgagttccaggacagccagggctacacagagaaactctgttttgaaaaagaaaatccctaaaattctttaattagtatctgaatatggtaatatgtgatgatctatttatagaacttatttatattaaaatgaagtgccacctacttgaagatgtggtttccgcagattttgataactatagcctgaatcttgtcattctcccagacataaacattacgctacaaattagtgtgtggatgtacagaatatacacatgagtgtatacacatttacacttattttgttagcaccaattataattgtttcatggtagcatgttagtacattttttactctcagctggaaaaaccaaaaatgactcccatgtacaaggcaaagttagagaacaaataaaatgaaccttggttgtttcccctccatttgattctttttattagatgaactgggaatacagcaagtagaaccacccatagtgaatggaacacagatgcctttctggaaccccagtcttctctatgattccccagagtgttgtttgtggattcatccatttatttataaaggagtaaaggggaaatccttgggagtcctccattgaatggtgtggagatgaaggaatagtggtcctaaccagcctaggggcccccaaaataaaatttaaaatgtgggggtttagtggatggcctgaatctaatccctaactcccacaggaaggaaataaccagtctcctgaaagctgttttctaacctccaagcaaactatagcatgtgtgtgcctcataatgtagcatgtgaaacacaaaacagacatgtgcagagactgatcaagctttggacaaacgagaacagtggatacccagcaaataagttctccaccctgcctcgtctgcaaccactctgatatcaaaacctaaattgtctctattacccaattttgacttctacagatatggccttgtgaagcctcaagtggcctgtagggtcttcttgtctcagcaatggctaggtcaggggctttaccctgcctggccttatttctcttttctttttgtagcactggggatctgccccagggcaagcactctgctacttagtttcatttcaggcctgtaacattttatgtttaatgtgaaaggctttacaagaatccttgagtaatttagtcgaaatagtgaataaagtttttaaggatttcttgatactcttatttattgatttttatatatatacatgaatgccctgtatttatatggaccagaagaggtaatcagatcccatggtcacaagatggttgtgagccaccatgtggttgctgggaattgaactcaggacctcttaattgcagagctttctcttcaggccaatgaagttacttttaaaaaaatgtaggtttttttttttttttaaatgtgtatcagtgttttgcctgtgtgtgtatttctgtgtgagggtgttgtatcccctggaactagagttacagttacagttgtgagctgccatatggttgctgagaattgaactcaggacctctggaagagcagccagtgctcttaactgctgagccatgtttccagtccccagatggagttacttataatttgttcattttctatgtctgtcctaactggacaccaaccggtgtcttactggtcaacaggaaactcaatcttcctttgggccggcatccagtctaagtcttcagccttcctttacatgacgatgtacttgaaatgtgaacaaataatttttcttttttttttctttctgcccaccccctgtccccactcttgagtcagtctgagatgtccaggctgttcttgcactcctgggctcagggcttctcttgacctccccccacccccagtaggtgggactccaagcaagtgtctctactctccattacaggtgacaatgtaaggagtggcatatttaattatttgtaaataggtgtccattataagaatgtttccccctcatagctgttctctagagggccactattgtcaacgcttcaaaactaaagtgcattgtgataatctatataacttgatggtactgaggtgcgggaatgaggtacatattctgtttaatgaatatgttaacatattcatattttgacatggtgaaggaaacaaaaatagtatttaacacggctggaagctgtacaagttcagtatcttatctgaaatgcctgagaccatttaaagtttctgctctttttggaatctggagtatttgcataggttagccactgagcacagataatttgaggatgtgagatccggaaagggcagcaatctgaaaatattgtttgagaaatgatggttaaagttaaactgcacaggacctaggctttcttggttggtactgcttaccctgtaatggctacatagaggaagcattcggcttggaagcacatagcaagtgctttaaaaagctcaaaacagcggactcacatgatacattagtaaacccgtgctgcgtatttcccctcattattcaccagacacctacttccttgcttatttgccagaccaaaagatggttcccgggatggagagcggcagacatgatgtgactgggggagggtgcattgtcataaagtattagcatagtattatgatagctgtggacatagaaactattcctatggttttaaaggctctttatgaaatttagttatccttaaaatgaagtacttttaggtagtgaataaaaaatgtatactgaccctccaaatagaaatgtcaaaaatgtcattaagaactttgtcagaaaacaagaattctccattctagaacactttacacttttttatttttattttattttattttattttatttaggatttttcgagacagggtttctctgtgtagtcctggcggtcctggaactcactctgtagcccaggctggccttgaactcagaaatctgcctgcctctgcctctcaagtgctgggattaaaggcgtgtgtcaccactgcccagcctagagcacttttaataaaagacataagaattgtcttttcagcttgactactctcatttcatttataccaaattgggcaaatctccaagaactgttgagaacaaatgatagccaaaattaggaatctcctctattttctgagggtactcaactatttctatagactgtcacctcttaaagtccaaagaaaaatgaatatatacaactgttataggtttcctataatcaaatgtcttgtcaccattgcaagcttgtcatctaaattccaaccaacctttcccccacttccaggatcttctctctcccatatcccatatctgaatggggacatgagtaatctcagttattcaagcaagaaacccaacaatcattcttgcttcaggttctattgattcttcttcctgatgggccttgctttatggtcacctgaacaaaatctaaacttctagttgcatcatcaaagatttgaggcacctgtgactcagctccaaaaaagacgctcattatcttctaggcatttccacatgttacatgaatgctttgaactaagttaattataaaatgaacttgctttcgaacagtaaaataatctggggagctattagtgtgagtttaaatattctactaaaatgctatctgaaagtttggtgacagtatttgaactctggtttggtctcaactgtagtatttgttgaaccctttgataaagagactagtgagttcataaatattcaagtagatgtcacgggttttctcttctactttgtttggcaaagtagcaattgttgtagagatggtgagatccaggagtactgcttaattttacttctagatagatgaaataaattctaagtagtgtttctctaatctttaaactattttttaaccatctttaaccaactaaaatttgtttaaaacaaaatttcaaactgttggtattttgattttttttcacattttaacagattttatacatgtgcacaatatacacagtaaccaagaggaggcattaatttttttttaatgttaatcttagcctgaaaatatctgaagaataagactttctaagatgttattgatctttgttctggcttttgagttggctgcttttgttggttaaccaagaattaaatgatgatcatgttaaatatgcatacggcactaggtgttcacttagttcctcaaggaagtccaatggattaaatatctgctgcaagttgggggtgggggtagattctaataagtgcatttatctctgattaaagtatcttaatctaacttatatttaatggcatggacataagataaactatgacaaatgttttaaatctttgaattttcagaaggagtcaataaatagtattaaatatatgaatgaatgggaaacatctacagttagtaagacatcataattaacatgcaatacctttatctgacgtcaaatttatacttcccaccctggtaatttacagctaaaagcaaaacaaaacaaaacaaaacaatccaacccactacggcttttggtaaaacctgggaaagtcctggagagtgtttttacgtttggaccccccagccccagcccccccccccccccacctcttttcctaagtatcagggggaagttggtgttggagtttacatacatgctcatgaggaccgggtaagtcagtggcccaagctttcaagctttcagttttggaaacacaaccttttagttttgagaacatatgaatatcacaggcactagttttaaaatattaagcatactccaagaatagaggctactattgtttagttaagaaattaatattggtgtttctgtttttaagttatgggtcttgctggaattccactacagaagtaccacaaacacgaaatgagtgaagcacggtcatgctttttgggatcactctacagtatctgaaagttgtacactagggtcttacttttttactcgggggtgggggtcaggcattttgggagggttttcctctggattattttgaggaaaacaatgcttgtgaacagaatatttgtgagcagagtatcaatccctgctcacttgggccggctattttagaaatagtttccacttcaagagtccaaaagcagaactcaaaggaatttgaaaccttgtttcaaccatgtaccagtaaatcttttgtttactggttttgttctgtagctttcaggtctagaaatgcgggcagttttgaaagatgacctcgagctcttccctaaattgacttgagcagaattcgtactcctttctttctcaatttcagcacatttctagtaataggaagaaataaaacctaatccataccctacatgattaaacacttcatgttcaaagaaaaaaagctcaataatgcctatagtaatgcttataatgtgaatagtaaaaatgccaattacagactgactgcacccagatgctatgagcaacctcctttaaaaggaagcaactaacacagaaaagccattccccacttttggtaactcccttagaaaaatcaggaggaacttctagtagaaacagagtggaaaggcagttttctgtctgaacgcttagggagggagagacagttaaaaatattcaccaaagacacaagtaacctagcaactaacttcggacaaatacagtctatctacactcctctgtattaatttaaaagaaaatgtaggccaataaggaaacatcgcttcgaatgcctcaaattcaaagcaatagtccagtactctaaacagctgtataaattcttgagtccgatactgtctcattcttaaaccctacagtacatggcacttggctgtgtctcaactaattctggtcaaactggacactggtaaatcttccccagttgttgttggcggcgtattgagtcaagggctggttaagtttaaaaaaaaaaaaaaaaaaaaaaatctgtctagctcatctgctaagggagggcagtactgaatcaacttttgtaatccccaacgtgcctgggccgtgatttgtaagtgatcaagtccctggctagcctgcactgcttccgcttgtgcagtcatcttcttcccctcgcactaaaacaataccttggccaccagccaaactttgagcagcaagcgactctgctgtttatggcctggaatgggtgctgaaatacccaaccaaggacgctctaggccctctgggaggcctaaaggaagagaggtggccctggctttaaaacactcctatcctccgccccctcccttttgtctcagacaccaaaacaaacgagctgatacacgtgtccctatgactcttgtttactatcaagactgcgttgtgcgcgtacctctgggatatgtagttcagtcagctcctccccccggtaatttcctcagctaaggagcaaggctgagactactaacccacaatccacttcgatagcaaagtttggctcccgtcccccgtgtctcggcagcaatccaatccaaagcgctttctgtagtgattgacaagccaccttctccagtaaacacaagagaaaagtcaatacatgcccgcccaccgagacggactacggcactttccaatggaaaggcggaaccttagagtggcagttcttcagaccaattaaagacgagaaaggtggacgaaggctcagccccccgggggcttcaggggagggggaagacgaagcttgaaagacttggtaatggcgacgggtttggtaagtaggaaagtttcggctgaggagtaaacgcggcggtgggagtcgcggcgcgccacagagaggtgggcagccgtcgggaaacgcgcaggcaagcagctggcgacgctgtcgcgacagacggcctgcgtcctgactctgtgtggtcgcggggtttctgaggggtggggggtgggcaagggaggggctggagcttcggggccgggcagcggccgcgagagcggagacccttgggactctgggcactggatcccctgcgcggaacccgccgtccgggcctcccgggagctctccgagcctggacggccgcggctcccaggactcggggtggtgggggtggcggagctcggggctcggtggcgtcgcggtgggggccggcggggaaggggccggggcaggggagggnnnnnnnnnnnnnnnnnnnnnn

SEQ ID NO: 1196 - DNA, 1928 bp, Mus musculus
ctcgccgggggccagtgcgccgcgctcgcagccggtagcgcccggggcgctcgctcgggagccgcgcagcccgagaccggaccgcggatagggggcgagggcggcgtccaggcgcctcggcgtgcacgggcaggatgagcatcgagatccccgcggggctcacggagctgctgcagggcttcacggtggaggtgctgaggcaccagcccgccgacctgctggagttcgcgctgcagcacttcacgcggctgcagcaggagaacgagcgcaagggcgccgcgcgcttcggccatgagggcaggacctggggggacgcgggcgcagccgccgggggcggcacccccagtaagggtgtcaacttcgccgaggagcccatgcgctccgactccgagaacggcgaggaggaggaggccgcggaagcaggggcgttcaacgctccagttataaaccggttcacaaggcgtgcctcggtctgtgcagaagcttataatcctgatgaagaggaagacgatgcagagtccaggataatacatcccaaaaccgatgatcagagaaacagattgcaagaggcttgcaaagacatcctgctgtttaagaacctggatccagagcagatgtcccaagttttagatgccatgtttgaaaaattggtcaaagaaggggaacacgtaattgaccaaggtgatgacggtgacaacttttacgtcattgacagaggaacatttgatatttatgtaaaatgtgatggcgttggaagatgcgtcggtaactatgataaccgtgggagttttggagaactggccttaatgtacaatacacccagagcagctacaatcactgctacctctcctggtgctctgtggggtttggacagggtgaccttcaggagaataattgtaaaaaacaatgccaaaaagaggaagatgtacgagagctttatcgagtccctgccgttcctcaagtctctagaggtttctgaacgcctgaaggtggtggatgtgattggcaccaaagtttacaatgatggagagcagatcattgctcagggtaaatcagaggttgaagagaacggagctgtggaaatcgctcggtgctttcggggccagtactttggagagcttgccctggtcactaacaaaccaagagcagcgtctgcacatgccatcgggactgtcaaatgcttagccatggatgtgcaagcatttgaaaggcttttgggaccttgcatggaaattatgaagaggaacatcgccacctatgaagaacaattagttgcgctgtttggaacaaacatggatattgttgagcccactgcatgaagcaaaagtatggggaagaagaccattagtgaaacagttccgtagtagtggttagtccactgagaatgtgtttgtggagatgccaagcagtttctgtgattccaggtttttccttttttaaacaaacaaaaaaaccatttacaatatatcagtaaacagtagtgatttaatagtcaataggctttaacatcactttctaatgggtagttcataaattaacataatcataaaaatgactttctatttcataaaactgactgaaggtttattcaaatggttataatatattgaaagcatacatgtttaagaagataattaaaagatgtactcataggccaatctgtatgtttggattattcaagtatcgtattagtgactatgctcctttaggggggaagctggcagtggctcatgcgctctaacgtggtattccattctttttataattcatcagatggtaaagtgtcaatcatttcattttctaccttttctggcttgataacttgtgtgttagccttggcctattggtaaaatggtgtgaaaatcatatgcaattttgaaattttttatatttttgcaataaagtacatttcaacttctttgacaaat

SEQ ID NO: 1197 - protein, 426 aa, Mus musculus
RPGRSLGSRAARDRTADRGRGRRPGASACTGRMSIEIPAGLTELLQGFTVEVLRHQPADLLEFALQHFTRLQQENERKGAARFGHEGRTWGDAGAAAGGGTPSKGVNFAEEPMRSDSENGEEEEAAEAGAFNAPVINRFTRRASVCAEAYNPDEEEDDAESRIIHPKTDDQRNRLQEACKDILLFKNLDPEQMSQVLDAMFEKLVKEGEHVIDQGDDGDNFYVIDRGTFDIYVKCDGVGRCVGNYDNRGSFGELALMYNTPRAATITATSPGALWGLDRVTFRRIIVKNNAKKRKMYESFIESLPFLKSLEVSERLKVVDVIGTKVYNDGEQIIAQGKSEVEENGAVEIARCFRGQYFGELALVTNKPRAASAHAIGTVKCLAMDVQAFERLLGPCMEIMKRNIATYEEQLVALFGTNMDIVEPTA

SEQ ID NO: 1198 - DNA, 137049 bp, Homo sapiens
ctttatttccatttttttcaacttctgttttccctgaagtagactgcactgttttcaattgccttgttttctttttttgtttttttttttttgagacagagtctcactctgtcatccaggctggagtgcagtggcgccatctccaacttagttactccattgtcacttgtgaaactgaagaagcaagattcccaggtgtagaattcttttgctaatcagcatcccgatggcatagactgttctaattagacagagtctcgttctgttacccaggttggagtgcagtggcgtgatcttggctcactgcaacctccgcctcccgggtccaagccattctcctgcctcagcctccagagtagctgggattacaggcacctgccaccatgtccagctaattttttgtatttttagtagagacggggtttcaccatgttagccaggatggtctcgatctccggacctcgtgattcccaccctcggcctcctaaagtgctggaattacaggcgtgagccaccgtgcccagccctcaatcgcctagttttctctgaactataatttatttattcctcaaagtctctgccagaggtgtagtttttctcaatataatcaaacacatgagataatttatgagtttctttcctttttcttggggacttccttctctatgtctttgatttcatcttccagttggacctggatgatctctagacctgctgaaccacagctatcccaggtccttcatcactatcctgagaattatcagtatataaatagaatttaaagccactggacttgatgagatcacccagggagtgagtgcagagaaagatgtctggagtgcttcaccactgagaggtcaggaagatgagtcatattcagtaaagaagatgacaagatgtggccaggagacaagaggagagctaagaaaaggtggaatcatgaaagctaagtgaagaaagtatttcacatgggctttttcaacatggctgcttacttcatcaaaccagcaaggagaatctctcccttcttaaaagggctttcccctgattaagtcaggacctggataatctgtcttttaattaactaaaagaaaaaaaaactgctttggtactgcaattcatttaattcatctgcaaaatcccttcaactttgttgttttttttattggctagaacaaagttacaggtatcactcatgctcaagagaggagattgtggccaggcacagtgcctcacacctgtaatcccagcactttgggaggccaaggtgggtgcatcgcttgaggccaggagtttgagaacagcctggccaacatggtgaaaccccatctctaataaaatacaaaaattaactgggcgtgttggtgggcacacgtaatcccaactactagggaggctgaggtaggagaattgcttgaacccaggaggcggaggttgcagtgaactgaaatcgcgccactgcactccagcctgggcaacggagcaagactcagtctcaaaaaaaaaaaaaaaaaaaaaaaaagaaagaaaggggattgcacaggacctgaatagcagggagaaagcagtcacccaagagtttgtttgccacagaatggctcaattgaagagaaacattgatgacacagaagagagaggtgacaactgcaggagcaatttccttgagtaggtcagagggaatgaatggagtacaggtagacagaacattaacagacagaaagtgaagtatgtgggaacaggtttgggtaggctacttgatgtcatggtgggagcatgtctcagttcccttctgcttactggcgcctgtatattcttgtttctcagtttatctcctcgttttggtaaaacttagattcttgacaaagggaaatgggaatttatattatgtaaaactgacatgtctgacagtatcttcagtctaccgttattttgctgaatatagaattttgggttgaaaatagttttccctcagcattttgaggatattagttctattgtcttccagctaccagtgccatgttgaggagtctgatgatgttctgattcctgagctttcagatgtgatttgttctagttttgtctctttttgtcttgttttgtttttcctctctctgaaagcttctatacccttctatttatgttagtgttccgaaatttcagcattctggacttagtgaggatatttttatttattgtcccataagcctgtccatgggcccctccaatctggaaattcatatcattcaattctaggaaaagttactgtatgatttctttaataattttctccatttctcattgtcttctttcttgaactattttttcaatgttaaaaattaaatcctttaattttcttatttttctctgctattttctagattttttattttgttctactttctggtaatttcttcagctttatcttggacccttttatagattatatatctactgtcatagttttaatttctaaaagttctttcttatttctttaaaatatagcacagtggctctagagccagactgggtcccatcccagtaccatttgctagctatgggatcttgggcaaattacttaacctctctgtgccttgatttatccatctgtagtgtaataatatatctcttagagttcttgtaaaaattaaatgagtcaatagatataaagtatctagaacagtatctaataaatgttaggaattattgttatcattattgtatgttagagaaaaatgcctttttgactttttgactttttcttccgttcacacttcagtttttacttctttgattttatgtatttaattcatttatcttgattctagtctttcatatgaataagttttcttggaagtcaggattcttgcacaatttcatacttgtaaagtatgcggaggggtggtggttactgaccagtggacttcacaatggagtgaaaacacggagacctgagtttttcaatggggaccctccaatgtcagcaactgtaggtcttgtgtcttgggctggtcagttccttaaaaaggaattctctaatttcctgcctaagagggtatacatctgtctgtccaaaatttggggagtccagaagggaaggaggccaccgataagtagctcactaatcaggatcaatcttcctctttttagtatagaatctcatccccatagtaagctgtgtaaacttctctagaaaataaattcctccacttccccctgggaatgaagaagagcaattacttgcctacataagatagagaaggggctggagggtggacagtgttatcagctctttctacagccatttaaccaatcctcaccccttaccagccctccagagacacctggtgtcttcagactctgtgctctgtaatacagatgtgatcttgcttcttgttggcttgctctcactgacccttcacccaggcttaggttccagcattcttcagtttgctgttagttccaaaattctagtagacaactctcatctgttcttgtctcttttcctattcttttttttaattaaagaattaatttttttaaaatttgtgataaagtacacataacatgaagtttactatctttatcgttttaagtgtacagtttagcggtgttatatatattcacactgttgtgcaaccagttccagaactttttcatcttgcaaaaccaaagctctttacccattaaacagcttcccattctcccctccccagtcagccactggcaaccaccattctactttctctttctataaattttgacttttctagatacttcatataagtggaatcatgcagtgtttgtctttttgtgactgacatttcacttagcataatgtcttctagcatgtgtcagaaattccttccttttaaggctgaataatcaaaaaaaattaaaattattttaaatttgtattgtggttctcctgttctttttgttgtttgagttttcctgtgttcctttagccattattttagtggagtagagataaacttctgtgtccaacgtggtccttaatagaaaacccatattctgtttatgaaatatgtttaaggacatattctttgttgctttttaagaatctctttaactttgcaagattccttaaaggagaataatgagtatacatttcgtcctgatttagccaaagaaaaacttatgcgttgatattaagcaaaaaaagttgcttcaagcagcttcctattcagcatgaacataagctcttccttagtgaatctagcatagtggatctcaaagtgtggtcccgagacctacagcctaagtatcacctgagtatttgatagacgtgcaaattctcgggccccacctcagacttactgaatctgaaactctgggggtggggcccagcaactgtgttttaagtagccctccaggtgattcagatgcttggtaaaatttgagaatcactagttttctagcggcaacccttttgcaaagttgcacatagagattaaacattttacttacttttagtccaaatgtctgtaagattttcaggctatgaggtgaccatcttttagcaggcatgttgtgaagtatctgtaccacctctataacattgggactgttcccaatattcgggactttcctctgctgaagaggcaggccttatcatgtatttatactacctgaccacttccttatctggcaccctactggccacacttactagaccagtcaaggccaggcaatctactagatggtcaagaccaactaacctgattctctcttgagaatatgaatcagagacaccaaaactgtagtcagtgttgaaatgctaaaggtacgtaaaactgaggctgatgatcacagtcagccttgggcaagaacaggccctgtatcctctcaattgcctccttttttttccttgagtgggtatatatttcttgcactccagagacttgatcaggaaacaccttaactattgacaggaaatgctgcatgattgattggtcatagttattattctgtactgcttgcccaagccattgactttgtttttttggcagttacatataagcaagttgatgggtctgtttaatttcctggtgtgaaaacaaatttgatagcactcttttcatttcaatgctgagctctcagagttcatttgccattgcttccagtctgattctctgagaaactggtgcaaattgctttgcaaatccacaaccaaagaatcagtatcagtgatgctcttttaaggaatatgagatacatagttcccataagccactgttcaaaaggctcaaaatgaaatattctgaaaatgaaagcaaaagaaatcataaaatattaccaaaaaggttatgtggtagtgaataaaagccagaatatgatttgagaagtgaacatttgttctgagaacaatgctaatgtaatgggaatatcaggaccaagctttactttttcaggtcatggttattgatttaagaactgatgcaaatgaaaattaccaaagagctgtttgcaaagatgtttcaagtccaataagtcttgttttagtattatactattgtaaatctctcaggatgaaaaagactatataggtcatctaatccaattacgcatttcatgcttgaaatcattgctatattcttaaagaaatgagaaccacacaaccttggcattgtggttgatgacagagagctatctaccatgcttcatataataaatctacaagaagaaataaatgaatttggaaacacaaaatggcattaacaagatatggctcttaataatgtttggaaaagtagtgctttttttaattttgtcattcctagggaaaaggtattagacattgtggcagagattgataattatctccagactttttttttttttttttttttttgagacaaggtcttactctatcacccaggccggagtacagtggcacaaccacagctcactgcagccttgacctccctgggctcaggcgcttatcccacctcagcctcccgaacagttacgaccacatgtataccaccaagcctggccaatttttgtatttttttatagagatggagtctccctatgttgcccaggctggtctcgaacccctgggctcaagcgatccaccctctttggccctccaaagtgttgggattacaggagtgagccactgtgcccgtccagacttggttctttttaattcccaaatgtttacttggcacgtgactgctcaaaataaatattacatttccaaactttcctaatagccattggtttcagttgctattgctgtgtaacagattatctcaaaacctagaggcctacaacaacctttttattatgctcacagattctgtggaacaaggcttcagccagggcatccagtacagggctggcttcttctatcatgctgacttgacttttacaatgttctattggtcaaagaaatcacaagcacattcagattcaaggggaggggaaataagacttcaattcattagtgagtagtggccacgccacactgtaggagatattgttgtagccgtctttggaaaatgcaatttgccacaccaaaggtgtggccatgttgactaagttctagccaagaggatagaagaggaattgtgtttaacttcctagaaggaagggaggggaggggagcttcccttctctttttcactttcctcttagctaaaatatgactggccctggagcagccattttggaccacagacaggatcatagagcaatgagctggagggagcctgggtccctgatgatcatggagtaccacactgtgtccggaattggtgggttcttggtctcactgacttcaagaatgaagccgcagaccctcgcggtgagtgttacggttcttaaaagtggcgtgtccagagtttgttccttctgatgttcggatgtgttcggagtttcttccttctggtgggttcgtggtctcactggctcaggagtgaagctgcggaccttcgcggtgagtgttacagctcttaaggcggcgcatctggagttcctcccggtgggctcgtggtctcgctggcttcaggagtgaagctgcagaccttcatggtgagtgttacagctcataaaggcagtgtggacgcaaagagtgagcagtagcaagatttattgcaaagagcaaaagaacaaagcttccacactgtggaaggggacccgagctggttgccaccactggctcaggcagcctccttttattctcttatctggccccacacacatcctgctgattggtagagcccagtggtctgttttgacagggcactgattggtgtgtttacaatccctgagctagacacaaaggttctccatgtcccaccagattagctagatacagagggtccacacaaaggatctccacgtccccaccagaatagctagatacagagtggcgattagtgcattcacaaaccctgagctagacacagggtgctgattggtgtgtttacaaaccttgagctagatacatagtgccgattggtgtatttacaatcccttagctagacacaaaggttctccacgtccccaccagactcaggagcccagctggcttcacccagtggatcccgcactggggctgcaggtggagctgcctgccagtcccgcgctgtgcgcctgcgctcctcagcccttgggtggtcgatgggactgggcgccgtgaagcagggggcggcggtcgtcggggaggctcgggccgcacaggagcccacggagtgggggggaggctcaggcatggcgggctgcaggtcccgagccctgccccgcgggaaggcagctaaggcctgcgagaaattgagcacagcagctgctagcccaggtgctaagcccctgactgcccggggccggtgggtccggccggccgctccgagtgcggggtctgccgagcccacgcccacccggaactcgcgctggcccacaagcaccacgcgcagccccagttcccgtccgcgcctctccctccacacctccccgcaagctgagggagctggctcaggccttggccagcccagaaaggggctcccacagtgcagcggcaggctgaagggctcctcaagcgctgccaaagtgggagcccaggtagaggaggcgccaagagcgagtgcgggctgtgaggactgccagcacgctatcacctctcaataccaactctgaactgcccacatttagattccagagaaataaatcttaagctattgtatttcgcattttctgccacatgtgagcagtgtttatcataattaatacaaatattatcacaaatttagacaggtgatacacatgcatcttagattaccagatccgtaaaaataataatgcttacacggtagagagtagtactaacattgtgctccaaccggtgacatgtgaggctcaccatattttataaaagtttaattctttttttttttttttgagacgaagtctcactcttgtcccccagcctggagtgcaacggcactgcacgatctcggttgactgcaacctccgcctcctggattcaagcgattcttctgcctaagcctcctgagtagctgggattacaggtgcctgccaccatgcccgctaatttttgtatttttagtagagatggggtttcaccatgttggccaggctggtcttgaactcctgacctcaggtgatccgcccacctcggcctctcaaagtgttgggattacaggcatgagtgagccactgcgcccggccaaaagtttaattcttaaaatgctcgacacaattagaagcacttaactactgtatatttaaagcaacgtaacattattactataaagttgttaagaaatgaaaatagagaaatacattggctcatggagtcaatacaggatgcatcattaacaaagggttaacatcaagatccatttttacaagagggactagttcgttacatctctgatttctagacttggagtttccccagtcatgtgtttactcttccgtgggtgggaagataaatcagaataaccaagtgagcttgctcttgaaatattttatttacaatgatatgataattgtagaaaatgaagtatgcgtacttaaatagaatttaattgacaaaagacaattttctctacttcaaaattgtaaacatttgcaaagtaagcctcatttcaaagtcaaagccttctactttaaaagcacacattagtaattctatttttctttatactgaagtatttcaatttttggacatacaagtcaaaaatcattcaaagcataaaggaaagtttcaaaataataagcgcctcatcctgcactatcctatttaaaagagatcaactaactttgataggtgcctctcaataaatggtgcctttgtctcaataaatagtaaatgcgtggagtgcacaacggaatagcatcagtaagacgaaacataataaacaggatggatcgggaaaggctggataaaatgtggggaagaaaaagaaagacgtcacaaagatggggtagcatttctttgtccaaaagagaaccagtaccaccataagactttaaacaaaggacattagcaacacttatcatgcaactagattctagaaggaaaataaaatgccactactaaggtggaggctgaagtttcaagacaaatctcctggcaccacctctgcgggggttcaccatggcgaatgacgcctgggaagcggggcgagtggccagcccgctcctggacgcgcggacaggtggacacgaaggcggcctcgctgggcctccctccgcctctcccggcccgggcgcgcagccctgcggtggtctgacaggcgggtgcgcggcgccagccagcggaggttgccatggtttccgggggtcacgtgggcgcgctctcctgcgccccctcccgcgcaccgcggcggggcgggggcggggcgcccgggcgggggagaggcgcggccgcggctggagcgggaggagcaggagatgctgccagccctcccggggccgcgctcgctcagccgccgccaccacacggagcagacgcgcgccgggagccgcgggccgggccagccgggccgccggggcccagtgcgccgcgctcgcagccggtagcgcgccagcgccgtaggcgctcgctcggcagccgcggggccctaggccgtgccggggagggggcgagggcggcgcccaggcgcctgccgccccggaggcaggatgagcatcgagatcccggcgggactgacggagctgctgcagggcttcacggtggaggtgctgaggcaccagcccgcggacctgctggagttcgcgctgcagcacttcacccgcctgcagcaggagaacgagcgcaaaggcaccgcgcgcttcggccatgagggcaggacctggggggacctgggcgccgctgccgggggcggcacccccagcaagggggtcaacttcgccgaggagcccatgcagtccgactccgaggacggggaggaggaggaggcggcgcccgcggacgcaggggcgttcaatggtgaggaccagaccccccacttcgcgcccccggatcccctcgctgccccccaccgctccccgctgtgctctcggatcttgccgctttgcgcacccacctctccccgcattctccacctttccctaccttcccatctcgcccaccccctcagcatccatttctgtctctcccactcgcccaccttcctactccgctctctgtcataccctcttcccttcctctagaggtgggagagctgggatgttacgcttccctcttaccctttgccccctctgcctgggccggttggggtgggcatctgctagaaagacaactttcgctgtggttggaggtatttcgcttagaggataccattgtgcataaagaaactggcccgcttggcgtcttctttcagcccttgtatttattaatggaatgtcgaaagagaaaaggagaaccgtgtttaatatgattggctttactgttgttaggacggtagattcgctaaaagaagcatgaaattggactcactggggcagaacaaaatttatggccagtagctctgacattcttggaaataagagttatctattattttccaatttaccaataccgtgttgtgttatttttggacacgtaacaaaggattctatttagtctgaaacccacgggggtctttggaacgaggaaatgggttaatggtttgctttttatataaaagacatattgaatgatttggtgctttatttttttaaaagtgtatgagaaaaacactgtaggaagttctgaaagcttgttggttgtctttataatgaaaagccagtgagtaattgtaaggattgtgccagacagtagagctagaaagaatgaatgggaaagaaaaaggaattttctcaaatagctgctcctggcaagtcccaccccttctgcttacaaccctctttccctaacacacccagacacacaccctcatttacagccccttgtattacacaacatgcccaaatctcatttttatggcaacccaagctaaaataccatggagtgcagtgtgcaagtgttttctctttgtggtgtaaggcaaacatgcatgcagcattgcaccagcttttatttatttacactgcttgtggtttgtgtgtccgcagtgtatttcataaaatgaaaacatttaaaagtgtcatttcatttccttgtgtatgctcctaggaagatgtttcttttctttgcaggattacatgttgaaatggattataaaattagtgtatttttagtttgtccaaaagaatcccagaaaccctggaaattagtgcgctgtgaagataaaagtgaagcttgttacttacaattttaattttggacttctaaatgtttccccaagaggataaacatagtcttaataattctttttgcacaagaatcgaatcaaaagcttttcctaccagaaacgagaaagagaaaagaatgcatgttttaaataggtaagaagcagcagccagtaacggatgacagaaagggcagagatatctaatacttcttttatgctcctgacatgttcgtgcacacacacaaaggggaaaaaaaggactcttttcccaggttggagaaaactaggaactaaggggcttggtaaagaccatatatatatatatattctgtatgatatgttgttaatataatcaaaatattttgtttgtataatgcatttgttgaagtactttgcattgatgattgcattttctccttataacaatatattgcgcacagaaaagattccattttcattttgtagtgaagaaataagccgttaacttctgaacagcaggggtcattttatatggctttatattctccaaggcacctttgctgtaaaaattgctcagtgtgacttaaacaagttaaacttgttaaacaattgcactatttactccctagcctcacccccaaggactttaaaactttttgactgcaaccaaatacaatttgatcattatccaggaggcacatacatctgtataacagaaactttggcaatagtacaggtacttccttctgtcagatgcagtgctttttgatatttcctatttgaatcagttatttctccctattttaaattgtattgagacctccagttgaaaaacatttaattataggctacaaagtgattggcaaggtttcttgtaaagggccggttagtaagtgttttagacttagggcaacatgtggtcttgatcacttcttcttcagtttttttttttaaacacatacaccttctgagggttgcggttgtacaaaattagctgcagatcaaggccatagcttgccgacccctggttagaagaaaaaaaaaaaagtcaaaatagtaccattgggggaaaaaacaggagtgatcctaaaaagtatgagcctatcagtttgacatctatgtccagaaatgtgtctcattagaaaagaaccccagatactgggcaattctggcatagtaaagaataaggattggaaaacaagtcttaatttactatgacacagcacaagacctgctgggtcagtaattctgaaattttcatagatatctcaaggaagtttgattcagaaatgaccattaccctgtaccatttttggagagcttttttaaataggttgagatgggacatgatatccttttcttccccctcagtagacatcccacccaggtcattctgatatcaatagttccatgactgtactttggaaaacattaacagatagtgataatactatattcttcttaacatttaaaacataattgccgttagttgacaattgctgtgtgctgtctaaatgctttaatttttttgtctcagctttatgagaacgataaggccatcacttgcccagtgtttcacgtgagctgcaaaatcaagattgggatacaggtggacctggcttcatccctgtgctcttgactgcccgattctatctccagatggggctggggctagcataacctgagtatcccttatatgtcaagctctatttgggacccttaatgtgttttattgttaaagctctgaaaaattaacttgtccaaggtcacacataaaacgagtaagtagggaagcctgatttcttactcttatgtatctaaccttgaagcccaggatgatcagggagttcttaaatggaatttgttctgtgggctgactcacaagtcaggttttcctgtttttttttcttttagtaatgctgatggatttgcattgttggttcatatcctctcttgtgaatgtctttaacgtaagtgatggtatttatgagaggttggagttaaaaggcaagtttttgaccatgcaacttgtgcccattgacaaacgtaggacaaacgtagggatcaagcatgtgaccttgaccttataatgtggtggtttaatcaaataagccaggcacctgcagttagctggaaaaaatgttgtctggccaggggtcggtgatttttgagggtcaggtggtgtggctgtaggtggcgctagagcaaacagtcagatgggtgaaggtcatcttctttcctacctttccaaaggatcccttcctcttctaatagctttcttttccctctcctattctcttccagtcttataaattctaattgttactttccatttgctatcaattctggtcgaaagagcaagctttagatgttagaatgatagtggcttatggtgaccctttctagggaaactctcaaaggccagaaagaagccataatggaaacctcttggcatctactctgtctccctcttccccgtcctagagaaagcaaatacagtttgacatgtcatgtctgaaagggtagcatccctaggccttgaatttcttagaaggtttacggtaggctatagcattgcatcagtactagtttggagtaaaatctgtggtaattcatgattttatataggcatcatcaagagatcttgtgttgccccataatttcttcagtggaattgctgaaacaaaaaatgaagtaaataccattcagattactctgataaatggacaagtggtcagaaacaaaattaactacacatgggcacatgcagagcagtcaacctgggagaaaaaataactaccgtgatagaaaataaagagctgattttctgagttatagaagaaaaagatctagagttcaaagtagatacacataccaaaaatatagactcataccccataagacaagcatatcaaaagtaataaatagaaatttaccatgtaataactgtggcttaatcctcttaactctgtcccatgtccagtcttgttggaatcttacctaccttttggtttttacagttcaaagggaatttggagaatttacaaaacatccttaaggtcaagcaaaatattgtaaagtttatatcattgatataaaatcttacagagttatatacttttttttttgcagaatagcaatttcattgtgttttatggaaatgaatccagtattgcacttcttggcgaggtgaagcagggaatgagcttatgtggcagttttacttaggatttaatgttatacagtaataaaatccatatcttttcagctcataatttgtagctaagagctccaggattttgtaattaatgagactttatagtttttggctattagagatttacatggtggttttaaatcctcctgaaatggattaaatcattcatgacaatggctaaaatattgaagccattattttagttatgagcataaaacaatagtgtcagaaaagataataaaaattattttgagttagagatagtgattgtgattttcaaagcagaagttaagaacattattcattttactagtaatagtaggtggattgctttaggggttgaaattgggaaaccaaaaaacctcttctcttaccatctattactttgggctttggaagaagggtggtagagggagaaagataatgaagtcagaagggaaagggggagggagagagcaagagagaagtaaaaccagttgtgaaggcttgcttgagtaacttacactttgaagacatacaatggaaacacctaaacagaaattgaagcattagtactttaatttttctatcaaaaaccaaaccatttagctattattttagataagacagttaccagctttttttttttttttttttttttttttttgtggatgcacataaattgatgtgctgtgtctgggtagaacaggagtgaatattgaatggttattttattgttgcaaatctcattccatggattccagtaaatttccagccgtcaagattttgttaacagctatgttgaaaaacaattgtgtttctttttcagttgtgcaaatacaaacaggggacctatgaatccatcaatttggggtttatttttgacccattaagaaaatcgtttgtcagtagtagtagtaataaagtcctacagtggaggttggggaatgatggaatattttaaggtgagagattcagtgaagaagactgaagtgactaactgcagggtctactttagaagtgtggagaatcacagaaagtgctgagatctgggatggcctattagaaacaatgtgtgaaacttggaaggtaggatagttcttattttaagaaaaaagaaatgattcgtcttacatttactctctttagacttcatttttttctgtttttgtttgttttttggtagagatgggtcttcctttcttgcccaggctggtcttgaactcctggcttcaagcagtccttttgcctcagcttccgaaagtgttggaattagaggcgtgagccactgctccctgcctagacttaagacaccatccttttgtcagagatggcctcatagatagtatgtatgatcaattttgttaatagatggggcaggtgagagacagagaagttccttatccaaatttggtaggttttggccttataaatttgagtttgttcatacaactgttgccaacattttgtgcgctatttatattaacttacatcatatgaattttttctgtcttccatcaagttgattgataaggtttaaaaggatgggctaaagaaaagtacttttgtcttcagaatttccaggtttttttgttctttgattctttttcaatgaagtgaaatctaatattagactatattttcctatcacttgcttaagaagagacaatggaaaagaaacaagaatgcagtgatttttctgaattgaatgaattgttactgtgttcttgatcctgttcttgtccttcctgtcttatctatatcatctagttgtggttgggacagtcacaaaatcctactctaaaaacctcactatgatgcttatcattattttatgagagcgaattttgtgcttcacaaattcaaaatgactcagacggtttcattatgtaattttatggaaagaatttgagctaaaattttcaggtcatggcttacatgacaacaaaacaatcaaataagaaaatcagaactataaacagttggtgtaacatttataaatgtttcagcaataggctctgccatgtgtagcttaatatgtttggaaactaaaaaaaaaagtctttccagttgctgctgtttaaaaatgtttcttaattaaaaaaaagacaaaaggtcaaaatgtaaacacatgttccacataaaagtgaagccaagaagatatactgtatacagttattcctgtatctgtttgactaaggatgacattgtttaatttacattagctgttccaagacaaaatagtccatgggagtgatgttgaggggaatttggggggtaaaaagagaaggaaaaaagccgtttgttccatttgttctaatatatttcagttacacccaaagagcatctttttcaaaggtcatgttgaattaaaacatgattcggctgtttcgttctcattattatagaaaactaatgtcttttaaatggtgtccttttaggccgggcacggtggctcatgtctataattcccagcactctgggaggccgatgcgggcggatcacctgaggtcaggaataggacaccagcctggccaacatggtgaaaccccatctctactaaaaatacaaaaattagctgggcgtggtggcgggcgccttaatcccagctgcttgggaggctgaagcaggagaatcgcttgaaccctggagacggaggttgcagtgagccgagattgcgccactgcactccagcttgggcaacagaggtatactctgtctcaaaaaaataaataaatggtgtcctttttatttaatactagttattattaacatttttgactactgatgtatcagatgtggaacagtgctttacacattgtcatctgaacagatgctttacacatatgtgatttagtcttccccagagtaattggtggaatcaaggtttgaacctggtaatctgacttcagggtcttcctcttcaaccacggtttatacacttcatttcagtaattcttttagcagtaacgtggttgaaaataagcacatatcaaaaaataagctacctacttttccctctaaaagtttgcaggctagccctgcattgatctctcccttttacaatttgcattctctgtctattcaacccaaattagcatttcatgtaccttagaaactcagtacatttgtttattttattttattttgtttttgacagagtcttgctctgttgcccaggctggagtgcagtggtgccatcttggctcactgcagcctctgcctctgggttcaagtgattctcctgcctcagcttcctgagtagctgggattacaggtgtgtgccaccatgtctgcctaatttttgtatttttggtagagacaaggtttttccatgttggcaaggctggtctggaactcctggcctcaagtgatcccacctgcctcagcctcccaaaatactgggattataggcaagagccaccacacccagcctacatttatttattttagaaataatcacctcatgtactgagctgcttaattctctaaatttattttattatatacctttattagcaaaatatatttgagtgtacaccccaatatatgttgataaattttatacatgtgacaatatattgacttatatgtatgataaagcttcctacaatataaattttgaaaggagaaagtaaaaagcaattctaagcaagttgtaattttctcctacatcccaacatatagccttatacactgttttggcatacatgaaccccgttttggagactacagctgtaaacaataccacttaaattgatactctagtaatatataaagtagccatgatcaattttggttccctgattcaagcttctagattataaagagtgtgtgtgtgtgtgtgtgtgtgtgtgtgtgtgtgtgtgtgtcttttttaaaagacagtcactcggtaagttaattgactcaacagaagttggcagaatacagaggaaaattctatcttataaaaaggaagtaaaactacgttacctgaaggggaaaatccaggctttttcttttaaaacctgttttcctgtatataccttgaattccaattgtatagtggtaatgtttttggtgcaacatttgtggatgggacaaagagaatcgtattatagttttctggttaggaatcagtaaattatggaaataccagtcagaattagaagaaagtctaaagtttagaatagttgaaaagaaatgcaatttcatagagtatttcaggttattttgttaggagagagatcgttcactatttgctttcttgtaacttttgaaaaatgtttagcatgtgcttggattacctattaaataagtgtaaaaatacatgaaagaaaggcaattcttttgtaaatatgcattaagtagtaaataaaacacagtaggccgtgtgtggtggctcacagcctgtaatcccagcactttgggaggccgaggcgggcgaatcatgaggtcaggaaatcgagaccatcctgactaacttggtgaaaccccgtctctactaaaaatacacacaaaaaaattagcctggcgtggtggcagttgcctgtagtcccagctactcgggaggctgaggcaggagaatggcgtgaacccgagaggcagagcttgcagtgagctgagatcgcagcactgcttgacagagtgagactccatctcaaaacaaaacaaaacaacaaaacaaacaaaaaccacggtatatagcggcacatgacatgattctaaattgatatagccaaatattcttgtcttaagtcattctcttggtcctgaattctcactcccctctccctgtctttctgctaaatctcactcttttcccaaaggtttagtttatattttaccctaccaaatatttttgcaagtttccctccttgacgttaatactatcaatatggtaggatgaatatggcctccatcagtcaactttgcagatgtcaagggtcctcagtctaggtaggcaagaatgtgcaggaatataccctctctttctaagtctttcctgtatgtgttgtgctttgctcacagtaggtgtgcaaatgttttttaaaatattgaacactgtctaatggtaaatgtgtatgaatgtaaaatgattgaaaacttcttaggcatgtaaatattttaaatagacttttttttattatactttaagttttagggtacatgtacacaacgtgcacggtttgttacatatgtatacatgtgccatgttggtgtgctacacccattaactcttcatttaacattaggtatatctcctaatgccatccctcccccatcccccaaccccacaacaggccccagtgtgtgatgttccccttcctgtgtccatgtgttctcattgttcatttcccacctatgagtgagaacatgcggtgtttggttttttgtccttgtgatagtttgctgagaatgatggtttccagcttcatccatgtccctgcaaaggacatgaactgatccttttttatggctgcatagtattccatggtgtatatgtgccacattttcttaatccagtctatcattgttggacatttgggttggttccaagtctttgctattgtgaataatgccacaataaatacatgtgtgcatgtgtctttatagcagtgtgttttataatcctttgggtatatacccagtaatgggatggctgggtcaaatggtatttctagttctagatccctgaggaatctccacactgacttccacaatggttgaactagcttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtcttttggctgcataaatgtcttcttttgagaagtgtctgtttatatcctttgccccctttttgatggggttggttgattttttcttgtaaatttgtttgagttcattgtagattctggatattagccctttgtcagatgagtagattgcaaaaattttctcccattctgtaggttgcctgttcactctgatggtagtttctcttttgctgtgcagaagctctttagtttaattacatctcatttgtcaattttggcttttgttgccactgcttttggtgttttagacatgaagtccttgcccatgcctatgtcctgaatggtattgcctaggttttcttctagggtttttatggttttaggtctaacatttaagtctttaatccatcttgaattaatttttgtataaggtgtaaggaagggatccagtttcagcttcctacatatggctagccagtttttccagcaccatttattaaatagggaatcctttccccattgcttgtttttgtcaggtttgtcaaagatcagatagttgtagatatgcggcattgtttctgagggctctgttctgttccattggtctgtatctctgttgtggtaccagtaccatgctgttttggttaccatagccttgtagtatagtttgaagtcaggtagcatgatgcctccagctttgttcttttggcttaggattgacttggcaatttgggctcttttttggttccatatgaactttaaagtagttgtttcgaattctgtgaagaaggtcattggtagcttgatggggatggcattgaatctataaattaccttgggcagtatggccattttcacgatattgattcttcctatccatgagcatggaatgttcttccatttgtttgtatcctcttttatttcattgagcagtggtttgtagttctccttgaagaggtccttcacatcccttgtaagttgattcctaggtattttattctctttgaagcaattgtgaatgggagttcactcatgatttggctctgtgtttgtctgttattggtgtaagaatgcttgtgattttttcacactgattttgtatcctgagactttgctgaagttgcctgtcagcttaaggacattttgggctgagacgatgttaaatagacttttaataatagtctcctagtaatgttttacattactgtattttaagatgtttcataaaatataaaagctttagcctatcttcagttcagtctcatagatttggacttcgttgtattaaaaatacaacgtgaggcttgggcctgacatttgaacactacaaaatgcacagaacgcacgtgcacaggcttcttttgcctgtaggatttcatattgtaattgaggtgacattctggccccccacaaaccactaatgctgtatgtcattgcatctgcttatgtgaactctgtgcttaatctaaaactgatctattgccctgaacctgctttgtccatttccatctttttgcgtttcctcatcattcctgccactctgcaaggcaagctgccttcctccctctgttgcttgaattctgctgacccctcaagacccacttgctgtttggactcctccagtttttcctctagctccagcacagacctgtctctttaagattgaaatggacatatccacccgcttaccaaatacctttgcttgcatgttcttcagccacctccatacaattttatcctaaactgaatgtgttctctcgttcctcagttcttctctcctgtactgtgatgtcattcttttttttttttcccactccactaattttcataaacgtggtcactagagctccttttcctttgcctcatactttttaaacctggcaatttgcttttatggaaaaaagcaaaaataaaccagattgcttttagttgccaaaaatttaagagtaattatgtgaaacatctgaaatagtggaagcttttttaagagtgtgatttcattttggtatagactctagatttgaagcctgactctgccatttataacttttgggaacttgaataagttacgtattttatgatgagtgcctcattttcctcatctatgaaatgggaataaagatagtacctatctcagagggatgttttgagaattaaatgaattaacagtacctggcatacgctaagcattaatgtgtgttaaaaaaaaacacaacaaaaccaaaaggaaacaaacaaatacaagttttagaattcaatgagaacacgacagtttaaaaaaaatgaaatttgattagaaatataagctagagattgctctcaagccagtatagtaatagtacttttaaaaagttattaatgaaaaatatgaaagtaaagtctttaaatcttttagttaagtgtttcaaatttttaaaaacttgcagttctttaaaccttatgtcctcctttaattccatttgaaatttgaggtaaatagtccgacttggaaaaaaaagtaaaaaaaaaaaaaagatgggataaagctttgctttgttttcataccatcctttcccctgagaaacagtgtttaactgatagagtaaatagatgtgtgtgtacacagtctccaagtttatggtcttaaatttaaggtttagcaggtaatttttgaacaatttaggaacctgtaggtagaagtattgaaaattgttactttatttaaatgaggcagatgcttgtagaaaaacaaaactgtgtgcctgaaatacaaattaattggcaaacaattagttggcattaaattgacagcttgttgccctttcctcatgtcataatatttataaaagtaagctcatggtgggacaaattaatacatctccaagtcttacattagtatgtgtttttattctgaaaacttataattctgtacttattcaactacaaattgctaataatttatttttagaagaaaataaagacaatcttttgagatctttgtttttacatgaagtttgttcatacgtctttgatttttttatttgactgttaacagcagtttaccagccaagcaatattaggacttttgatgcataataattccttgaaatacctttcttgtaattccttaaatggaatccaaaaggtattttagtgtttgaattttaacaaaaacccgtttgtaaaaagaatattttatgaaaaatattttaggagcacattttacattaaagtacattttgaactaatttggttgggctgatagtatcggagcatagtgagagatttttatctgccaaaactgagtagagcagaattttttttctcttttacttgttgtgacgtattttcaatatagagaaagacacagataaatgaggaacactcatataagcagtcctctagctctgacagattttaacattttggcacccttcaaggttttttattttttttcctggccacgcacggtggctcacgcctgtattcccagccctttgggggagaccaagacgggcagatcacctgaggtcaggagttcgagaccaccctggccaacatgatgaaaccccatctctactaaaaatacaaaaattagccggatgtaatggcacatgcctgtaatcccagcttcttgggaggctgaggcaggagaatcgcttgaacccaggaggccaaggttgcagtgaactccagcgtgggtgacagagtaagactctgtctcaaaaaaagaaaaaaagttatttttttttcttttaaaatataccacatgtgcagtaggaggaggcccctcgtgtactctctcctgtcccattccatcaacttctctctccggagataaccaccaccatgatgcatttagtgtttgtgtttctggtatgtggttttgtagtattactacataggcattaggttagaaatttgtataaattttgcacttataaaagtttcttttatgtaaattattatccatcaacttgtttttgagaagggcatttgagatgttacattgattcatgtagttctagttctctagttcatttattttaacattacttctatgtagtatacccttgtataaatatacactttatccattctttggtaaatattttggttgttcccaattttttgttatagtgctgtagtgaatgtgtgtgtgtgtgtgtgtgtgtatgtgtgttaggcaaatgtagtttttaaagatagttttcagtgtgtggtctggatacctctgggggaccatttccctctcttcccagaccttgcaagagtccataggatgaaaattataataatacttctaagattttctttgcctttttttctctcatgctctcagcgtgatagcttacggtggagttttccagagggtatatgatgtatgatattgcgacagattgaatgcaggagcaaatacgagaacccagccatcttctatcataccagatttgcaaaaatgtaaaacaaagtcattctaaattttactaagttttgtttgttttggaaaatatagtttttttaatcaaaatatgttattagtaacgtgtaagttcctttaaattcatattttaagtatttatcagttttaatttataatacaataaatatcaatggatataaccatatacacaaataatttttgagagtatatagagattttgagatcgaaaagtttgtggactgctgctatagggtatgtacctaagtgtggaaaggttgattgtaggggtgcacagctttgacttcacctcacattgtcatatctgctttataaaggtgttgcaccagtttgtactgtcatcagcagtatgagtccctgattttcacattgaagcgaacattcaatattgtcagatttcaacaagctttgacagtaggatggatgtcaggtagcatcttactgtgaattgaatttgttttcctcttattgctagtgacattgaacatcttttcctgttcattgactgtatttgtagtttattttctttgaaaattttttgccatttttcccatctggctgattgtgtttttcttactgatttgtagaaggatttccctccttccctcccgccctcccttcctctcttccttccttccttccttcctttaatgttctggctaccaaccctatgttggcaatagtcattgaaaaaaatctcccaatcttaggtttgtcttttcattttgtttacaataactttgaacataatttttaattttaatgtaggctaatgttaatcattccttttgcttgtgattttttttgccttgtttaaggatttcatcactaacccaaattaaaaaggtaatctctttattttcctgcaaaaatttgtaagtcttgagtttcatctttaaggctttaatctataatttattcttatatatggtatgaattagggaatctcatttcattattttagtatgcatcatgtattgactcattttttcccccactgatttttaaatgttaaatttccatttatctgtgaatgtacaaatttccacatacatgtgaatgtacttcaagcttctgttctgttctattgggtttgctgtcctttcctcaatgcctctttcccttaattaatgtgactttaaaatggtcttgatatatggtatggtaactctcacttttttttttgctttaaaatgatttaatcatttgtaggcttttattagtccataaaacttttaggatatgcttcttcagttttgtagaaaatctttattggtagttttattggaattgcttgaatttataaacaaagttggagatgacagatattttaatgatactgagtcttcctatccatgaacatgatatatctccctttattcagtcttcctttcatattcttcaataatgttttataattttctccataaggattttgctatcttttcttaggtttattcctatgtaacttatcacaactgggatttttaaaattatacattttaatttgctgttgctgagaatatataacaggaactggtaaagttcaataataagaagaccctaatcaaactgagcaaagacttgaacacgtcaataaagaagacctaagaatggctgggtgcagtagctcatgcctgtaatcccagcactttgggaggcctaggcaggcagatcacttgaggtcagcagtttgagaccagcctggccaacatgatgaaaccctgtctccactaaaaatacagaaattagtggtggcacatgcctttaatcccagctacttgggaggctgaggtaggagaatcggttgaaccgggatggcgaaggttgcagtgaaccaagactgtgccactgcactccaacctgggcgacagagtgagactctgtctcggaaaaaaaagaagacataagaatggccaataagcacgtggaatagtgctcaatatttttagttatcaggatagtgaaaaaaccactgtaagacaccattaaacacacacatcattaaacacacacaagaatggctaaaataagacataccttatgttggctggaactcctatatggtcctggagggcataaagtgatataaacacttaggaaaactgtgggtatgttataaagttaagcattcacccacctatgaccaagcaatcccactcctaggtatttaagagaaatgaaagtaacatttacaaaatggttgtaaacatatgcttttattcaaccaaagttattgtaaacaaaatgaaaagacaagcacaagactggaagttttttcaatgaatattaccaacaaagggttgaatatttagaagaatattaaagaatatttataaaagctttattcaaaatagctcaaactggaaactgaaatgtccatcaacaggagaatggagatatatatattgtggtatattcatataagggaatactactcatcaataaaaaagaacagtacgaattaatcttatgtttgcatgaagttcaaagacaggcaaagctaaactacagtggtagaaatcctaacaagtaattgcctatgagatagtgggaattgacagtaagggggttcaaggaaactttccaaggtgttgaaaatgttttatatcttgattggagtgttggttgtggatgtatatgtttatcaaaactcattgaattgtacattttattgtatgtcaatttcacatctttttttaaaaaaaattggaaatgtggacactcttgaaatcttttttttccacattttattgagaaatgccattgccttctgctctgattatcttgtgaaatctttcattattcttgttagagactaaaaccaggttacattttcataattgtggggcataaatggtactgcttttaataatactacttgaaaaaaagccaaagactagtcaagctctagtgttaaaagtctattttatgtttttagccagtactatatattttaatttatgggtttcagaaactcaatacttgtatacataacatttgctgtttttttttgaaactgtgtctcactctgtcaccaagactggagtgcggtggtacgatctgagctcactgcaacttctgcctcccaggtttgagcgattctcatgcctcagcctcccaagtatctgggactacaggtgtgcaccaccatgcctggctaatttttgtatttttaatagagacgggttttaccatgttggccaggctgaactcctggcctcatgtgatctgcccacctgggcctcccaaagtgccaggattacaggcatgagcctccatgcctggccaaatgatctttaggtgccacccctattatattatttttcattagcactattgcttcagcatttttgaacctaatatatattgtagccagcagtgttctaagccttggggatacagtaatgaagcagacagacaaggaaagaccctgccctcatggagcttataatgtagcgaaggaggagacagacaataaacataaaacaggtctcttttgccagctctggagaaaaggaaacgggatgataccatggaaaggaacaagaggggcaactttaaactgggtgttcagggaaaagcttcctgagagggggttatttgagctgagactggaatggcaggaatatcttcattctgggagttgtatgaggaaggctttgaatatgggtattttctataaccgtactcttattagtaggccaaccttaatcacatccctgattattctctcagttgctcttcatttcaaagtctccctcctgccttttcccatttgtttctcccaaattacccttctctggagctgttttgttgtgactttatagacatgtagcaatttgaactctttgcagcttccagcttttccggtgttcttagcctagtttggattgtttactcttacaagcagaacattggtctccataaatctgctctttgcatgaatctgaccgtacagacttaaaagagacagttttgtgtatggagaagcagaaagtgaatttatatcgtcttgacagtggcgtttcccactcctttctacttaactctgagcccacatttaaaatcctgaaagtatttgggaacgtttttcttgacattgttactgcctcaaatctctgtgtagttttataaaaacttagtcattttaggatttttctagctgaaactgtatttttctctctttttctaagagggcattgttggtaaaatcctcatgaattaagaactggagactcatgttcattcacaagcaaaaatatgtttttttctaatttaatcattctattactttcatgttctaaagtgtcagttatattttgaggaattcggttagtaaatataaagaaagtctttgaagttggcactttgtaaaagcagaaggagcatcgatatttcgtcttactctgccccacctccagccgtaatccacgtgtctgagtgggttggacacctgatctctgtgcttctttgctgtataatcaaaaaggaagaagaaaagtggtctcccaagtgctggcttctcaaacagctcccgttatgtctcataagaagtgccttgaggtacatggttcataatctgtgtctccttgagaccaagaccatgaagccttggagggtacccgccaactattattctgtccttgtacctttgagccccttcacaggctgaatctcaacaaattcctaggcactgtgtatctagaaatacatagtatttcaagggcttacaagacagtgatgagtaaagtatctctgagtattaataattgtggtcaaggttcagtaccttttaacaaaaatgtagaaaataagtggtccttttcaataccagaaattatgtatgtattaaaagtttgcaagttgtgtgtgttaggttaatcagaaaaattttcaagttttgttgtttatttgcctgtttgctgttgaccttttaaaaaagttaattattccttggttcaagggtgagccttacttcactttaatttttgaagcacaggcataagagaaattcatttattctgcactaaatatttactctgtcaaaaataattatcttacatggtttcaatttacacagtttctagaatattttatttagacagttaacagattcagaaagtgtttgttgctagaaaaggtgattaatgggaggataaggatgctaaaattattcagctgaatccaagattattgtgtatatttcacttagggtatacgaacacttttctgcaaaaggctaatttaactaacacagctccagtgtagatagggtagtttgttttttatttttgtttgctcggggtgtgtgtatatgtgtgtgtgtgtgtgtgtgtgtgtgtgtgtgtgtgtgtttatgactgcagatcacagctcagggctcttgtttctttaacttggagtttccctcccaggagtatgctcagagatgcaaactgtgtgtactgctatcaaccttttagtttcatagattatcttaggttttttagtcttctactggatttctctttcacctgcggtatttctaaattaggtagctacttgcagggtgtaagtctttgaagccattgtatttgaaaatacaactagacttaataagctcttcaagggcagggactctcttacaattccagtgcccagcatccacactcaatacagcaacaaaattaatggggagagggagacttgctctgtttccttgcagagtttattgatgcattctgcaggtatttactcagcacctttatctgccaggcactgtgataggcattgggcatgaagaggtgagcagataagcagttcctgctggcctggtgcagaactccgtccagcaggtatgggaggctgttttcactgctgagatagagacttcttcggtttatccaaagtaatggaggatttttcttgtaaggacacggaaggattaaagaagacttgaatcagttacacttctgggtctcttgggagcgtaggaactaaacgaatctagtggaatatagtttggcaacagaagatatctctggttatacaagcacgaagatattcataggaacataggactcagtgttccactgcagtagtgttggggagaaagtcaaaccttatataaatatttttgtcttttttccttggggattcactaagatcttaggttatattctcttaaaaatgctaggattttactctgttcttaaatcatattgtttgtttctccaggcatacaatatgtttcctattttttcgttctatcctagtctctagttttctctctatgtggggtgtgtgtgtgtgtgtgtgtgtgtgtgtgtgtgtgtgtgtattcaccaaatatccacagaataagaaaatctaaaggtaaaaaccaaaagtctgagaaaatttaatttgacttgtcacattttaagataccttcatctgttaacattttttgggaatttgtattgctgtgtattttttatatttaaaaagtggtaatattagtttacactaaataagcgtcagtctcttacatttgaataggaatttatagttgacaggtacatccaaagatgtttaggttttttttgtttttgagatggagtaccgctctgttgcccaggctggagtgcagtggcaggatctccactcactgcaacctctgacttctgggttcaagcaattctcttgcctcagccttccgagtagctgggattacaggtgctcaccaccacgcccggctaattttttttttaatttttagtatagagatggggtttctcttatgttggcccggctggtcttgaactcctgacttcaggtgatctgcctacctcggcctccctaagtgctgggattacaggcgtgggccaccgtgcctggccaggtttttttcttcagaaaaaccccctgaaagaaggagggcagattttactctccatatatcacaagttgaaaatttaagtcaaggttacatggttcatctacgccatcagaaggcaatgtggccagtattagagcccaaggctcctgtctgccacttgggtggtctgtccatgccccatgcttcaccccctccctgccagtgatgtggaaggtcgggatgttggcggtgcccatcgtcaccttcctgctccccttccctgacttactttcctgagagagaggaccaggcatagcttggccagatgcacatttctttatttccagcaaggcctccaccctgaatcccagccttcttctctattttggtaattagactaaaaagcttagaaaaatgatgaaggtgaccgttaacttgctgaaagtttgtacaggaaacatttgtgtttcatccctgcaagtggaaatggagggatatgggcatgagagattggatttttggtgattgttctcaaaacccagtatttaccttaattactgcataccacttgcttggtgcacccatcttcttaactgtccaatcctatgccccatttactgtcagaaaatgaaaatcatagacttacaacctgtctactcacgatttagaaattgatagaatgtctagcaaaaatatcaaggagaaataaattaaaataatttatagcaagtaaaatgtatttcagtaggtatgtgtttcagcatgtactcaagaagacagtgtagttagattgtcccacctagatgtggaggctctatgaatataaaagctgcaaacggagtctgatcaaaaagcattgtactaggaatccaaataccataaggagcattgtagtagtcgcatggttttctgaaatgatgaacatctattagtaaaattccaaacaaagcaagaaacaaaacccaaatttgatgttgtcattgtgttgtagaaaatttgatgtatattaaaactgcataaatgaatcaagtgtatataaagagctgtattaggatttaggcccagatggttataaatggacttttttttgccaatgtgaatgcccagtgggatgttttaaaagttatgcaggacaaaagttgaaggttgcaggacagttctttgttgtgcaggattgttgtggagtttgcctgacaaaagccaaggaagggtgtcctctgaattaccgtgacaatcaaaattgcccccacaaatttagaaaacatcttctagatagcgatgccacctttgtggaaaacctttaccttaaacacttcagaaagacacagaaacctaaggaccccaggaaaacaaagacttcccgaccttttaaaccaggagctcatagtcctgtggcttcatcgtctaaagaggctggagggggcaggggggcagagaatgtctactatatttttgccccaaggctgggagaagtttttaaccttcatcttgcctatatctgcttgcactctccgttctgcattcctgtggttgcatttttttgcattttgtttccattcactgtccttgtagcttgctggggtggcactctttagactaactttaatagttgcaaaaaaggggtttgaaaactgatgggcctttgtgtgtatgtgtagtaaaatatatataacacaatttatctgatgcaagtttttaataagtaatttgtgactgtgcaagtatatgactaaagtattgtggtatataaatagtaaatattgtatgtctttcagtcactttggaggatataattttgttataaatgataatatcttgataattgggtttatgaattatttcacaaagttaatctttaatcataatgaagatcatgaaggaagataatattcacctcttattgtatgatttcaggaatctgtattttcactttctgttctctctgaggcagcgttttgatgcaagatactcgtaaattcagattctccagctgtgatgaagagtgactgtgtgatctaaaacaaattaataattttctctgagacttactgtaaaatgtactcatcagttgtttgaagatgctgattttttttttgtttgagactgagtttcattgtgtcacccaggctggagtgcagtggcgtgatcttggctcactgcaacctctgcctcctgggttcaagcgattctcctgccccagcctcccaagtagctgggattagaggcacctgtcaccatgcccggctaatttttgtagtttttagtagaaatggggtttcctcatgttggccatgctggtctcaaactcctcacctcaggtgatctgcccaccttggcctcccaaagtgttgggattacaggcgtgagccactgtgcctggccgaaggtgctgatatttgatagcatgattgtaaggattaatgcactacacatctgacatagttttattatagtacttgttcctgtgcatacatatttttcatgcagtgcaatcatactgctgataaaaattttgtcttctctttttacttgacctagtgtttccatagtgtaaacaaatttcataattactcttctaaaagtattgaagtagactcatgacattctgttaccaaaatactgcatagtacattgtgtcctttctttatataacatgagccagaaatgtacctgcttctcttgagaaaggcatgtttttaaaaacctcagttcttgagataacgatgtcatcaaaaccaagaagatacagagctgagttgagtcggaggagtgggcagatggtaggcttgccagctgagtggtgcgcacaccaggatgagattgcagctttcagtggacagatttgcgtgttatggacatttggattgcacaaaaactgtcagaactataaatctgagactttcaaggatatactatccttcagctaaagatgatttcaacatacatgagcaatttctgttctgttttctaattttatcatttaagaaatgatgctgctgaatagatttattcatacattgctctttccttcactagtagtacttctttaggttaaatctctagtagatttaccctattaagtgacacaagtcttttatagtacttgatgtaattgccaaattgttgtttaaaggtattgtattgctttatatggttcccagttaagtagttttagctgtctgtaactagggatttttcttttaatttaaagtgctaatttaataggtaaaatactgatttcaatttatatttatttgattattaatgaatttcagcatttaatttttgtatattcatggtatttcctcttatttattcatctttttctttagttaaattataagatggtttaccaatttgagccttttcagggttttgggaaaattagacttttaatctaatcatattattctgctttttcttttagctccagtaataaaccgattcacaaggcgtgcctcaggtaagtctgattatattatggattttgtttattaatggtgacatttaaaaaatgataatattggacaagaaggtacaaagaataattgctgtatagtaaacctttatttgtcagttatttttcccagaaaacacaactatctgatataatcactatctaggaagcaattgaaaatgccctacctaggaagcaatttcaaatgcaattgaaaatgtgagtggctacactgaaagtcacactgtgtactaaactggtgggcctttttaaatggagactctcagcccagggtgttattcttgctcttgatagaattacgatctgtatggttgtctgatttaccagccataatctagaaacagtgatttagcagatgggtaaaggacaccttagaaacagtgataattgagtgagtgtttttttgtttgtttgtttgtttgttttcataagagggtttttaataagggacaggagaactcttaaaatgcaggtataagaacttgtcattatgggaccatttagaataggagcaaattgctttacatttgtttgtgcccctgaggctattgctggtttaaatatactacagtaccctaatgtagtcagcatgataggccttagccattaacaagggcgtacattaacttcaatatactgtgtactatttaaactgctggggaagtatgagacagaattaagagcatttctgtccaaaatggcttaagttaaatgattttgggcattgagataaactattatttagaaaattcaccatatggcttatcttctctgtgtaagaggacaaatgaagtgagggtaatatttgatttgagaaaattactctttaagtatacctggaaattttttgttaaacccaagataaacatttcacacagatcatctttggagttgatataatacaaatgggtcatttatttcacaaaattaccttatttccacctgtgctataatattaaagacattttaatgttgaattttatttttgatttgtcagcagttactggtataatttactcttgttatgtagtgaccaggtctataaggataatatgctatattggaataacatctactttatcattctgagctttttgtaatctcaaggcgtgtttattttaaatggtgaaaacaagtgtagattgtaatgccttttgtggaatgagacattatgtttatgtcagtaaggcgtcgaattttatcccaaagaactatcaagtgtgatcatattctagtgtagtagtcctttatgagcagtggtgggaataggggaggaagaagagagaatcagtattgtgatgccttgtcttcatgaggtgaaattctttcaatagaaacacagttaagagtcatagaataaataatcaccatttctacctcaaaccgtatgacatgtgacatttatttctgggcacgttccattagtatttgttgtacattatacgtatcattggctgggcgaggtggctcacgcctgtaatcccaacactttgggaggctgaggcgggcagatcacgaggtcaggagatcaaggccatcctggctaacatggtgaaaccccgtctctgctaaaaatacaaaaacaaaatgagccgggcgtggtggcgggcacctgtagtcccagctactcgggaggctgaggcaggagaatggcgtgaacccggaaggcggagcttgcagtgagccaagattgcaccactgcactccagcctgggtgacagggtgagaccgcatctcaaaaaaaaaaataataaaaaataaaaataaaaaataaatatatatatatataattgtagagatgatgtaataccacaaagaaatacacattaaaatcaaatgttgcatttattcccagaatgacaggtaataagaaatgtcagtgaaaacaacaggaaacagtttggtataaataagatgataccaagttcaggagtcacgctgtatacagcagtaagccttaaaaggagtaaaattgttatcccaataatataatatgctggaaaccatcaggagaatgaatcttgacattaattataagaaagaaaagagaactaatttatggagtaccactgatggatcaggcactgtgctaagcattttatatacatttttagtctttcaggcaaggcaaataaaattatttaatactttgaataaaaaatgtggtataagaaaaaagggaagaggatttatttaatcatctacttctctgtattttatttgagactttcttaattcttataaaagtttgtgtaaaatgtttttgacaaagaatatagaaacagtcttaagacatcctgaggaggaaatgctacagtttttttgttaatttaatttagtgctaacatgaagtttagtaatagagatgtacattaacttttttaaaaagtaacatttcctgaaaataaaaaagaaatgattattttctcaaaatgcagtcaattgtatttgataattaaaaagatttcttatgataccttttctgattgagttttcagagatactttttcttttcataacccataaaactttaatgtaagaatggtaatttaggggaagaaagtaagtcaggtaaaatcaactggaagtctgtacgacgtaagagtttgttttttattcatctgtttttaaattaaagttacaacagtaaatgctatatgtatatattacaacaataaatacaaaatgtgtagtgctaggtgttctatcattgttgattgaaaagaaaaaattactatgaattataattaataactcattaactgactttcctaaatcttttgaatttttggcttttgatattcatactgcatctatcaaacataaatatttcaaacctgaataatttaaacaaaacatttcccctttggatacctttttcttttgttatgaaggtgagaggaatatttatgcttaacaaatacattctttaggattatttttacacttttaagaacactatttgtgctatagtctctcgtcttcctcatgtgttcagtgctggcccacaaacgtgtcagtttttatttttgtaagtgaaaggaatcagtttcactcattattttcaaacagaattcctagcatcttaagagtttatagaggcttcagggttgtataagccagcatcctacttggtacaggagtggaaggcatgtagaaagcatgactaacgaagagaagcgtagatgggcaccagaagaataggacccaattttactgattagattggatgagttccacaaaacatgatgaaaaactgtcagatgtcttctgaaatccagatatatctctgatagcatcctgacagcaccccataaccttatttttaaacagtacctcatggtcccatttttaaacaaaagaaaaagaaatactgcttttgatctcttaaaatgctcttcagctcttaataatcccttcttatcagtacatccttaagacagagaggcctggtgtggtggctcacacctgtaatcccagcactttgggaggccgtggtgggcggatcactagaggtcaggagttcgagaccagcctggccaacttggtgaaatcccttctctaccaaaaaatacaaaaattagtcaggcatggtggcgcgtgcctatagtcccagttactcgggaggctgaggcaggagattcacttgaaccctggaggtggaggttacagtgggctgagattgtgccactcactccaacctgggcaacagagtgagaccctgtctcaaaaaataaaataaaataaaataaagtaacagagaaatcattatccataatccattttattttatttgtatttgagatggagccttgctctgttgcccaggctggagtgcagtggcacgatcttggctcactgcaacctccaccctcccaagttcaagcaattctctcaagtagctgggactacaggtgtacgccaccatgcctggctaatttttgtatttttagtagagacgaggtttcaccatgttggccaggctggtctccaactcctgacctcaggtgatctgcccgccttggcctcccaaagtgctgggattataggtgtgagccactgcgcccggccacataatccattttacaatatgggctttttgttttttggaagattattctttttggtggaaaatggaaataatatatcatttgttgttgtgagtattaaaaattagtggtggtggctgggcgctgtggtacacacttgtaattttgccactttgggaggctgaggtgagcggattacctgagattgggagttccacaccagcctggccaacatggtgaaacgctgtctctactaaaaatacaaaaattagctgggtttggtggcgggcgcctgtaatccagctacttgggaagctgaggcgggagaatcgcttgaacctgggagacggaggttgcagtgagctgagattgcgccactgtactccagcctgagtgacagagggggagactgcgtttaaaataaataaataaataaataaaaatttagtggtggtagtagtagtagcagctcagtaaatattttaagagtaaacctttaatcaagaaataatcctgttgcttcactgttcacctaatatatagaaaagatcctagggtttgaagttgtactgactagagttttcccattttctctgtgaatttgtatgtaagttgtttacttctttgagtttaattttatttattttcttttctttcagcttgggatcttaatagctatattcaagcttgtgagggttaaattggatgatttttattatttttaaattttttttttttttgagatggagtctcgctctgtcaccaggccggagtgcaatgacatgatcttggctcactgcaacctctgcctcttgggttcaagcgattcttctgcctcagcctcctgagtagctgggactacagctgcacaccaccatgcctggctaattttttgtattttaatagagacagggtttcaccatgttggccaggatggtctcaatctcctgacctcgtgatccgcccaccttggcctcccaaaatgctgggattataggtgtaagccaccacacctggcaattttttttttttttttaagacaggatttcactctgtcacccaggctgtagtgcagtggcatgatcttggctcactgcagcctccaccttccaggttgaagtgatccttccacctcaccctccctagtaactgggagaacaggtgtgcaccacaatgcctagctaatttttgtatgttttatagagacagggtttcgccatgttgcccaggctcatcttgaactctcgagctctagggatccacctgcctcagcctcccaaagtgctgtgattataggtgttggatgagtttaaggaagcccccagcagagagtctaggcttttcaaaacgttcgctctcagccttcttcttatgaacgtggtttaaaacaaagccataaacccctcagctttttgccttagcctgtcagaataaagccttagagagtcataatactgtttgatagtaatcctttaatatgggcatctttttattgtttatacattataggttttctaaaaaattgtaatggttttcctctgtggttttgtctctgaattggggaggggctagaaatgtccagttaatcttaagacagtgccttgcatcatgaagttggaactctgaattttttttttaatcctaagatactgttttgaaaaagttacccttctagaacagtttaaagagttcagtgagcgcctttatctaggctccccagatgttgatattttgccacatttgcatgctctctcctctccatctttacacagacacacactcttttttattgaaacttttaggaatcttaaatacttcagcctgtatctcctaagaaaaagggcattcttctaggtaatataacactgaaggaatttaacatcgatacgatactattatctcatacagagtttagagtcagatttcctccattgtcctatcatgtttttttctctctctcttttaaattcaagctaattcaaggattttttattgcatttaattgtcatgactcagtttttcttgcctttcataaattgactccctgaagtttttgaaatttgctttttcagagttttgaaggttattcctaaccataagacagttccctataccgcctgttatgcattcatagatggcattagcacagctgctgtttgttcagtatgccccaccgacgtccatgaaatctttgcattgacatttactattgctttcaaggactacttgaaagcaattacttgttctaataagtaattatttcttataatagaaggattttcttttctcatgtagttaaccactctttaattttttgccatagtatgaacatataattttgtggtatatttttaacagaactaaaattttataattttctgtaaactatgatgtagaataattcacaggtgaaattaatctttaaatttcaatctcacacacctactgtgtaaaatgtgatattacaaatctcagtgaaatcaccctgaacagaaatgattattccccaagaaattagtgaaatagcagaagttcacatcttgtcttgaatctgattcaaggaacatatgcttccttgattcacggaacatatgcttccttttgttttgtttgggaaatatcttgtagccttggtgttcattgtttctactttaaggttatttgacgataacagcttttaacccccaaactatttttttccagaggtcatttctatattgtcaaaccaatttgctggtataattatagttacattcatattttgttttttgaaattagcttcatttttaataagcctgttaatcaccaatacttgggaatacatattgggagaatactactttaattaatatactagtttattcagcaaacatttaccgagtccctcttgtgtgtcaggtacagtgctggggatgccacgaataataagatacagttcttacgaagtgcgcagtctagcagggaagctgatgatgactcatagtgtagtaaatgccgtaatatcctcaaagtgaaaaggagaaaacatacagtttttccagggcctgcctcacaggaagggtactatttgtgctgtctttaaggtttataacataggttttacgaggactataaggagagagactattctaggtatttctattcagtattactgtaaaaagtccattttcaccatatgttgctatgcagtttgcctctgccatcaagcacctatggcatggagtgagcagatgcccactggctatggatagcagggacttaaggccaggagttatttcatcctttaatttaccattgcttcaaaatgttaacatctgccttaccaggagaggctgtataggctctggaatcagaccagggttagagtactagctctgttactcacctatctacgtattaaaagtgtctctgtgtgtgtgtatccttagttacctttctaaggcttagtttctctgggtataaaatggggataatacctaactcacaagatgattgttgtaatgaaacagtagataacccatgaagaacagattcttgaggccgggcatggtggctcacgcctgtgttcccagcactttgggaggccaaggcaggtggatcacctgaggtcaggagttcaagaccagcctggccaacatgacaaaaccctgtctctgctaaaaatataaaaattagctgggcgttgtggcgtgtgcctgtagtctcagctacttgggaggccgaggcggaggaatcacttgaaccagggacgcaaagttgcggtgagccaagattgcaccactgtacactccaagcctggatgacagagtgatactccatcaaaaaaaaaaaaaaaaagaaaaaagaaaagaaaagaaatggcttcaggactgcagagcttgacatgaagagttagtcagaaggatgacacccagggtgaggctgaaatcaagggtcagaaagagaatttgactgaggcaacaggatgaaacgagaggtgtcagtcttgagcaagggaggtgggaagacaggatggaaggtgggactgggacctaaggaggttctctgagatgccagggcacaggcctgggggcttttgtccaggcttgttccttgggtgggatggaagccatttagggggcctccaagtcacttcatgcacctgttatctctcagtgcccacactagtattataataaaatgggttcttccctgtgattcattatgaataatccaagtgaacagagcaagtactgctcctggctcatttccagccacttgcccctcctgctctacactctagcagcgcttgtttactgatacttaagcaaccttgggaattggaacccagtggaatctgtggcattgttgagtctctggttcttttttgttaggccctggaatgctgataagctacctcaaggctaatgagaaattagattatctcttgaacttaattgcattttcccagagttctcttagagccccccagggaaaggagaaaggaagatagtgaaagcagctgttcaggttggggcatggtgggaagggaggatctttctgcgcctatagtgtcctcagactcttcacactggtggttttgccagtcgatgtggaagggcttggaagataacatgggaattatgtaacccaccaaaccccgtgtgccttaattacaggaacactgccactgttggggaaaggggtcggggagttagatctataagatagtataaaataggtatgagtagatagaatagacatttagatgtagtgcaaccattctttaattacaagcggagtttaggtcactacttcaccagctctgtgtgaaggatcagtttttcgtttttgttttcccagtgcactgcagaccagcacttttgagaaatataaatttgccacagcaatatcaaattgctataattgtatctaaacactgttttactctctgtacttatcttattgcagattgccatggcttaggtgatacaaccgtggtgtgtgctacatgagataagaaacttctcacaaaaagcttttataaaggaagattgcacatttatctaaaagaagcgattattaaaaaaaaaaaaacaaacataccttattttgctaacttggcattttgtcaggacagcctgcatgaatgaatggtgcccttgagttgtcgaatggtggcgtgtggcagccctgcttcaggcccgtggcgtgcctgcgttctgcctccatgtatgcctgctcatattcagagcatgccatgggctctcttatctaggccttgctatagctcaccacattccctgccatcagcttccttcctctctccctccctcccttccttccttccgataccgttactattacacatcgtttgatgttgtagttgcttgttcacatgtctttttccctatgcttaacagtgaggttcataattaatggactgagaaacaaggacactctggatgaggtcaaagaaaaaatagaatgtgaagtaaagaaatgagaatgcaaggaggatgggaagatttctccaggcatgtgtgtagagcggtgtgagattcctgagtagtgtgtgctggggtaaggaccagtgtgaatatagttacagggtgagcctgctaaagggcaggctgagtgacattttattggaattaaggaagccaaaataagttgaggatgggctctcaaatgggttttcaacttggacattgactgcctacgatggtggcacattggagtgaaatgaaaactgtgagccaggtaccagtcaggaaggggcatctgtatgccgtggctctcggaggagcacagaggtttcagtgggagcaccatggagtggtccagatgccagtgtggggagccacagcgtgccctcactatctttcagatcccactgtgtgcaggaagtggtaccgtctaagagaaggagtgttcttggagaagaatcaagtttcaaccaaggcagagaaaagtcagtaatgttttataaaagaatgtgagggtgtggggaatgtgttgggaaggagggtagtaatggacagaaggaagccacagagcagcaattcatttgaggaaatatttgcaagcaattaccattgccagggactacactaggcacagcagtgaacacattatgcccttgaagtacttgcagtctagggaagcttaaggcatggggagatgaaattagggaaaagatggtggtctggagggtcttacatcttgtggatgaccaagggtgacagagcaaagaggacatagttggattgatagtttttagattataatttattcactgtaaatacttgtttaactaaactttccttaaggctaactctgttagcttcctaatgagagcgctgtaaccgtctgatacttatcttaggtacagaaggcaatatgatgtagaagtaagaggctggatttggagctgtttttaaatttaacagtcaaatattcaatgagggcctacaatgtgttgggcactgggctggacccagggcaggcagatacagtttaggatcttaggtacatcatttattagctgtgtgaccttgggcaacttacttaaatgaccttctgtaaaaccagattgtggttattctggaagagaatgcaggcaaagcttttagcatagtgtctgacacattttgagtgcaaaataaacttttatatattattagactggatttttcaaattttaacctgataaaaacaccataattttagtgtctcttctttcctcttgtaacttatcccacctaatattaattggccaaagtgcataattttgtgtatgtattacaactaactcccctaccccaaatttgggttaacttaacattgtattgttatttgtgggggagagcaaagatttctctgaaatgtaacatcctttagctttttagatgaaaacagaaaagcaacctcagtccctcatcataaactgtatttgtagactgtagttttgaaagcaaattgatccaccttttaaaaatctaaactgatattttaaacaggtgtgtgcaaatgcagtccctcccacccccaccccatcagcatcttgacccagctacttctttggagctgactactagagaatgttagtctcctctctgagagcccagcaatatattatatactaggtaatcattggataatgttttctgatattttaaaagttaatattgcaactaaaaaccaaaatacctattcaggtcttgtcttccctttaccagtaagaatcagggtcttccccttccctgcacctccccggattagttttctactttttcatgagttactaaaaccagagaacactgattttaatgttgttttacagaaaacagtaccataaaattgacaacaaattaaaatatacattaatggtacagtatattgttttcagaatagtggaaagaaggggcctttcacttgaaagacggaacagcttaaatgatagtgttgttagacgtgtttcaaggaattacaaaatgttgtgtttattgaccatcaaaaaaggtacagctgaccttttccttagatattttaaaacagaattccaagttatagctcccctttaaaaacaggtatggatactttaatatatgcattgcctaacagagtatataggctacaaatacagcaaatgcacatagcttttattcaatttttgaacagcagcttaccagacgtgctgagttttagcaggttgctgagtggtaatctgcaggagaaatggaaaacaggtttgccttaactactcttgtggctttctaaaaataaattgctactttcaagttacctatttggtattttcactttatttagattttgtggatctcaaaattttctttttataatgttgatacattaccacttacaatttacttctgaattctgtaccataaaaataatgtattttattttcatgttactttaaaaatgatattgcttcttacttgcttatatttatcattccccccatttgtgtccttagaaacatttgttttaattgctctgcttttcttaagtacatttatatgaagagagctatttaatgtattttaaatacatttcttagaattgaaagctcttcttagaataatgaaaaaatttgtaattcagaattatattttattgactaataaataagcattcatgttatattacatagacaattaattagaagttaagtgaaattaaaattttcctgtagttaaattatttttatttttatttttatttttttgagatggagtctcgctctgtcgcccaggctggagtgcagcggtgcagttggctcactgcaacctctgcctcccaggctcgagtgatcctccctctgcagcctcttgagtagttgggaccacagatgcgtgccaccaagctcagctaattttttttgtatttttggtagagacagagtttgaccatgttgtcaaggttggtcttgaactcctgagctcaaagaatccagtgcccgccttggtctcccaaagtgttgggattacagctgtgagccaccgtgcctggcataatgattgttttagaagggatcttggtgttagactgtatagttggtgagactgaagtgtcttagatggaggttgtacctgcaggagagtcacaatgtgtgtctcatctataacagagattctgaggcagaggtcattataagttttgaaggtaacctgtgagtctcaaaatgttttttatgaatttgtaattccgaggctgggtatggtggctcatgcttgtaatcccagcaatttgggaggctgaggtgagacgatcccttgaggggattgtgctactacgctccagcctgggcaacagagcgagactgtctcaaaaaaaaaaaaaaaatagagtttataattcccaaagccttccctcccctctgagggaattttatcaaggaatacatttctctaataagggaagtagctcaaatttttgaataaagattattttgattatgagtcttagtagtctaatttgcaaaaatagatgatggtgatgatgacaacaatactaattaaaatttatgcacggtcaactgtgtgtcgagtgctgtttctcaactttgctttccctgagacgacctatgagaatcactagtgcaatatttgaagggagttttcttattatctccattttacaggtatggaaactgaggcacagtttactttttatttttaatattattaatttattccttagtactgagtcaagcctagttttttcttgttgttgttgttgttttgagacagaatcttgctctgtcacccaggctggagtgcagtggcatgatctcggctcactgcaacctccgcctcctgggttcaagtgactgtcctgcctcagcgtcccaagtagctgggattacaggcgcccacaaccatgcctggctaatttttgtatatttagtggaaatggagtttcaccatattggccaggctggtctcaaactcctgacgttgtgatccacctgcctcagcctcccaaagtgctgggattacaggcgtgagccaccacgtctggccaaacctagtttttagctattttattaaatggaattatagactagtaggaccgtcacagtcttgattactttaagaccagatcatgcaagtgtttttgactattctgcaggaaatgaaatcaaaccacttctacctattttctcctgttatagtttttatcctgagtctggaagttatgttaaatatttttttgcactaaattccaataaagcagagaaaagacaattgttaggcaatttgtagtaccagcattgtttttctatacatactgttataggtgaagcatttaaattattgtgcttttttggtaacaagttttttacattttaaagttgttctttatattttaatcaattcatcattcaaagttctgtgccccaaattataaaatagttcacattttaatgcttttagcagtcaatctgagtgattcagattagttttgatctaaatttaaatgttatgttattatcttttcagctagaaatctgaaaatatcttgttgccaaccatattagtggatatatatctagaaatatgtaaagcgtagtattcatttatacaaataggaaacttatacatttttgggagtgatttgcttacagtttagttcggtttattattgctctttgtttctccctggatcagggagaaaacccttaatactgggaaaatcaatttaattcctattataatgactaccatctatatactttttttttttttttgagatggagtcttgctctgtcacccacactggagtgcagtggcgcgatcatggctcactgcaagctccgcctcccgggttcacgccattctcctgcctcaacctccccagtagctgggactacagtgcctgccaccatgcctggctaattttttttttgtattttgttagcagagacggggtttcaccgtgttagccaggatggtctcgatctcctgacctggtgatccacccgcctcggcctcccaaagtgctgggattacaggtgtgagccaccacgcccggcctatatacttttgaagtatctgcaaatcaaacagaagattaatagtacaggtatatacgtaagggagatgctaacaactgaggaagtcatgtttgcttggtttgcagaattgtgattattaaatatcatattcctttgtaattatggatcctatgaaaaataaaagatctacttgtctctgtttgtataacttggaatggatgagacctgccctctcagccatctataagcaataatgttagatgctctgtgatgatttggaagaaggtgaggagagggaggaatatacaagggaggtgggcatggatggagtgaagagtggaaggtgatgattgtaccaattttctgtgttttaatttgaaatcatctccaacttccatatattcagcaagagtaagtcaaaatacttttttggcctttttaatgatgaggtcatgtttctcactgtaaggttcaattatgaaaatttttccaaaatgtaatatttatgaatcaatctttttttatagttgtgattagtatatgcatatatgttacatcattaaaaaacttttattataaaattgataaatgcttatggtaaaaaagtgaagtagtacagaagagtataaaatgaaaacaaagggttgtgtctctacagtgttcccagtcccagtcctaaaaaatagccatacctaatagtttgttgtgtatttccttgggtgtttttatgcacatacatatttagttgaaattaaacttatatccaattttttgaacattgtctttttcacttaatagtgtattgtgttctattttccatgaccttacctctaaagctacctcttgctttttaatgacttaaagccacctcttgcttcttaatacttcttaatggtgtcctattatatgtgtgtattgaaatgtatataacaagggtatttagtttttaggtacaaatacctgcatagttttgcaagtacatctacaggatatattttttagaagtggaattgcttaatcaaagaagcatgaaatttgagcatgtgaaatttgtataggcattgtcaaattgccctctaaaacagtatgctgattcatattccaatcttaggttcaacacagtgtaaaacacttgatattacaaaattttgaaatgtctgttaatttgctagctcagttatatttcagttggcatttccttatttatgagtgaagcatagctccttttaattattgttgaccgtttatattttcttgtgtgaatttcctgttaaatttttttttctctgatttgtaagtgtacagatctgaggttcaatggctttgagttcggatttgggctttactactaactagttgtttgaccttgagagggttatttagtctgaacttcagttcattatccgtaaaatgtggtagtaagactgcccagctcataaggtatggttaattaatgagataatgaatagaaaatacttaaccgatttcttaaagtacagtgagaatatatgcttgctagtagcattactaatattagtagggtttttttttaaattaaaagtagaaattttcagaaatgtcttttttttttaagacaaactctctgttgccgaggctggagtgcagtggcatgatctcagctcacccctaggctcaagtgatgctcccacctcagcctcccacaagctgggactacaggtgtgcgccaccatgcctgggtcatttttgcatttttttgtagatatggggctttgccacattggccaggctggtcttgaactcctggggctcaagtgatctgccaagcttggcctcccagagtgctgggattaggcatgcgccccctcaccggacgaaaatgtctttatagcatccatatgataatttggtttacttcgtaaacataatgatatggtaagtttcaatagattatctaatatcgaactatccttatattcctggaatgaactctgcttggtcatagcatattgattattaattatattcttaaaatataactaacgtataacaactattgtttaacacaaattaaaacacttttaagattatgtatacttcatggctttaaaataattacagaatagttttataaaattgcagtgaaactttttcacacataggaaaatgttatatgttctattatgtgccttttaagaatgtatgcccctctgaaatagtatattattttgacagtctaagtcctcttacttaagattgattttagattgagaatctagcagaaaagtgaaataaatacatagagaacatttatgtaattcacatttaatgttttttttttcctaaaagcattttcatccatcaaatatggacttttttcttatttcctccttttaaacttgaaaagtactatattaagggcattagaaacgtggtgctgcataacataaagatatttcattttgaaaaagaacttgggttccattttgcatacaaactttaatataaatagaacctggaattccagtaagaaccactttaaataatcataatagctaccatttatttagagcttactgtgagccaggagcttttctaagtgctttacatgtattaaatcattttattatttaagtgcagctctatatgacgggcactgttactgttctaatgttaccagtaaggaaactgatccagagaggttaagtcctttcccaagcttacacagtgactgatgggcagagactggattcaaattcaggcattctctctgtaatcccagtactttgggaggctgaggcaggcggattgcatgagctcaggagttcgagagcagcctgggcaacctggtgaaaccctgtctcttttccttactttctatttctattgccaccactccagttatcacacacttagattacttatctctcttgaattagtcttcctcttcttttctcactcacctagtacatctctgccctaacatcccacatatgataaagtttatacattttaatttaatttatatattttaactcagggtcctcaggaacctacagtctcagttactctgttaaccccattttctattacaccagccacaaatgctctcatataaccaagctgtggctgcctactgtatactaaacattcattgatttacagtatgtcgtgtaattctctcatcagcttttagatactattattatttccgttttaaagaaacgaaaactgaggcacagagaaattaactggtagaaggaacccacagcttatcaggagagcagtcagagtttgaatccagtgagccactcgttggaggtgggttcttcagcatggtctttcataggggcggaaacctcgttcaggtatcctatgcagttatcttgaatcagaatctgtggggtgatttatttatctagtgagtgatgcctagcacctatttacatggtcagagaatgcctctctcaggagctgacatttcagccaaggcctgggaagtacagggtggagggtgaggggaaaggagagcattccagggaaaggagatgttgtgtgtaaaggtctggagcttattccctcatttgtcagcagtgtgaatgtttatctttttgacatcattcttacgtcttttggcagcttaagccaaatatatcaatctattttttgagatttactcctcatgtgattctcatacagttggcttttattttattttatattttattttatttcgagacactcttgctctgtttcccaggctggagtgcagtggtgtgatcttggcttattgcagtctcctcttctcgggttcagatgatcctcctgcctcagcctcttgaggagttggggctacaggcgtgtgttaccacgcccggctaatttttgtagttttagtagacccgtggttttgccatgttggccaggctggtcttgaactcctggcctcaagtgatccacctgagttggcctcccaaagtgctgggattacaggcatgagccactgcacccagccggaggtaggttttaataatcatattttgggaggccgaggtgggtggatcacctaaggtcaggagtgcgagactagcctgggcaacatggtaaaaccccgtctctactaaaaatagaaaaattacctgggcacggtggcctgtgcctgtaatctctgctactcggtaggctgaggcaggagaattgcttgaacctgggaggtggaggtttcagtgagccaagatttgccactgcactccagcctgggaaacagagcgagactccatctcaaaaacaaacaaacaaaaaaatagtcacattttacacatgagaaaaattgagattcataatacttagcaatgtgtaaaggtcatataataagtggcaggaaaaaaatggcagagatgggattatgcttcaggctctctgaattctgcgctctttcctcatactgttgatcagtcattctacatgtaaccatggataataatttatactcctcccataacagatggatttatcttcctaaccaggttctacattagtagagtttagggaccctgtttagtacttgtctccctcataaacaccaactactgcgttatatataaatggtcagtaaataaaagttgtttccatgtatcagttttgctaaagccagaggcatttcagaccatttttcctatggtaaaataaaattttgatagttaaaaagttatttgcagggtacatgcatcatttttctaaaaacaataaagctatttataaagaaataccaggcagtggttctgaaatacatggaacataaaaactaaattaaagatctaaggccaaccttacttgttttgcagatttattcatttgctcagcacaattggttggaagagaataacttcagttttgcagactatcatttacattctctactagcacagataagcagataaaacagtcatggacactcctttcagaaccacacatgatccctgagttatgtatcacccattttgtggttgtaattctattgactagtcactagcatttgaatctgtcatcttgcaaatacaactttcttatcaatgactgccctatggttttattcttagttacttttggtaactggttggattgtcttgttttccttgtcatgatctttttaaacacgtattcttaacatctgaattctctttggttgcaagtgactgcaatgtgcaaacacctttaattcaatcaagtgaaaagggggtttattgagatggcaggggtgtggttcacagaatcaccaagtcacagcaagggtaggggtgcagttggatttcagaagcaactggaacctggttttgagccctgttaggaatctctccatctcttgcctctgattctctcttgcggccagctacttgctccatatggtgaggagcatcgccactgcagttccacattttacagctgcagcaagaaagaggtggacctgacatcccctctcattcaaggcttccccaaaatcccaggaaagcattctaattagcccagctatcctggattgacctggaaattgtctcatttgcccctatggggtctgctatggcacagggctcagaaaccctgacctcacctggagctaattttgactgacccatgtcagcttatgagaactgtatctgccagctgatttttagtttagactggctgccctgaagaagccctctgtctttctttgccaaaggcagtgtctctgttggctcgctgagcttcctttccagcctaaggggacatctgcagtttactcagcatgtttgcaaatctgagaaaactgacaatccctgagcttcttctgtgagggaagctcaagtcacctgtttcaccacctgctgtgcaactgcaggtgacccgtttggatgtgtctttttctgttgagaaacattactgtttataacagaataatacttaacatagaatgacaggaaataacaatactagacaaatgtttctctttaaaagaatgggaccgttatcttgcatatcagttcttctagctactaaaggaaaaggtcccaaaaaagaaataatactttacatttacaccacaagtttttcaaagagataaagtgggaggctaaaggtcactgtcatctttcatcttatgaactgttttttgatgttattttcttcagaacattaagagcagccaaccacctggttccctcattatgcaaaattattgcattttaagatcagattggatgttatttccagaactgtaagcatttctaatttgtaagagcactggttttttttggtgcaaaaaggatcgtttttggaatgattatactgtaataactgtagaagagatagttttatatgtggttggttgtgctgtcactttagttaaattcaaaggcatttataattattcaccatttgcaagacattcatatgtgcattctatgagactgctaaaggtaagtaaggtatagcttgtgcttgagtcctagaggagctaaatgggtatgatgactctcctcccagaggagggtgcatcatgacaaatgtcacctaccctgattctactaaacctatgccacagagagcacaagcacaaaggagctgcatgcacattccactcagtgagtctgtgccctgcagtaggtggacagtgagagcctgtgaatgtgaatctgccattcctgcaggctcacttggttcctgcatgcctcccagagcatgaacatttctagggcttaaaggtatccattttgcatataacatggcgtctaaatacaagtcagcagtaacttctagtgcttacaaggaaaaggcaatcagttttaatggtggaaatgccactattttggacttcttgtagggctatgtgacagtctccagcagtggcttcctatgggattttcaagaataacctggacgatagaagatttttgcctcatatgttgtttagaatttatcacccatgtaagatgtgaatctactgaaacagaaacataaataaggtgcgttctgtgtttctatgtagaagagagtatttaatcctaactcatgtatttattttggggaaaagtgtcagggaggatgtggcatttgagcagagatttgagggaagagaaggatttttataggtgggaatgggtagtggaaggaataaatttccaattcagcaaaccatgtaagttaatatgatgttcagggaatagtgaatagtctaataaggtttggaatatgtgggctttattataggaagaagaggccctaaatataggtttggatcagattgtgggggagggtagccttgaaagccactgtcactgtaagagtttggattttattctgtatgtgatggggaaccattaagttgtgtgtgtgtgtgtgtgtgtgtgtgcgtgtgtctgtgtgtgtgtgtgtgtcacagaatgaaattagcagatgtatcattaccagaaatggtcaggatagaatcctgaagtttcaaaataggtctttatagtcctacctattcctttcatggtggtcattatccaggaagcagctgaaaggagatgatgtctttcaggggatagcggtgtttaaggattaaacactcttattgaagtgtgtgtggactaagaggaaatgagggacatagactatcagcccattgtgctgctattgcctgtatattatatatgttataaacctactaacaattcagtgttatagttgttgctttatgaaatgtgatgtcttaaggaaattaagagaagagcaaaaatttatgtttactcttttctgtttactcacatacttatttaaaatttaaaaaatttatctatgtatttttattacaattttaaacataacataaaattcacgatttttaccattcttaggtgtatggttctgtggtattaagtacattcacattgctgtgcacccattatcaccatccatccacagaactgtttaatcttcacaaactgaaactccgtacctgttaaatacttaactcctcattcccttctgttcccagccctggcagccaacattctttctgtctctttgaatttcagtactctaggtacctcatagatgaggactcatgcaatatttatcctttggtgactggcttctttcacttcgtgtaatgttttcaaggttcattcatgttgtagcgtgggtcagaatttccttcctttttaagatgatataattttctattatatgtaaatatcacatttgtttattcattcatctgttgatggacacttgggttgcttctacctttggctattgtgaataatgctgatgtgaatatggacgtacagatatctgtttgtgtctctgctttcagttcttttaggtatgtacccagaagtggacttgttgaatcatgtggtgattctgtttatttttttgaggaactgctgtgctgttttccatggtgctgcaccattttacattcccactaacagttcacaagggttccagtttctccagatctttaccaatacctgttattttggttttttgataatagccaacctaatgggtatgaagtatcttactgtgatttttacttgtctttttctaatgactttgtgatattggagaaatgtctacttaagtccagtgcccacttttttttctttttttttttattatactttaagttctagggtacatgtgtacaacgtgcagatttgttacatatgtatacatgtgccatgttggtgtgctgcacccgttaactcatcatttacattaggtatatctcctaatgctatctctcgcccctccccccaccccatgacaggccccggtgtgtgatgttttgcactctgtgtccaagtgttctcattgttcaattcccacctatgagtgagaacatgcggtgtttggttttctgtccttgcgatagtttgctcagaatgatggattccagcttcatccatgtccctacaaagggcatgaactcatccttttttatggctgcatagtattccatggtatatatgtgccacatttccttaatccagtctattactgatggacatttgggttggttccaagtctttgctattgtgaatagtgccgcaataaaacatacgtgtgcatgtgtctttatagcagcatgatttataatcctttgggtatatacccagtaatgggatggctgggtcaaatggtatttctggttctagatccttgaggaatcgccacactgtcttccacaacagttgaactagtttacagtcccaccaacagtgtaaaagtgttcctatttcttcacatcctctccagcacctgttgtttcctgactttttaatgatcgccattctaactggtgtgagatggtatctcattgtggttttgatttgcatttctctgatggccagtgatgatgaacattttttcacgtctgttggctgcataaatgtcttcttttgagaagtgtctgttcatatcctttgcctttttgatggggttttttgattttttcttgtaaatgtgtttaaattctttgtagattctggatattagccctttgtcagatgggtaggttataaaaattttctcccattctgtaggttgcctgttcactctgatggtagtttcttttgctgtgcagaagctctttagtttacttagatggcacttgtttgttttggcttttgttgccattgcttttggtgttttagtcatgaaatctttgcccatgcctatgtcctgaatggtactggctaggttttcttctaggttttttatggttttaggtctaacatgtaagtctttaatccatcttgaattaatttttgtataaggtgtaaggaagggatccactttcagctttctgcatatggctaaccagtttccccagcaccatttattaaatagggaatcctttccccatttcttgtttttctcaggtttgtcaaagatcagatggttgtagatgtgtggtattatttctgagggctctgttctgttccattgatctatatctgttttggtaacagtaccatgctgttttggttactgtggccttgtaggatagtttgaagtcaggtagcatgatgcctccagctttgttcttttgacttaggattgtcttggcaatacgggctcttttttggctccacatgaactttaaagtagttttttccaattctgtgaaggaagtcattggtagcttgattgggatggcgttgagtctgtgaattaccttgggcagtatggccattttcatgatattgattcttcctatccatgagcatgaaatgttcttccatttgcttgtgtcctcttttatttcgttgagcagtggtttgtagttctccttgaagaagtccttcacatcccttgtaagttggattcctaggtattttattctctttgaagcaattgtgaatgggagttcactcatgatttggctctctgtatgttattggtgtgtaagaatgcttgtgatttttgcacattgattttgtatcctgagagtttgctgaagttgcttatcagcttaaggagattttgggctgagacgatgtggttttctaaatataaaatcatgtcatctgcaaacagggacaatttgacttcctcttttcctaattgaataccctttatttctttctcctgcctgattgccctggccagaacttccaacactatattgaataggagtggtgagagagggcatccctgtcttgtgccagttttcaaagggaatgcttccagtttttgcccattcagtatgatattgactgtgggtttgtcctagatagctcttattattttgagatatgtcccatcagtacctagtttattgagagtttttagcacgaagggctgttaaattttgttgaaggctttttctgcatctattgagataatcatgtggtttttgtatttggttctgttcatatgatggattacgtttattgatttgcgtatgttgaaccagccttgcatcccagggatgaagcccacttgatcatggtggataagtttcttgatgtgctgctggattcagtttgcgagtatttcattgaggatttttgcatcgatgttcatcagggatattggtctaaaattccctttttttgttgtgtctctgccaggctttggtatgaggatgatgctggcctcataaaatgagttagggaggattccctcttgttctattgtttggaatagtttcagaaggaatggtaccagctcctctttgtacctctggtagaatttggctgtgaatccgtctggtcctggactctttttggttagtaggctattaattgttgcctcaatttcagagcctgttattggtctatttagggattcgactttttcctcgtttagtcctgggaggatgtatgtgtccaggaatttatccatttcttctaggttttttagttgatttgcatagaggtgtttatagtattctctgatggtagtttgtatttctgtgggatcggtggtgatatcccctttatcattttttattgcatctatttgattcttctctcttttattctttgttagtcttgctagcggtctgtcaattttgttgatcttttcaaaaaaccagctcctggattcattgattttttttttttgaagggtttttttgtgtctttatctccttcagttctgctctgatcttagttatttcttgcattctgctagcttttgaatgtgtttggtcttgcttctctagttcttttaattgtgatgttagggtgtcaattttagatctttcctgctttctcttgtgggcatgtagtgctataaatttccctctacacactgctttaaatgtgtcccagagattctggtatgtttctttgttctcattggtttcaaagaacatctttatttttgcctccatttcgttatgtgtacccagtagtcattcaggagcaggttgttcggtttccatgtagttgagtggttttgagtgagtttcttaatcctgaattctagtttgattgcactgtggtctgagagacagtttgttagaatttcagttcttttacacttgctgaggggtgctttacttgcaactatatggtcagttttgcattaagtgtgatgtggtgctgagaagaatgtatgttctgttgatttggggtggagagttctgtagatgtctactaggtctgcttggtgcagagctgagttcaattcctggatatctttgttaactttctgtctcattgatctgtctaatgttgacagtggggtgttaaagtctcccattattattgtgtgggagtctaagtctctttgtaggtcactaaggacttgctttatgaatctgggtgctcctgtattgggtgcatatacatttaggatagttagctcttgttgaattgatccctttaccattatgtaatggccttctttgtctcttttgatctttgttggtttaaagtctgttttatcagacactaggcttgcaaccccggctttttttttgttttccatttgcttggtagatcttcctccatccctttattatgaagctatgtgtatctctgcacgtgagatgggtcttgtgaatacaggacactgatgaatcttgactctttatccactttgtcagtctgtgtcttttaattggagcatttagcccatttacatttaaggttaataatgttatgtgtaaatttgatcctgtcattatgatgttagctggttattttgctcattagttgatgttagttccttcctagcgtggatggtctttacaatttggcatgtttttgcagtggctggtaccagttgttcctttccatgtttagtgcttccttcaggagctcttttagggcaggcctggtggtgacaaaatctctcagcatttgcttgtctgtaaaggattttatttctcctccacttatgaagcttagtttggctggatatgaaattctgggttgaaaattcttttctttaagaatgttgaatattggcccccattctcttctggcttgtagagtttctgccgagagatccactgttagtctgatgggcttccctttgtgggtaacccgacctttctctctggctgcccttaacattttttccttcatttcaactttggtgaatctgacagttatgtgtcttggagttgcttttctcgaggagtatctttgtggcattctctgtatttcctgaatttgagtgttagcctgccttgctaggttagggaagttctcctggataatatcctgaagagtgttttccaacttggttcctttctccccgtcactttcaggtacaacaatcagacgcagatttggtctttcacatagtcccatatttcttggaggctttgttcatttcttttcactcttttttctctaaacttgtcttctcgcttcatttcattcatttgatcttcagtcactgataccctttcttccacttgatcaaattggctactgaatcttgtgcatgcatcacgtagttcttgtgccatggttttcagctccatcaggtcatttaaggtcttctctgtactgtttattctagttagccatttgtctaatcttttttgaaggtttttagcttctttgcagtgggttcgaacatcctcctttagcttggagaagtttgttattactgattgtctgaagccgccttctctcaactcgtcaaagtcattctctttcctgctttgttctgttggtggcgaggagctgtgttcttttggaggagaagaggcgctctgatttttagaatcgttagcttttctgctctggtttctccccatctttgtggtttatctacctttggtctttgatgatggtgacgtacaaatggggttttggtgtggatgtcctttctgtttgttagttttccttctaacagtcaggaccctcagctgcaggtctgttgtagtttgctggaggtccactccagaccctgttttcctgggtatcaccagcagaggctacagaacagcaaatattgcagaacggcaaatgttgctgcctgatcctttctctggaagctttgtctcataggggcacccagctgtatgaggtgtcagttggcccctactgggaggtgtctcccagttaggctactcggggttcagggacccacttgaggaggcagtctgtccattctcagatctcaaactccgtgcccagagaaccactactctcttcaaagctgtcagacagggacatttaagtctgcagaagtttttggtgccttttgttcagctatgccctgctgccagaggtggagtctacagaggcaggcaggcctccttgagctgcggtgggctccacccagtttgagcttccaggctgctttgtttacctactcaagcctcagtaatggtggatgccccttccctagcctcgctgccgccttgcagtttgatctcagacttctgtgctagcagtgattgaggctgtgtgggtgttggaccctcctaaccaggcgcgggatataatctcctggtgtgccgtttgctaagactgttggaaaagcgcagtattagggtgggagtgtcccgattttccagatactgtctgtcatggcttcctttagctaggaatgggaattccctgaccccttgtgcttcccagttgaggcgatgccccgccctgcaccgtgggccgcacccactgtccgacaagcccaagtgagttgaacccagtacctcagttggaaatgcagaaatcacccgtcttctgcgttgctcaccctgggagctgtagactggagctgttcctattcggccatcttgcatgagaaatcttttttttttttttttgagacggagtctcactctgttgcccaggctggagtgcagtggcgcaatctcagctcactccaacctccgcctcctgggttcatgccattctccttagcctcctgagtagctgggactacaggcccccaccaccatgcctggctaattttttgtatttttagtagagacggggtttcaccatgttagccaggatggtcttgatctcctgacctcgtgatccgcccgccttggcctccgtaagtgttgggattacaggcgtgagccaccgtgcccggccagtcctgtgcccacttttaaattgggttgcttgtttttgttgttgttgttgttgagttgtaggagttctttatatagtctagatattaatcccttgtcagatacatggtttataaatattttatatcattctgtgggtcacatatttaccttttctggtgctctttatttcttcctgtagatttgagttactatctagtatcatttccttttagcctgaaagagttcctttaattccttgttaggtgcatttgctagctgcaaatactcctagtcagtgttatctatctggacatgagttcatttcactgtcctcattaaaagatagtttggctaaatagagaattcttgggcaatagttttttctattagcacttggaatataccatctcactaccttctgacttccattgtttctgatgagcagttagtaattgttttgttgttcccctgtatgaaataaatcatttctctcttactgctttgacaattttctctggttttgagtttaacagtttgattaaaatgtgtgtgggtatggatttcattgtgtttattctgtgctgaggttcattgaacttctagaatctacataaatgtttttgtaaaatttggaaagttggccattttattgtaacatttttctttgcttctctctctgtttccattttttatggaacttctattatacttaggctagtatacttgatgtctcacagatatctacgactgtctatttttattcattctttttttccgtttttcaaattgaataatttcccttaatctgtcatcaggttcctgattctttcttttgccacttcaaatctcttgagcccacctaatgagtttttcatctcagttattgtgctttttaactccagaacttgctttttttttttttagaatttctctctttattgagattctttattgagtcgtttttactctttgattgattaaacctgatttcctttagctctgtgaacatatttataatagctgccttgaaattgaaatctttgctaagtctaacaactggcccaattgtagatcatatctgttgactgcttttttctggaatatgtatcacacttcctgtttctctgcatatcttacaagtttgctgaggactggacattttagattatacattgtagcagttctggattctgatttcctccctctccaggttgttgcttatttttttttttttttttttttttgtagcttgtctactaaatctgtatgctctgtctttgccatggtatgtggctgctaatgtttctgcttttcgtttgtttgtttttatttttaaccctggcctctcaaggttagcccctgtatcttcgtgatgcagtgaccagtggttggtcagattataagggcaatgggacttgtgtgagtttgggggcatatccaaattttaggcagttttcaagtatactagcttttactttctgccaagctaactcatacctcctctaagtgcgctgtagccacctcgacagcctagagatatgtagagggctagggcactgcccagtttctccgtcctacccacactgccttccaggcagccacggatgcttggagaatttatcaagtgcctccgtgtctgcctcattttctgttaaatttctggttagttcactgcatccaggaccaagcgtcaggctctctaagcttctacccttcctgcttgtttgtcggttttttggttttgttttgtttttgcttttcttgtattctctcaatcaagttagcctcttcctgcaaagctggtagaaccaccatgctgaccaacctggtgggtgagggattgcagccctaggcaggaatgccatgggctaccactgtcctaactcaaaatcagtagctatttttatgaataaattcttaatttgttgtatgcctttggttgatttccagagccctgatcctttttttttttttttttttttccagttttgtttagtttcctcattgccttttgagatgaggactggccatgctcctcattctgctgtattgtgcttctaaagatagttttcaagtaaccaaggtgagacaggagatcaacaagactcaccagtctgctgatcagaacacgatacaaaaaattagccgggcatggtggcacgtgcctgtaatcccagctactctggaggctgaggcagagaattgcttaaacctggaggggcagaggttgcagtgagctgagattgcaccactgcactccagcctgggtgacagagcgagactccgtctcaaaaagaaaaaaataacagctagaactaggaattataatatatttgcataagatactccaaccagcaccaagacagtttacaaatgatgccatggcaatgatctggaagttaccttatatggttctgggaactccccaccccttttctagaaagtttgtgaataatttagcatataattaagagtgggtataaatacagctatccttgcaggttgctttgggccactctgcctgtgggatggccctgctctgtctatggagcagccatttggctatacgctgttgctctaataaatttggtttctttcactgtcagcttgctcttgaattgtttcttgagcaaagccaagagccctcccagagtttcttgagcaaagccaagaaccccccaattttggggttcaccagcattattaggttttcctcattttcatcaagaatatatttataaaggaagaaaagatttttttgtttgtttgtttgagacagagcctcgctctgtcacccaggctggaatgcagtggcaccatctcagctcattgcaacctctgcctccggggttcaggtgattctctggcctcagcctcctgagtagctgggattacaggcgcccgccaccatgcctagctaatttttgtatttttagtggagatggggtttcaccatgttgcccaggtgggtcttgaacttctgacctcaggtgatctgcccgcctcagcctcccaaagtgttgggattacaggtgtgagccaccatgctcagctgaaagaaatagtttttcaaaatatattactgcatagctcccttaaacattcatatctccaaaaaagagataattataaaattctctgaaatgttcatatttcaaacataagaagggattaaaacaaaaatgttttcttgctaataatcagtcttttaaatgtatctaatcgcttttcaaaattttaaaatttaatactttctaaaaatatgcaacttctgtaattatcagaatcaaggcactaaaatttcttgggaaataggaaaaaatttcattaacaatgttatagtaaaactgagaaccttatttctaataaaaattaaaacattcacttaaaaaggaatattgagccaacgtctacctcactcttgtaataatatagtttcctctatacctttgatgtaggcaaaccccagggttctaccagttttgctgcaagaggaaactgatttgattgagagaacacaagaaaagcacacacatacacacaaatacagcccctgcccagcagcaccattggttacagtgacctgggtgacggacatgcaggaagtctagaagctcagatagcctgaggctgggtcctggctgccgcaaacagaccagcaaactaaccagaaatttaacaggaagtgagacagtcacagaggcacttgataaactctacaagcctccatgacgtgtaattgttatgacatgtaattgtcccaaggtagacttactggctttttctatcggtagagtggtggtggccataggttgcaagcatcctggcctcccagctgccacctggtctagctgtttaaagaagtaagccagtggtctaggattcttcctgaatctttcagttagaacacccaaagctattccttgtttttcagccacataaagattgctggatcaatccattaggaatgcctgttagcaggttctgtctcaatttaaaggctcctgattattcccttttagagcttcatagagtggttttgctatgagcccaaacctgggaatccaaatctggcagaatccagccattttccccacaatgtttttttcttttttttttcttctctttttttgagacggagtctcgcacttttggtccaggctggagtgcagtggcacgatctcggcttactgcaacctccgcctcctgggctcaagcagttctcctgcctcagcctcccaagtagctaggactacagctgcatgccaccatgcccggcaaatttttttttgtattttagtagagatggggtttcactgtgttgtccaggctggcctcgaactcctgagctcaggcagttcacctgcctctgcctcccaaagtgctgggattacaggcatgagccactatgcctgccctcctcgcctcaaaaaaattcctaattgtttcttagtttcaaggggctggagtgccagaatgaattcttttcattcctgggctaagtccttgtcccaagggtgagaatgtatcccatgtatttaactttttgaatagaaatttgggcctcgttgggggggtatactcaataccctcatttccccacaaaattaaggacctgtattgtatttttttcagagtcctccctagtaacgctgaaaattaatatggtcattcacatgttgtaggaaggatccatttattaagctgtagttaccttatttcttttgccaatgcattttcaaataaatgaggattatccctaaaaccttgagggaggacagtccaggtaaactgaaatgtagcaagagtgtctgcattagtccattcaaaagcaaaagtatactggaaatatagtgggagtctgggtgcaaatgtgtgctaaagaaagtaccccttaagtctaataccacgaatcagttatcattttcaggggtcaatattgtgtaagaattaggagctattggagctattaggagctagtaggagtccttgtataaggactgggagtactgcttcattaactgccctcagttcctaaattaatctctgttccccatttgatttacttatgggcaaaatagggatgttacgtgggtactgacagggccagttagtactttaaagtctatactttaaaagctttactgtcatgggttgtgggccccattgtgtttctggtctcaaaaattattgtttttttccgtggtaaccaacattgagttttaaacaaaactggactggggttacattagcagctctaccgggaacttccatgtctgaaacagaggactacttgagaagtgatatgcagtggaagagaggtcttttctttacctgtatgaaggcaagcacttagagctagaagtagtattcctgcctggcctattgcatttttatgaggctctcctaattgaactgtggcctgtaagtgggaacataagtctcttcccagtaaaggaataggacacttaggcataagcaagaacctgtggaaaaatgtgtggtcccgcatggtacaaccaaaggagtatgtgaatctcctaatttttggctggttgtcaatcccagttatggtacaagactgtaaagacagtatccctgagaaatgggtcagcactgagaaggctgctcccttgtctagtaagaactcagtatccttgcctgctacatcaagggctatctgaggctcctctgtggagatggtaaggtgtcattgggagctctggggaaccttggggcctatcagtcctctattctcttggccattatgggtttgggtggcctttggagcctggggtagtcccttttccagtggccctcttagtgacagtaggcacactgattctggttacaggaccagcaagtcaggggctcttgtctgggcattccagacactgatcttgcaacacttcctcgagatggataaccctgaggcagaagagtgcttaaggcagttgtgaacgattgtactttttggctatttcttttgtgtgtgttttttctgcctgctttgcctgtccctatttttgtaaactccaaaggccatgtttaagagttagctcatggggggttgaggtcctatttttgcctattgtagcttcctcctaatgtcaggagcagattgagtgataaaatgcataccagggatagctcaccctttcggggaatctgggtctacattagtgtatttcctgagtgcctcaaccaaacagccctggaacagagagggattttattcttctcctgagttacttctctaaccttgtcataatttactagcctaaccacacacttttccataccttttgttaaacaagttgccacgtgatttctgcatttaaggtcttgggaacccctctggtaatcccactgaaggtctggatctggaactgcatcgcaccccacaagaaaaatggctcggccttggttatgagtggccactccatctacatattcatggacagtacccagaatcatttgtttatcctctaccatacatcagatggacaataatatttgcaactcatgtcaagttaagtcgaaagacttggccaacttaataaactcctatataaacttctctggatcctccaaaaactgaccaaatttctcctttgcataaagccaaatcacacatagaaaaaggtacatgtttgtggactctccctccatctccatcagctacctcctgcaagggatgcaggtttgatttggggggctgatgtgaggtcccactcctggtggcactggttggattcacttccttgggcagtcgggggtataggctgaggctagctgtaaaagccggaggggtgtttggtgactttgggggtagaatcttacactggagacctggcaggacccccctcagaatcaagggaccgagggggctcccaggggagagagtgtggcccttctaggtggagtggctagaaggagataatctaggatatctggtgtggcttcttggtgcctggaagtaacatgagctagacacatcctacagttgtcccttaagtcaagatcctgataaaatgccataaaagcctgcacataaggggcctctcctcatttttcctcctttttacagaataagtccaattgtaaaatagtatcataatgtaaagaaccatttttaggttgggtgcggtggctcacgcctgtaatcccatcattttgggaggccgaggtgggtggatcacctgaggtcaggagttcgagaccagcctggccaacatggtgaaaccccgtctctactaaacatacaaaaattagccaggcatggtggtgggcacctgtaatcccagctactcgggaggctgaggcaggagaatcacttgaacctgggaggtggaggttgtagtgagccgacatggcgccattgcgctccagcctgggcgacagagtgagactccatctcaaaaaaaaaaagccatttttaggccaaatttcttggtttcccaatttgtattggacccaagtggtgttgctaaactaaagaaaattagtttctttttaagcgatttaatttgactttgcttcagttgcctaaaaagcaccctagcaatgagtcctctgggatgcttcccgttgtccccctaacagggatctctgctagacagtagtacaaatgccatcaattcctgagagcctaagtacagttagggtgtgaagaaagtcaattatgaggtatgaatgggtagtgaagtgatcactctatccagcagcaagcagaatatgacaaaagaggtgttttttttaagacagagtctcgctctgtcaccaggctggagtgcagtggtgcgatcttggctcactgtagcctctgcctcctgggttcaagcaattctccggcctcagcctcctgagtagctgggactataggtgcgcgccaccatgcccagctaatttttgtattcttagtagagacggggttttaccacgttggccaggatggtctccatctcttgacctcgggatctgcctgccttggcctcccaaagtgttgggattacaggcgtgagatgctgtgcccggccaagagatgttttaataagcaaagtgtagaaggataggtaaagtagggtgacaggattctcatagtctgaattccaaaaaaagcacagaaagaggaggctgaaaatgatcagtatgacaaagaccaacaaccctaacagggtgccaaatgctgaaaaacctggaacatgaaatgccaaaaaacccagagcatccaggagttggcccatcatgaaccccaaaggcacgagacctaacacagttggggccactggacaacgtgactctggcatcccaaagttagcacaacagaggacttctgaaaattaccaaaagaggattcaaaacagactaggaaagtgtcccgacttacatagaatagaaacagttgctcagatagccaaagcaaagacaacagatgtgaaagaaaacaaaataagcattagaataaaacagccatttattagagactaaagagacaaaaagatttgagagaaagcgtgacaaggacatggcaggcgtgctcctgtctgggacacccaaatgataggggataatgaactaccaagccagaggccttgttccctcttcttggttcacccaaaaagatcaatgtcaagggggaacagaggggagactcacctgtccttcgaagccatatggtgttgattggtcttaaattggcatctgggtgaaggtttccctcagttttgcttagattattagtcaccaggaatgatgattggctctaaaaagagcctttggctcctgtacagctctacagccttatagagttagagctccatagtgttatagctccagagccccaatttttactgagcccctttgtcatgttcatcttgttcagtgttgtttattccttcatggttgccaggctgatacaagtgaaccccagaattggggctcaccctgggagagttcttggctttgctcaggaaacaattcaagaaaagcaagttcttacagcaacagtgtccagccaaatgactgctccatagacagagcagagctatcccagagcagagtgggcagagtggctcatagcagcccttgtggattgctggctagctatatttatacccacttttaattacatgctaaataaggggtgagttattcatgaactttctagaaaaggggtgaggagttcccagaaccatgtaaggtaacctccaggtcattgctgtggcatcatttgtaaactgttgtggtgctggtgggaatgtcttatgcaaatgaactataattcctagtcctagctggtttgggctggtctctttactacatcatagtttttgtttttgttttcattttgtttttttaagagacaggttttcactttgttgcccaggctggtgtgcagtgacatgatcttggctcactgcagccttgacctcctgggctcaagcagtcttcccacctcaggctcccaagtagctgggactacaggcaggcaccaccacactcagctaatttttttttttttttttaagagatgaggtctcactatgttgcctagactggtctcaaacacctggactcaagcagtccttccacctcagcctcctaaattgtggaactacagacatgagccactgtgcttggcctacattctgttttgatcagcagtgtcatgaaaacaagccctgttaatctcctatcttactagcaaggtgaagaaatagaaaaataagaatatcataatcatactaccgaggaatagctaccatacaaactttggtgtctatcctaccagaattttttcatggatattttctgtaggttcaaactatgcatctatattgaaactctcttaaaaaaaatagtaaaagttggtgaacaatttccaatgtcattagatactcctgtaaaacataatttttaggaggggcagagcaagatgactgaatagaagcctcaaccagttgttcctcccccaccccacggaaggacattattgaacaactatccaaaagaaacaccttcataagaaccaaaatcaggtgagcactcacagtacctgttttaactctatagaactgaaatggccactgaggagggtaggagacagtcttgggttaccagcaccacccctccaccatcctccagcagtggccgcatggtgcagagagataatccatgtgcttgggagacagagagagtgtagcagttgtgagacattatatcgcactcagtaatgccctgtcacagcaagaagcaaaagcaaactaactcagctgatgcctgcccacagaaggaatatttaaaccagccctagctagaggagaattgcccatcccaacagttggaaagttccggcaagcctcaccaccttgggctaaagtgctctggggccgtaaataaacttgaaaaacagtctaggccacaaagacttgaactcctaggcaaatcctagtgctgatgtgggctcagagccattggactggagaggcacgcgagttactgagacactgggatggctaagggaatgctggcatcaccctttccacaaccccaggcttcatagcttgcagctccaattgagacccttttcttctgcttgaagagaggagagggaaaagtaaagaggactttgtcttgcatctttgataccagctcagccacagtagggtagggtggtacccgttagagccacgaggccctcttcccaggccctcattcctggacgatacttctagacatacccagggccagaagggaacctactgccttgaagggaaggacccagtactggcaggacccatcacctgcagactaaagagctttgggccctgaataaccagcagcaatactcaggtagtacactgtggaccttgggtgagtctttgagacttgctggcttcaggtgagactttacacattaccagctgtggtggctacagggagagacttccttttgcttgcgaaaagcagagggaaaagtaaaggggactggatcttgcaccttaggtactagctcagccacagaggggtagaggactaagtgggcttttggggtccccaattctaggacttgactcattgatgacttttctggacttgccctaggccagaggggagcccactgcccaaagggagcatcccacgctaggcacccttcatcataagcgactgaagagccctccctaagggaacatcagcagtagcctggcagtacgccccataggtctatagtggtggtggccacagggtgaggttcctctgcttaaggaaaggggagagaagagtgggaaggactgtctcagtgccagctcagccacagtacagtagaacaccaagtagacttctaagatttttgactgtagtccctggcttgctgatggcacctctggatctgcctggggcttgggagctcgccaccatgaagggaaggacacaagcctggctgacttcacttcctgctgattgtagagccccagggccttgagtgaacataggccatagccaggtggtagtcacagcaggccttgggtgagatcccagtgccagcttctggtctgaccaagtgcagtcccagtggtggtggtcacatctccaggcagctcaaaacacagagagagtctctgtgtttgtttgggagaaaataggggaagagaacaagagtctctgcctggtaatccagatagttcttccagatcttatctaaaacataatttttaaatgactacatagatatcagtagtatatatgaatatttattttaatttttttgttgggaatttagatatctctttttaaactgtcatttattcagatcaaattacttgatgagcacttacggaattgggcatgaagaatttcaagacttttaataacatttctaaactgacccctctgttcccacttccacccccaatttagaatttcaccagtagtatgtaaaaaagtctattctaaactctgcatcctggccaggtgaggtggctcatgccagtaatcgtagcatgtttggaggtcaaggcaggaggattgcttgagccgaggaattcatgaccagcctaagcaatatagcaagagcctcctctaccaaaaaaaaaaaaaaaaaaaaaaaaagccaggaacagtcgtgtgctcctgtagtcctagttacttgggaggctaaggcaggaggacagcctgagcccaggagtttgaggctgcagtgagctatgattgcaccattgcactccaccctgggtgacagagcaagactgtgtctctaaaaaaaaaaaaaaaaaaaaaaaaaagaaccaaaaaccaaactaggcatcctctctaattaatactgacttttatcaagaaacaagtaagtttgctaatttaatagacttaaaatgcttaattattagtttatatttcttgtctgttattgtctttatatcacatcatttttctttttaatttaaaggttcatttaaatttatcatttatcatctcacaaatcttgatttaagtcttgatctgaagaaatgaaagttaaaaaagaagaaatctaaatttccaacaaaaaaacacaaattaaaataaatatccatatattattactgattcctatgcagccacttaaaaattgttttacaggagtacctaataatataggaaaatgtttaccaaatcttatttttatttttttaaagcagactttataagacaaatgtgtagtttgaactcacagaaaataacgcgtgaaaaaaaggctgatgagttcccctttacaaaatggaaatggaacttttcaagaagaaatgcttattacgttttttacatggatttatttcttttgcctttaattaatgaaaaaaaccagtctgaattgtattgttttgtaaatatgtgttctatattttgaatctttggatattgatttgcattgctgtatcacaatttgcttatatttaatagcatcaataatttttttagacttctgataatcagtagagaggcttgattgaaatatgttcccctaaagcccatatttgatagttttattactaaatttagaagccagtaattaaactattttcttataattatggctatattttagttcaaattgctcatcctaaagccatcaggtcaaatgatacttgttctgaaaatatattaataaattgggaaggattccgtaatatttctgttcctataattctctgatacgtgtatgctaggcagcattcatctcaaaaacagtaaataaaactactcagaagctttaagtaactttagctttactatatctgaaagacaaaattgtattctggtaaatgtagctatatcattcattatcagttagtatttatatttagatgaatgtgattcaaggtctcaggccaaaataaatgccaagagatgatcgtattatctaaacaattagagcattggcacaaattcttgggaagctgttgactttttaaccaaagtgttaggattctgtttttatttcaccttggcattttaatttcttaaaattcataatgttcatcaactgcaatgcttagaaatccttaccagaccattttcagcaaagtacaaatatagtttctattacagttctgtcctctagtacaagttgatccacttactctctgctgcttgatagttctagagaacagcattgaggaattctgatgattagtcgcaaacaacattgactttaaaaaatggatagtttcccaaacatattatcctccgaattattcttctcgctctttttattatatctgtttatcttattcttagtcatttgtgaggttttattttttgtcttaaagaaaatttactttaaatagagaatttgtaaaataccgtggattacatgcacctgtcttttcttgggttagtcttgtatctttatctaaggaacactgggagctagaggggaccactgttccattgtgaaagagtgaaggtttgtatggtgtttcctctattgtcagaatcgcacgggctactcatgatgtatgaacagtagaattaagtagaatatttgagcctatcctgttctggactcatcctcttagaaacgttctttgttgataggattcctttgataaaccgattgaatgctctgtcctcttaattgtgccatgctataaataagtcagttattaaaagaaatggttgatgttttatagactgaatgcatacttgtagagcatgttgtagaaagatactttattgaggttagttccagtgattgagtacacatacttaagtttttaactctttggaacccaagagtagaataaaaaattatttacaaaacgtatgtcggttctgacatagggtattgtttttcctttggaggcatttttgaagaaaaaaaaattacacattacaaaaaccagattaaagagtttggcatgtacagctgtgtgtgtgtgtgtgtgtgtgtgtgtgtgtgtgtgtgtgtgtgtgtttgagactaagtcttgctctgttgcccaggctggagtgcagtggcaccatctcggctcactgcaacctccgcttcctgggttcaagtgattcttgtgccttagcctcctaagtagctgggattacaggcacgcaccaccatgcccggttaatttttttttttttttttttttcttggagagggcatttcgccatattggccaggctggtcttgaactcctgactttaggtgatacacctgccttggcctcctaaagtgctgggattactgacgtgagccaccatgcctggccagcatgtacagttttaatgagaggaaaataccaaatgaagagcaaatttttatttgtttgaaggtctcaattgctgcttatttatgtatttcagcaatacccttcccaatagtgtcctgaacttgatgtttacttgtggggtgtgaatgttaattaattatacagtcccttaaagagtagtggtatacatgtaaaggaaaatctttttagaaacataaaaacataaaaaggaattagtaaatttggagttttattctaaatactgctgttaaagggctacaaaaaataatgggcttataatgaatcatggcaatttagtcaaatatttaaaatatctaaaatgtttatgagacagcagaatattttatagtagaagtaataggaaaaaaattttacagaaattttttaggaatagtaattacatgtctgggatggtttagaacctacctaaataaaggtaaaaaatacagttttatagagaactagaaagtggtttgtgaatggctaattcttaaagctccattgataaccttggggagaggcagaacatcctagattaaatagaaattgtgtttctgttatttcatcaagacagggttatacagttaagtatcttggctaaaatctttatagtaaaattttgctgacatgaacatcgctggtctgggaattaaatattcacttaagtactatttcatgaacagtgccagaatttctgccagaaaggtaaaagatatatttatattgcgttttttatagctgaaatgtagcctgtaaccgagtggattatagtaacttaatattttgatgcaggaagtaggaaaatattaaaaattgaaaggtggttttaaggaaattgtaatggttctgttcagagtttatgagacagccttattctgtagacttttaaattatgaacttcccacctatttttatgtaaatggtgatgtcagtttcagcctttcctccatttgccttaagccagagaaagagagagggagagagagaataagagagagagaaacaccttgtgttggggccatcaaatggtttttttgatagtcatcagtggtattcacaaaattctggttttcttgccttctgaggttgtagtaacacttgcacttccccatcttgctgaagttaggactgaccatataacttgtctaatgcaatgtgatatatattccttattggcagaagagacatctgtcacttctaggcagaagctttagggactggtggccttccaaattgcagaggctccattagcctgcagccttcagtaaggaagtggaaccaagtactcactctcctgaggtggacatattatgtgaccaagaaatacactcatgttattttgagtcactgagattatggcagtgtttgtaactgttgtgtaagccagtctaatctgacatatgcagtatgcaatttctttatgcctaaggttaaggaagaagataataacgtttctcaccgactaaagtgaccatttatttcttcggtcatttttgttaacatttactgtgtgccagtcactgttctaggtgctaggaaaatagagggaacaaaacaaagcaatctcttcttcccactctttgttaattctttagggaacctcctttgctgtgaagcctttccctgccctctgagctaccggttgctcctttctcgtctgtgttcctccggcactttgtagatatcgtcattgtggcactgatgttatcatgatcattctatttctgtcttgatttctagactgtttctataaatgttttaaatatagtacatatataatattgaaagtaatataaaatgtgtaggcaaaacaagttacacattatataaaatgtataacagaagaatatgtatacatacacatagatgctttgcattatccctttattccctttatgtcatcccccacatttcaaaaaaatattttttgaatgaataaataaggcttcctgtgggtcttttaggcaaatgtgatttgggaacaaaatgtgaacttctatattttgggcatgttcttccaatgcctttgctctgtgaattcaaatttaagagcattactaatggatgagaacaggtctataccaaattacctgggcagaaatgtgaatgaacaggggcgggggaagcctattaacttgtcattgtgcctcttccctttacttagctatatatatacatatatatatatacacacatatatatatatgtgtgtgtgtgtatatatatgtgtatatgtatgtgtgtatatatatgtgtgtgtgtgtgtatatatatatatatgtgtatatatataattgttatacccttttaccagtgtttctcaatcttttttccattatcatcccctacccccagtctttttggactgttgccccctaaatgcccccaatgagattttactgccacagaaataccgtatatctgtttatgtattgaacgtatatctgtgctttataaaaaaatacagtaagtctttttgccccctaagaacgagttttcttggttgatgcatgccttcaactaatatttgaaaaaggtaatttttttttcctttgtaggagggcgtttccccttcaataagctaagtttaactctactgagtcacaactctgttatttaatacacctgtgcttttgtaacagctttattttaagctaattattatttaaataagtatgctaaaatcttagtttattgagaacattggcaaattaacttttatatattttatggaagtcaatttttctagattgaaggcctctaaaccacgcattctgtgcaaactgtatttgccttttattccttcagcatatacttactgagcgtctagagtgtgcaagactctgccagagctgaggacccagtgaatcgtggagttcagtctgcttcctttaactccttgctagccaggatgcgaatatgggtcatgtatacttgtctagtgcagagtcgttttgaccatactgatttttaaaacatcaacaacaaaatgttgtgggcttttagtgaaaaatcctggaagttgaataatccctcatctatcattctttatgtatagcacatgaaaaggttgagggccaagtcccacaatatgcgaagtcagtatagttggtattttcctgttctgtcctgcaagttgtgaccattgtctggctacaccagtgcacattactctatctgcaatgtgggaatctgcttaaattcttgggccattctgtataaccagtgtagtatatacatatatgcacaacaaaacagggaaacctcaatataagattcacttaaagaataagattctggttctcaccactgttgaattgccaaacaaaaaggatgaagtatatagtttcaagctaaatttcagattgcgtaggaggcatggggcaaatatgtttcagaaagaacacaagggagtacaggttatctggaggctttggtttgagtgcccatccagagatagagccattcattcatttatttgttacagaaatatttactgacctcctaatctttgtgccaggaattttggtgagtaagacaaaaggctctcattttcactcatcctctctgtccccatttcttggacaaattgtgtaggacattttaacattgagcaagttttcattcattcattcattcattcattcaatgtgtgtttgagtgtgtataatacaagtacattattgtgagatatttaaaaaagacatctctgccctcaaggaccttgcaagcttgtttgttcatcaaccagtcatttatttaaaaaaaaaaaagcattgagctagtaggcaatgtgccaagtcagtgctagggaaatacagagatgaacaagagcacacagtcggttcctggagggctgcgtctcagcctggagaggcaaacagcttgtaacatctttggaagcatgcagtgtggtaaatgacaataatgagctcgtcccactgtattgcgagagtgcaaaggatgagcacagaagtggagtttccagaattagttctgtgtgggtgaaaggtcaagatgtgactctccatctgactttttagttgaggctggagagaagggttggcttggaaaggagattggagggagttcaatcagaagaaacagtttaagtgttgataaggagctttataaggcacgatgacagctttacagaactgcaaatactttattttgatttggctgcagaaggtgggggtagatgaattctaatgtagtgaaacaattgcaacaggaatgccaagaactaagtccttgtagtactggcacaatgtatagttcagtgaaacagcccagaaacagacaaacacactatgtgataaagtgggtatcacaaatcaacagggtgttaagtaataatattgagacaattgataaactctttggaaaaatagtagattcttactccagatgatttttaattaggacttaggggctaggcacttagaaatttgagaattaggattgatttctgtgaattaaaatttaagatcaacagtaatggatcagagggtgggggtgtgtgtatgtgtaaaacaagttaatcttaaccaaatatcttgcctactgcctactgcctactgcaccacctcgttgaatgtgtcaatcctgtgaacatggccagcttcatgggccctgcactcacgagggccgtgcatttggtttaatgctctgctcttgttgtcctttggaaagtcttaatttttgaagatggggcccatatatggtggtttttgtttcgttttgttttgttttgtttttgcactgggccatacaaattatgtagcattcctgcctatgaagttggccatctctggggacagaaagttagagagccaagctttagaagtagatatccttgtgttctctggagagtcgcagccaacccagttaaagtgtcccagacacattggcagggccatccctattgagtgcctcaggctatccagcctgattccctgaaacattcaatttatttaacaaagtttcctacttcccatttcctgctcaccaagcaatctttcaatagtgacttggctgcttctttggttttccagcagggagagatctagctagttgtgctggtcccatccttcattcaggaaggtagttactaaattggcaatctggtttcatatgtcagtgaggttctttaatgtgagcctgcttctgcatgactggtccattcctgttacgtttctgagactgaaggctgaagtccaggaattacgcgggtaaattcaccaaagcagtcatgtgtagaatagtggttaagagcaagagctttggagtcaagacacacaatcctggataaaacgtgggtcctgtcacttactaggatgtatgtatgatcttggctttcctgtgccctagtctttcatctgtcaagtgatgacattaacacctaccttaaggttgttgtgaggttgaatgagatgatgtactttagatcagggtttcttagcctcggtactgttgacattttgggccaggtaattctttctgttcagggcggggtgttcggtgcatcatagaatgcttccagcatccctggcctgtacccagtagatgctagtggcatccctctaaccccctatagttgtgacaattaaaatgtcacagaggtggaatcacctctggttagtacttggttaagagtcactggttaagagtctcttggttaagagtcactggttcaggtgtttagagtggtgcctgggggaaagaaaatgttttatgatataataataataatgggaatagtggtaccaaagatgatactacttttgatgccaccctgagggacctaggaagacattcgtcagcctttcatttattctttgtccttaaatttttatatctatgccagaataaactccatgtagattaaatagtacatgtaaaaagctctacctttaaacaactgaatgaaaaagaagtaaatcttcagatttgcaaataaggaaagggttttcaaggtcaaaagcagtgatacttctgtgatgtttaatgttgggtttaaaacacattggggaattttctttcctcatagatatcatgacattaaaaataaatatgcataatctataaaaactttgtagttacaattgaaaagcaaattggataaaatgattgtgagtaatatgacagataaagtggtatgaaaaaactaatttaagtcaaaaagaaaaccaaatatttcctatagataaggacaaaggaggaaatacaaccatcctataaacatttgctatggcttaaaatctttgtcaatttaaataaataatttaaaatttttttaaatattattaaattcaaactatttaataattttttaaaaaattttaaattatttatttaaattgacaaagattttaagcaatagcatccaattctgttgtacagttaggggggtcttattacatattttttgtcggacaatcgataggtacaatccttctagaaagaaacatggtgataaatgtgccctaaaaatggtcatacaatttagcccctgcaaataactttgggaataatgcttacagcataatctgaaatatagacaaatatcgatgcatgaaggtgtttactgcaaagttgttttaatataagccagctaaatgttcagtattagagaagtagttatttacggcatataataatctgcaatccttaaatgataatctttacacagtgtttctaatgacatgcaaaattcttacagtgttaaatgaaaaaagtaggtttttaagttgcatatgcaatgtaaactcaacccagaaaaaagactggaaggaaatacccaaaacgttaatatttgtcgctgaagtacgcaaaatgttaatatttgttccataatatttagattatggataatttgtgaaagttagtcacaactatatgattaaattcatcatttcatggcagacagccttttcttttgtttctgttcctttaggtaatgtttagatatcatgccttggaaatgaaaatgaaaaggtttaagctatgtttctctaaataggagaaataaaaaagaaagtgtcaatgccctaaaatacagctttatttttaagtaaattataaattgcaatatgaaaccaattttggggggtagactgcttctcctggttgaggtgaattaatggttttttataccgtggtactctttttgttcattaagtgttaacgatgtactcattgtagtatggtttttgatgaaacaatctttaagatgttcatttttgtttttatagtatgtgcagaagcttataatcctgatgaagaagaagatgatgcagagtccagggtatgtaatttactgaatgaatgaattttaaattgatgcccttgtcatatataaggaaaataatcatagaaaagatttaacaggcatgtaggttaacaggagacataatggaattattttgactgtttcttttcctagtctcatctccaatagcctactcctgctgtgagtcttgcagaattatttttatccagagagtatttctctttacaaaatgtatcctggtgatgaaaagtgttttcagctgtctttctcatagtgataatattatttttcttagacagtgtttttagtaaacaaaaatactgggaaagaccttctacgcctattaatttataacaacggaaagttactctgaaacaaacaaatcacggtaaaatcacatccagtgtgtcagtacagcagttaggattattttttaaatctgtgagtcttcatagtttgctcagcagctgacttcttgcaggccctaatgtttttgtaagaatttgtccactgtgatttcagcagtttttaagctatgtctttcagctcagttctactatttatttagtaaaaagtaaactaaaagatgactatgcctggaaatggaaagtagtaatttctgcatcaccctccccccctttttttgagtacatgtgttgcaaaagtgcctcttgtttctttggccttaaacagtataaacaaaaacttatttttgtagctctgaaaagtacataagtaagattgaggtttcatgtggagaagcagctactacgtccctaagtcgttacatcattaagctccttgaaacttatgtaaaatccagtggtatcaggaggcttacaacgtggaagatcttgaaatctcattttattcctggacccatggggattcccactaccagggttgtggaagctcatttctcactattagaacttcagttcttttcatgaagtttataaatcctagcctggaaatgatgttgttttaggattaaggtatttttactaatctgtgatgtgctgttacccctctgtatagtctgaaaaactagaccttgcctaccgtatactttatgtatctagcagaaacaataccgggtggcaatgaagacaacatgcttctttatatttgtgtataaatgagtatgataaaatttagtaattgagatcagagcaatcgagatgagctggtttaaattaataaaaacctaaattaatgaacatttgcaatacagtttaaaaacaatatgcagtatctcattgattcaaaagctgttaggccttgaattttagctgccatttaattgatgaggtaaataaagtgttttggcaggttcactccagctaatttctaatagttttgttggggaggctataccagttaagattcatttgactgtgtaaaacctcaccctatggagacaaatgtgaaaaagaaaacactggggagagattatcagacaaatgcttggagatcatattgaactgcagaaagcgttcaaaggccaagctgtaggcctggcaggcaggagccagcccgcctctggtgtccatcaagagcaagagtgtaagacttagcgtagtgtctttgaaacgggttcagctacccatctctattactgtgtctctcagttcaaaattccaatttccaaagagtttctgatggacccagctttggcccagggtagggccagggtcaaaaagtccaacctacttgggaaccacttctgtaaataagggcagttactagaggaggaggaatctttgtggggtgtgtatttaccctaagatctgtcccctgtaacaccttttaaagttatatttaatagtttttttgttaatgtattatatgtttgattatagcaaagtacttttaggttatcaattaggttgagtattctctcctctaaatgtgttactaaaaactatacttactttagtctcaacaactatgaagcaaaccataccacatgcttgggaatgattattacagatttcaaaattatttagatgtagaaggatattgggaaatatctatgaggaaaatgtatactatattgtgataaaattacatttcatttggacattttgtattacttctgagactcaccaaatcagtaagtctgtagtataaacagaaatttatcgtctgatatgaattcaaagaaaatgtaaatacttaagactcattttggaaaataacagattttagttggaatgcctttaataaatgaaaatgtaagggttatctagatctagcatgtagaaactggtagagaagagctaataagggtagagtatttcttatgtttctccacaaaaattttttggagttccacctgtatatctggcctggtgctaggtgtaaagtggtgagcaaatggacaagtctctgccctcttggagcttacagtctagtggcagaagcagacaagtgaataaattagtgaaaagttaaaaaacatgaagtgctaaagaaacagtgaaacagtgtaggaatcaaaacacagcccccaagcctctgggtcaagtgattctcatgcctcagcctcccgagtagctgggactacaggcatgcaccaccacatacctggctaatttctgtatttttagtagagatggggtttcgccctgttggccaggctggtcttgaactcctggcctcaagtgatccactcaccttggcctcccaaactgttaggattactggcgtgagccactgtgcctgaccgatatacagtgttctttaaagaaaatgtctaagttaaaaccttacttgttaactgtttttctaattttttttttttaatggaaaggcagcagaaatttagagcagaagttggcaaactttttttggtaaatttttttttaactgaaaaatgcactattttcagagagtaaatattttaggctttggggagtcatggggtctcctttgcaactactcagttctgctatagtagcttgaaagcagctgtaggtaatacatcaatgaaaggcatgtctgttgggttacattaaaactttatgacgcttgaatttgaatttaatatagattttatgtgtcaggaaatattatcatttgtttgattttttttcccccagtcattaaaaaaatgtaaaattattcttagcctagaggccatacatacaaaaacagctttgcctgcaggtgtagtttgctgatccctggtttagaatatagactctgtagctggcctggctggcatgaattctggctctgcaccttgtggactggatgacattggacaagtgatttgggcaagttgatttccttaactctaaatttcttaacctgcttcatgggatctgtcactaggataaaatgagttaatattagtaaagcccttagaatagtacctggcatgtatttatgctatgtttgtttaacaaataaaatttttatctgaaatcaggaatgaattttaatgaaaaccaaagtggcctctagtacactaaaatcacactttgggtgtattgctgaggcctcagtgatccagagagagatcccttaggtgggatcatgctaagccccagaggaaaaatgtaggagagcatcttcagagcaggtggctgcagtacagaggagctggagtgtcagagaccacacccgctttctggctgtttactttccccagtgaagagggattttaccgacgaggttaattacagagagtggactctgagtgctgaggagtaatggcagggtgagggaaaagggaaacaggaggagagcagtagaccatagtgatggaggtggggctgagaaaaaaaatactacttagaaatggtgattgggctgggtgcagcggctcatgcctgtaatcttagcagtttgggaggccaaggcgggtggatcatgaggtcaggagtttgagaccagcctggccaagatggtgaaaccctgtctctaataaaaatacaaaaattagctgggcacagtggcaggcacttgtaatcccagctactcaggaggctgaggcaggagagtcgcttgaacccaggaggcaaaggttgtagggaaccgagtgcaccaccactgcactttagcctgggtgacagagcaagactgtgtcttaaaaaaaaaaaaaaaaaaaaaagaggccaggcgcgctggctcacgcctgtaatcccagtactttgggaggctgaactgggcaaatcacgaggtcaggacatcaagaccatcctggctaacatggtgaaaacccgtctctactaaaaatacaaaatacaaaatacaaaaaaaaaaaaaaaaaaccaaagccaggcgtggtggcaggcacctgtagtcccagctactcaggaggctgaggcaggagaatggcgtgaacccgggaggcggagattgcagtgagctgagatcgcaccactacactccagcctgggcaacagagtgagaatctgtctcaaaaaaaaaaaaaaaaaaaaaaagtcgtcattggtacgagaggtagcaggaagaagagagaagaggaaaaagctggatttctgtgtgaaggcttataggaattgaatgggttggagagaaagacataaagttgaccagagcgaagcaggtgcacgatactgatgcctgatgcactctcctctcccccctttcctttctgagaacagcttctcagcaggcagacatctcggttgctttggtttgaagttctagatggattttgtgaagtgagaaatgactttctgttttgttttagtgtgttagccttccttatttgaagtaggaggaagtgaagtttggttggtgtggtttggttaatacctgaattttaaaggtttcttatgcagcagtgaatgagaagtccctgggatctactttgtctgtgtttgtgtgtcatcttagaatctagtttgagatgaatattgggcagatagtaaacaaaggtttacatctaccttacccttagaggggaaagtgcagtgaccctttctcttactagctagtagttctttcatgtagtctttacataatgcaaataaatggtatatatatcaatagtttacatataaatagtttagcaatactataagtttccccaattcttttcaggcttataattttcattaatttttagccatctgatgtggtttgaaatgctgatttaaatttcccattgtgagttttgatgtttgtggctataaactccactgctgcctgattctgtgagctctgatgctctgatggtagggcaggctgcctgaagaggcaaggtacctgcccatcagctcttgtggtcactctttgagtgagcattggaataggaaagggtggtgtgtaggtcttcaggaaaaccaactccgtgtctgctgcttttaggactaccccttgcccctctaactcattttatagttacaaactgttcatgttcacaaaagagtggaccttttggtccaagtcagttgagcctcctgctagtgaaaagggactcgagagatagcaagccacacttacacacacggcattctgccactcttcacactctagaatacaagtttagtgagaatatagcacactagtttccttgagttccttctgaaatcagtgcaccagccagcctccttggactctttttccctggaacacatattctcttggagtggcagtgcatgattgtttgctcccttctaaaaatcacttgctcgctgtggggcaggtacataccacatgtgtaaaaatatattcggcatctaatgccatatacatttaaacattttacttctttccagggaccttatcaagattcaaaagaaagaattacatcctgaaagagtattaaactcagtagaaacagaatgacagcagtccaaattttcagtgtagctgctggcacctgttgtccttttgtacgggtccccactggctgggagctttggaatcttcctagccagtcacagttgtgtgcataatgaacttgctaacctaggggaaaatatgcttttgaaaaacatttcagtgctatattgatgaatggataccaacctcccccgaacaaggtgaattatgttcccctacttggtaggctcataagttaccagtcaccaaaagtgaatctcagcaccaacctgaagcaaacttgagcgctaacagttcttctttctaatgttggttctgatttttgttagtttttaaaatctctttgagtgagatggtattggctaatgtctttgttttttaaatctgatgtccttttagattatacatccaaaaactgatgatcaaagaaataggttgcaagaggcttgcaaagacatcctgctgtttaagaatctggatccggtaagataaatcttaataatagaaatggctttgttttttcccccagtgacagtgtcaagaactgtacagggtcttgagttttgccctctttgtaagctgacatcaccctggggtgatggtaaaggcccccttgcggatgcttgaatgcacagtaggttgaactgcaggagaggaatattgagtttgggggaatatactgctgttggagcaagaagtaaagaagcctgaggtgtttgtcctgtggaagatattctctcatctctcaagatgttatctcagggctacaaaaacagccctgagaaatggcacaggtaaaaagatggtaggaacttgccctcttcgtacccatcaggaatatgcagggatgctcagggcccatggaggattgtttctctttacagccagtggtagtaattatatttgaatgtgtataaactcattatctgtgtattatacagattaaaagtaatatttcacttggctttaaggtgaggttttttttttttttttttttggtcctttataaggatttggaaatctctaatttttgggttcggtatttctagaatacccactcttggtatgagtgcacgtgctgttcagactttgtcttgcactgtgatgtacatattctgcttccttcatctcagattatgcttagtcattgctgtatagttatttaggagtgaacctctgctgccatattccaaatgtgaaaatagagtcaacttttgtaacttacctcgacttttttatttggtcaaactcaacatcttcaagtttttggtgatgccctagaggagaagcattaaatcaatacctgctctttttaaaatgaggtcttcttaaaaaggacgtttttataaagattcatgtactgcatcataccagttatatactgcgtcatatttacagtctgaaatattttaaaaatctcttttgtttctagtgtaatttatgtttatattacgtcttccagaacacagtacattgtgtgactttggagatttatgttaggcccacacattacgagtttgtatgtccatctctgagtctccattactggctttgataggcctaaatttgaccagacccaggatccatcagtcacttcatctgtccattgtctgagggcaggaactgtgtcttttgtatctttgcatcactctgtaagtagcagatggctcacggccctgtacgcgcactaggctctcaaaagaaaacatgggactgagacaagaatgctttaagttatccttttgttacaggaaagaggtcctcatccagaccccaagagagggttcttggatctcgcacaaaaatgaattcagggtgagtctgtaaagtgaaaacaagtttattaagaaagtgaaggaataaaacaatggctactccatagacagagcagccccgagagctgctggttgcccatttttatggttatttcttgatgatatgctaaacaaggggtggattattcatgcctcccctttttagatcatatagggtaacttcctgacattgccatggcatttgtaaactgtcatggttctggtgggagtgtggcagtgaggatgaccagaggtcactctcgtcaccatctcgactttggtgggttttggctggcttcttgactgcaacctgttttatcagcaagatctttatgacctgtatcttgtgctgaccttcagtctcatcctgtgacttagaatgccttaaccatctgggaatgcagcccagtaggtttcagccttattttacccagctcctattcaagatggagttgctctggttcatgcacctcggacacttttatagttatctaagtatacatatttaatcctaaataatagttttggatagatttgtaataaaatgatggtgtttaagtaatatctaattcaagtcttgttaaaagttatgccgggccgggcgtggtggctcatgcctgtaatcccagcactttgggaggccgaggtgggtggatcacgaggttaggagatcgagcccatcctggctaacatggtgaaacactgtctctactaaaaaaatacaaaaaagttagccgggcgtggtggcgggcgcctgtagtcccagctactagggaggctgaggcaggagaatggcatgaacccaggaggtggaggagtttgcagtgacctgagatcacaccactgcactccagcctgggcaacagagcgagactctgtctcaaaaaaaataaaaataaaataaaaaataaaaaaaagttatgccaaacccttgaacatagttacagtctcatggtatgaattcagtagttcagagtggccctgatagatccttgtccattcaagtttgtttgctcagttcattcaatccacgtttgccgagtaccatcacttaccagcagtgggagttagtgctgaggaagcaaagacctggttcagtaccctgagttgatatcaaagctagcctatggatcccatgttctctaaggcaaggaccaatgtagtatttaactcttttgctccggaggcacacagaaggcagtggtaaaattaatccttacttttacacttagaggtaggctttattcaagaagtctgtattttttgactagaactttacatgggagaatttcagaggtcaccaaaaacagtgctctcaagctttaatatgctgatgtatcatcaggggatcttgttaaaatgcagatttggattctcatggtctggagtggagcctgaaaagtctgcatttctcacaagctcccaggtaatgttgatgttcttggcccacaacatactttgaataccaaagactagagctagatgtgaaaatgttcaagttcagtatttggttactgttacatgtgttatgtttgcatgctttcctattcaatgaaccagtattttaatgcttcagcggggactaagtcgtgaaattctggtgtctgtagggttaagtgacacacaggcataaatcgttgctaattatgctttcctgggatgttgtctcttctgttctgtcttctaaattaattgatcttccttgccatttcaactttagctctttaaaagcattgtgaaaattttggttgcattttaaattattaatatttaagaaagcttttgctaatacagtctggcaaggagcatctttgcttagtgtgattattttgtaaacataagagttcttttagactttttttcactgctttgctgaaggtcaatatgtattttaaaaaccaacacatagagggaaaaaacatccagtttctgaattgtcatgatcgaatgttttatagagaagaagcaaatgtatatacatagtagttttcagaagaccttttttttgaatttgagctcagaccaccttgaatgactcccttactatttaaatccttccagagatgatataggatataagtaagtaaaatttatttttctcagcaaattaccacctggaataagacatttagcccaaaacatggcagattagaggttttagtttaagctcatattgtaaagtagctttctagttttttatgatacacattatttacaataacccaaatgtgttttaattgaattacatattcagcttatataatctgcttatcatgcagctcctttcattttaatttcttgactactatgtttcaagacctgtttaaagtgttggaggccacaaagatatttagagatggttgttgtccttttggaatttatagtttaatgagagtacaaacacatctgcaaagcatgttgggaaaacatgatatattgctgtaatatggtcagggcatggtgagaagatgtctgtctcttagcttaccctaacagttcagaaagctggaaaggtcactgagctgtgccctctgaaaatgaggagggaatcaccaggtgaggaaaagtacagaatgttatcactagagcctaaagtggcaaccatccagtgatggatggcctccatctagtgatgggagtgatggagctaagatgtggatgctttatcaggaaggcccattctttctcgaatgctatgctgtggcactggactgccttgtaggcagtgggcacagctgaagagttttagtcagagaatgtaactatcagatttatctaaggtcactttggtggtaatgtcgaagatggagttaaagaggggagaaaaacaggggaagcagacaagaacaaaagagtgaagcccagtaagaaaacgaggtcatgatctagggaagagaaatgggcctgaactccagggaagggggaaagggacagacagaaaagaatggtttcacaaaaaagggttaacagaacttggtacttggtgattgatttagttggggactgaaggaaagaatctaggatggctcccagtgtctagctggagtgactgcgaagttgccaccttttcctgaaatgggaaaacttgaaggaggaaggggaaactaattagtaattagcaagaagaatgatcttggctttgtgtctactatttcatttgaatttcccgaagtcattatttagcttgaaaatcttacacttcctagacttcagaaaatttttccttagagagctgtatattcatatgttgagcacagcatttataattattaatctctttgaagatattcttttcatgaatattttaatgctccactcagtaggccattttcctcctgaaatatttctaatttgaggctaactgaaataattttcttaggctatatgataggctctttcattaatgaagagtaaattgttatttcttaagtgagtcagagccctttactgagctcagtcttgaattggcattctgtaggagaattagatgtggatttcctacagtagttgtcagttatcatgataagcctctgcatattaaatatttcctaagttcttttcactctgtgcataattatggggaaattacattttgattgactagaacagacacctgtctgtattttatcaggaattgccttttcatatatccgtgtatgaattcttcagttttataatgttttcaaatgcagctaattccaacatcacaaaatagttactatagcaatttatttcatcttttttccccatttgacatttagagtcagaactaatcaataaagctgatgttcaccctctacctgccttaaaaaagtcaatatataaatagcaagcaaaacaatatattagtaaatcatttaatcaacctttagaattttgattggtgaccatatgttgcctgagttgatgaactcatttgggtagaatggtccctgtggggccaattagcactacatcacgaaagggctgtttcactgctaccttggcttcatcttcaaccttggctgctgttccacaaaaagatgccagagctcacacagggacccaaggaggggacgaaaactgcttcctgcaaacccatcaccatcattcttccaaaagtttttcttagcctatatgaagatgtaaaattatgttctcagtttaattagagtttttttagttaattaaaaaatataaatcagtatacatgtaaaattgacaaacattcaaaaagaacaaaagagtagtcagtgaaaggaaatctccttttcacctttgcctctcagaaacccagtttctcaggaactatgttcttttagtactatcttgtatatttttgcagggtcatgcaatgcacatacaaatatattctttttcaaattttggtggcagcagaatagacatactgttatgccctgtttttttttgttgttgttgttgttttttgagagtctcgctctgttgcccaggttggagtgtagtggcacgatcatggctcactgcaacctccgcctcctgggttcaagtgattcttgtacctcagccttctgagtagctgggactacaggtgtgcaccaccatggccagctaatttttgtatttttagtagacatggagtttgactatgttggccaggctggtctggaattcttggcctcaagtgatctgcctgcctcagcctcccaaagtgctgggattataggtgtgagctaccgtgcctggcctgccttgttcttttcaaatttaacaatatattagtatttatagaggttccatattctttttaaaaaatattttcatcagcattgtttatacaagtttaaactattagcttttatgtattataaagctaaatcatgataacacattaatgttttgctgttgccactatgttataattgtacatataacagcagattccaagtaatcaaaacaatatttaaaaagaagaacaaagttgcaggattcacatttcctaattttacaacttactgaaaagctatggtaatcaaaaccatatactgggctcgggtagacatatagaacaattgaatagaattgagaatctaaaaataaacctatatacttatggccaattgattttcccacaagagtgttaagaccattcaatagaaaaagaatagtttcttcaacaaatagtgctgaatccctggatatccacacacaaaacaacaaagctagactcctttgcatatacaagaattaattcagaagggatcaaaagccaaagatataagagcttaaaccataaaactcttggaagaaaacataggagtaagtctttatggtcttagatttagcattggactcttagacaccaaaagcataagcagaaaagaaaaaagataaataggacttcacacagatgtaacatttttgtacatcaaaggacattattttaaaaagtgaagacagtctgcagaagataaaattatttgccaatcatatatctgataaagatctagtatccaaaatatataaataacacaactcaacaataaaaagacaaaaattccaatttagaaatgggcaaagtgcttgaatatacaaatgactggcaatcaaaaaattttcaacgtggttagtcgttagagaaatacaaatcaaaactacaatgaaataccacttcatccccaccggggtagttacaattttaaaaaaggaaaataaagtgattaattttatgttatgtgaatttcacctcaacaaatttgtagttccctctcaccactccttttcaacatagtgctgaaagtcctggctaatgcaataagacaagaaagtgtagtaaaatgtattgagaaggaagaaatatacctgtctttgttcacagatgacatgattatctaagtagaaaatgggaaaggcttccagagctagtaagtgattataacaaggttgcaggatacaaggttaatatacaaaagttaatcactttcctttatatcagcagtgaacaagtggaatttgaaattaaaaatacaataccatttatattaacatccccccaaaatgaaatatttagatgtaaatctaacaaaaatatgtataagatcaatgtgaggaaaactatcaaatttgaaggaaatcagggaagaatttaataaatgaagagatttccatgttcatggataggaagacccactattgtcaagatgtcagtttttcccaagttgatctgtagattcaatgcagtcccaacaaacggatcctaaagtttggagaggcaaaagacctaggagagctaacacaatattgaaggaaaagaacaaagttaaagtactaatactaactgacttcaagacttagtataaagtgacaataatcaagacagtatagtattggcaaaagaatgtacaaattaatcagtggaacagaacagagaacccggtaacagccccacttaaatgcagttaactgatctttgacagaagagaaaaggtaacacaatgaagtaaagatggtcttttcaacaaatggtgctggaaaaactaggtatctgaaaaatgaatctagaaatggacattttatttttcacaaaaattaactcaaaatagatcacagatataaatgtaaaacacaaaactgtaaaattcctaggcgataacatgggagaaaatctagatgaccttggatttggtgataactttttagatgtaacaccaaaggcacatccatgaaagaattgataagctggacttcattaaaattaaaaatttctttgctgcaaaagacactgtgagcagaatgaaaagacaggctcagactgggaggaaatatttgcaaaagacacagctgataaaggactgttatccaaaatatacaaagaactcaacagtagtaaaccatcagattaaaaaattggaccaaagatgttaacagacacctcactgaagaagatatacaaatggcacacaagcatatgaaaagatgctccacatcacatgtcatcagggaaatgcaacttaaaacagcaatgagatagtactacacatctattagaatggccaaaatttgaaacactgacaacaccaaatgctggtgaacataggtggttcaacaactcattgctgatgagaatgcaaaatgcaaaatgttacagccactttagaagattgtttagtggtgtcttttacaactaaacatactcttaccatcctctccagtagtcatgctccttggtatttacccaaaggagttgaaaacttaggtccacacagaaacctgtacacaggtatttgtagcagctttattcaaaattgccaaaacttggaagcaaccaagatgttgttcagtatgtgaatggataaataaactggtacatctagacagtggacaaaatgagtgatctagttatgaaaagacatggaagacatggaagaaccttaaatgcataatactaagtgaaagaagccaatgtggaaaggctatgtgctgcatgattccaactatttaacgttctggaaaaggcaaaattatttgcaaggcagcccttgtcaccgctagacagctctcattcctaggcaggtctttatattctgccaaaacctccatgaaacttccacccaacagtcccagttatggcctctagaactactgatgtcatggtttgaacagaagataactggtgtattctcatataggtcttttctgtcacctaaacgccttgtttcctgaaattccctcattgcaggttttcacatttcttgattacccttctttgagtgttctctcgctgccagtgactcctttgaaagacagatgtctgaaaatccctacatgcctacaacagcagagctttttggtgaatggatatatgacagcttatttatccagtgccctgttgataaactgttagtttgtttccagtcttctgctattgtgatgcaaagaaaaatggtgatgcattttataaatatctatatagtaacttcctagaaaaggaacagtgaggtggaagatcatgcatatctaaaattttattaaattttgacaaatggcttttttagagtttgttccattttaccttctcaccggaagtctgtgtgagaatgcctcttttcccacacggtctccaacacagtgtgatattctaacatttgtatctttttgaatctggcgagtgaaaagtggcatctcatttcgattttaatttggatttctcttcattttcagagaagttgagtaacttttcatgtttttaagaatcctcctttctcttttctggaagctttgcagatcttttatctttagtgttctaaaaatacattatttcatcctagtgtggggatttatggtcattgactgtgctgggcacttgagtgtgcccttttggtctgaaaacctgtgttttcagaccaaaattttctttgggtctagaaaattcatcctgtattgtttatatttcctcctttttgttttctcttttactgtctctggcactcctttcttttcatctctttattgactttttttgaggtgtttggttttaatttttttaactcttttatttacctttaaaaaaattgtaatggtggatacatgtctttacacatttgtcaaacccatagaatgtacaacaccaatagcaaaccctaatataaactatggactttgaatgataataatgtcagtatagattcagcagttgtaacaaatatgccactccagtggaggatgtttatcttgggggagtctgtgtcatgtgttggggtagaggatatgtggagtatgtctatactttctgattaatgttcctatgagcttaaaactgctctaaaaaattctattttattttttatttttgagacagagtctcattctgttgcccaggctggagtgcagtgtaacagtcatggctcactgcagcctcaacctcccaggctcaagcaatcctccaatcttggcctctcctgagtagctgagactactcatttttttgagacagagtctcactctgttgccaggctggagtgcagtggtgtgatcatggctcactgcagcctcaacctcccaggctcaagcaatcctccaatctcagcctctcctgagtagctgagactactcattttttttgagacagagtctcactctgttgcccaggctggagcgcagtggtgcgatcatggctcactgaagcctcaacctcccaggctcaagcagtcctccgacctcggcctcctgagtagctgagacgacaagtgtgcaccaccatgcccagcttattttttttggtagagacggggttttgccatgttgcccaggctggtctcacactcctgggctgaagcaatctgcctgccttggcctcccaaagtgctgggattacagccatgagccactgaaccctgccaaaaaaaatctattttaaagaaaaaaaaatgacaatcatatttttaatttccaagctacccatttttctctgatttgctcttttcctaacatcctatttttttttggtctcatggatataatatcatcttaaatgtctctgcaaaagctctctacagttcctgaaatatctatctcatgtgttgtcattttgctgtttatcttagtcttgtaggctaccaggggagcaacataaagctgatttagagctctgagtaagtagggcaggcctgtcaaccagtgcactgtttagcttgagctgacagggagccagctgttacattggggaacccctaagtcctaccaaatgaaggtttttgttctagggcaccagtgttcacagtatctgttctagttctaatttgtttagtttctctctaatcttttgtctgggaggagttgagggtccacatttggctgctaggcattctgtattagggtagagggattttgaaggaaggtgtcaactaatctctgcaggactttaaatcagtccgcttgtctttagctttgtgtctcagtcccatgctggcagaaccagatgttacccactttggaccctcttggtgctctgcaaggcatgttggcccctccacactgcagtctcacctgtgcgacttggggcagctctctctgccacttgttacttaccttcgccctgaaactctctcatccatcagttgtcccttcctgtactctatactattgtagattcatatcttcatatgccttgtaacattttcatgcggtctcaaaagggagagaatcacatgtgatctgttatcctctttattcagaatatcttgtttcttcaacctgtgttttccacttgcatcttttttcccctttgaatctatcttcaactctttagtttatgtataatagtaattgattttggcatgggcagttagcattataccttttgtatgcccataaggagtgacctgaccaagggctcagagctaataagtagcagaacaaataaccctctaaatctttagacttttccattgtattgtattatttcctcatatccatttattctgtcttttcaaagttctttgaattattcctgtatttgttctgattaaagatttctttcacctcctagtttattctcatcagtttgaagtttatccttgagccttgtcaatcacactttgacagaataaaaattttacatagtttaattagttgttgaatagtatttttgatgtttctgacaaatctgccctagtgagctcagtggatgcagcttgaagccaaccttaatgacagtgaatagtgacagaatatttgccacagtcatttttgttttactttgttgtttttcttttttgttctgttttgattttggtgctaaaccaaaaagaagattggaatcaggatctaaattcaccaagtatttaggttatctgtacacaaattttagtgatgactaatataaggaagtttttaaaaatgggtatctttaaaagaaatttgaaataattccttactaacctgatcctttttagttgctaagattatatttcacaaggtatatggtggtttggtggttaaattttcattttaaagtggtgatagttgcaaatattctaaaatagactaattataattactttcattcaaatactgaatgtgagagtatataatcatcttatttgtatgtggtaagaaagactactatgtatttttctgacaacatttagtggtagttatgattatttccatttctttggacttgttcacagaaatataactgtggttacttaagaaaacatgttctagataaacataaagattatatcccatcttttttaaaaataggagcagatgtctcaagtattagatgccatgtttgaaaaattggtcaaagatggggagcatgtaattgatcaaggtgacgatggtgacaacttttatgtaattgataggtaagttttgcccaaccttactattgaaattgaaagaaccttttgtataaaatctcaaccattattacggcaactgacaggttaatataggatagttgttattgccgctactcttattattacataataggcactgtaaacctgttgtgagtacatgcagtgaaaccacagtggatcatgaaaagagacatagtttatagaggaactaatgacttttggttagtctaatctgtaaatgtcagtcatttaacatgagcatcttcatttgctgaattctaattgagagatattatgtagtagtattagtatgtactagatgcctgttacagtgagaacagcagtataatataacatctgagatattaattcacagtagacctcaattggtatttcttaaaaggttctttttttataaactgtgtaaaacatgctcatggtttaaaaaattcaaaattggcggagtgtggcggctcaggcctgcaatctcagcactttgggaagccgaggccagtggatcacttgaggtcaggagttcaagaccagcctgaccaacatggtgaaaccccgtctctactaaatacaaaaaaaattagccaggtgtggtggtgcacacctgtaatcccagctacttgggaggctgagacacgagaattgcttgaacccggcaggtggaggttgcagtgagccgatactgcaccatttgcactacaacctgggcaacaagagtgaaactctgtctcaaataataataacaataaataaataaaaataggaaatgcaaatatttcacaggggcataaggtgaaaagtctttcttcctactgctttaacatcatccagtccacataagtaagtagtttgtgcatccttccaagaattgtatattattatatttgtcttaaaaaaactctataattatttaaagaagtcttgcatttatgttgaaaatctgttttcaggaaatttaagttgtgctttacctcatcatagaacaatatgccttatgcaatagatgaatcctgaaatctaacagcagagcagcctgagctgagtccttatttcttcacttttgtaaaacaatgataagtgttcatgagacaattggcatccctgacccctccccttgtgtgtggaacgcaggtcctctcccagcctgacttactgggttacgtttgctctctgggctgggttgtgttcacctcagaggtcttggtgaaaatgacctctttggtctcctgaagcctcatttcgttattttggctctgtgggtggtatctttcatgcgtcagtcgagcatgctgtttaaatcaagagttgtcactgattctcccattccctcatcccaaattcctggtgacctgtggctgaagcactagccaggattttagaatagaataaaccagttatctatatgtgaatcaaagtaatgatttttatatcattaatagctatcatcactgaaacacctcagaaatgcacctaagtgtgtttaattgtagaggtgtatgagaagccctaaccctctatgatcttaaccatttagtggggatttttgactttcaaaactgccttacatttgtatatagtgtattcccttttcagttagatcctagtcacccatttggtagatgagaacatgcaggcccacagaagtgacagcacttggttcagatcacccaaatgactggcgtagagccaactccacagccaggtctcctgccctgttcatgttctttctggaggttcttgcctgccggaggccttgcattatcagagaagaagtctgtgtgaaaaaaacagcccaagattttttgtttgttttttttttttaaacagtcttgctctgttgcccaggctggagtgcagtggtgcgatctcgacccactgcaacctctgcctcccagtttcaagcgattctcctgcctcagcctgcggagtagctgggactacaggtacccgccaccacacccagctaatttttgtattttcagtagagacaaggtatcaccatgttggtcgggctggtctcgaactcctgccttcaggtaatccgcctgccttggcttcccaaagtggtgggtttacaggtgtaagtcagtgtgcctggcctagcctgcggtattttaacagattttagactgatgtgatttcaactggactgatagctcattttacttctcctcggcacatttggctttgttttaccctattcaaagtagccgagtgtagagaacagtttcagcgcaaaagtataaatagtgtaaatcgaagagtttaatctgtacagcattgctagtctgaaaatctgaaattctccaaactccaaagcattttgagcatcaacatgatggcacaagtggaaattccacacctgacctcatgtgatggtttacagtcaaaatgcaggcacacaacagcttattcagcatccccgaaggggttagtgtacgaggtacagtaactttaatcagaatatagcattgtaggtggagactgcaagcctgccattgtttgtggttgctcttgtttggcagctggtgcaggtattctggggatgctactatgctgcttagttgccccaaacacattagtttttactgtgttaatggtatgtcttattttttactgttaagtacttatgtgtgaatacaagtaaaaaatgatggcttattggtagcatataaattcagagtcaggaatgatggtaatgctgaacaaccacagattgtccacatgggtggttgagataatgacacctttgctttctggtggttcaatgtacacaaatttggtttcatgtacaaaattacccaaaatattaaataaaattatattgaggctgtgtgtataaggtatatatgaaacataaactgattttgtatttagacttgggtctcattcccaagatacctcattctatatatgcaaatattctaaaatctgaaaatatctaaaatctataacacttctggtcccaagaattttggatgagggaaactaaccctgtacttgaaaaatgattatccatgggacaaattctagtagtttcccttgaaacagtcattctatccgtgaatgacattgaaaaccaattcttttcttatttatttatttatttatttatttatttatttatttatttatttatttttgaggcggagtcttgctcttgttgcccaggctggagtgcagtggcgcaatctcagctcactgcacccactgtcctcctgggttcaggtgattcttcttcctcaacctcccgagtagctgggattacaggtgactgccaccacgcctggctaatttttttgtatttttagtagagacggggtttcaccatgttggccaggctggtctcaaactcctgaccttgtgatctgcccaccttggcctcctaaagttctgggattacaggcgtgaaccactgtgcctggccatgaaagccaattattttcttctgtctatcatgtttctgctgttattgcttctttattattaataatccttttctttcttttttggaggggcagggagagtgtctcactttcttgcctaggctcgagtgcagtggtgcagtcacagctcactgcagccttgaactcctgggcccaagcgatcctcttgcctcagccttccaagtagctaggagtacaggcatgtgccaccatacttgactaattttttggttttttgtagagacagagtcttgctatgttgcccaggctggtcttgaactcctggattcaaatcctcccaccttggcctcccaaaacattggaattacaggcatgaggtaccaggcctggcccataataattttctaatgttaaaagccacttttttttttttttttttttttttagcagcacgtccccactctttgtctgtgttagggtttagtcaacagaataaagccaaagaattttttctatctgccctcacaggtgcaagccttgaaagcatgttctctgataaaatacagtatgcggaaagtcagtcatccacacaaagaatgcagtttacgtgaatatagggtctgggtaataggaagtgcagtgacatgcaaactgaaccttatttgcctagaaaaagaaccccagttaaaagataagcaccaaaaaactataaaaagaccagagttagatatctagtctgaatttctactttttaactttagaatgggggttgatctaaagtaaagggccagagagtaaatatttttggctttgcaggccaatatgttctctgttgtaactactcaactctgcagttgtagcataaaaccagccatagataacacataaacaaacaagagtgtttatattgcagtgaaactttatttacaaaagcagatagccagtttgtgggctatagtttgccaacgtctgctatagattataaaggaccctagtaagttttgtagagtagtggctaaccaaattgctatagctagattctttttaaaaagttattttcttctgatcacaaaagtaataatatgttcatgttacaaacagaaactcttaaattagatagcgaatatgcctagaatccctcactattcttatgcttttagataactacagtcagtgatttgataaatgtttcttcagatgattttctttctttttttaaggttaattttttatagagatgggatcttgctatgttgcccaggctggtcttgaactcctaggctcaagtgatcctcttaccttggacttccaaattgctggaattacagatgtaagtaagccaccacacccagcctcttcagatgatttttttttttttttttttttttgagttggagttttgctcttgtcacccaggctggagtgcagtggcacaatctcggctcactgcaacctccgtctcccaggttcaagtgattctcctgcctcagcctcccgagtagctgagattatgggatcccgccatcacacccggctaatattttgtatttttaatagagacagggtttcaccatgttggccaggctggtctcaaactcctaacctcaggtgatccacccgcctcagcctcccaaagtgctgtgattacaggtgtgagacctggcctctccagatggttttttatgcatatactatttggttgtagtctttagttatagttttatcattccttattcaaaatttttattgtttagtcccatttttcccagcaggcacatggtctggaacagatggcacagattgattcccctttattgtcatcggaggggataacaggctggaaataagatttttatttcacagggctcttttctgaaataatgttttattttaatgatattttatttgaattaacctccaatctacatatgtccaacagaggcacatttgatatttatgtgaaatgtgatggtgttggaagatgtgttggtaactatgataatcgtgggagtttcggcgaactggccttaatgtacaatacacccagagcagctacaatcactgctacctctcctggtgctctgtggggtttggtgagtaaaatacttatttgacctgaatgttatgatttgtagcaactgctatgacggtgttacaaattgccgcatgtagtattttaatttaaagatcatcagtcatcaggtaatttattaagcagccactgaatgctgaactgtagggcactaagactgcactaagtcagatcctgatgtcattgcccccactcctccagtccagtcaggagcttgggacctggtggcccaggaaagacactcagattcagaatgctcctgtcttacccactcttagaaaataaccagccatacaaacacagccttaagtactttttctcagatagctttctgaggtaagtattataatctgataaagtggtggctcccagagtgtggtcccctgaacactggcagctgtatcacttgggaactttttagaaatgcccattctggggccccacccactgattctgacctactgcatcagaaattcggagtttgagaaaccagtataaaaggatgctcttggtgctataaattgattggtaactactctgcatttaaaagcagttgtgtagggaaaaaatgcttggtggctgtgctcatgtgccccacatcagaattacctggagtatcttttaaaatcctcttacctagccacgaggtcaggagatcgagaccacggtgaaaccccgtctctactaaaaatacaaaaaattagccgggcacggtcgtgggtgcctgtagtcccagctactcaggaggctgaggcaggagaatggcatgaacccgggaggcggagcttgcagtgaagctgagattgcaccactgcactccagcctgggcgacagagcgagactctgtctcaaaaaaaatcctcttacctagacctcaccatgggcaaattgatcagaatcttcagcactgggacctgagcattagtacttttaaatacatttcttaatgtggtattcccgcaagacttaaaagctggtttaaagatacattcgggcaatattttcacatatgataggatgcaaattattaggcactactaaagctccttctggaggattgtatttaaggtagtgattctcaaactttaatatgcttacaaatcacctgggaatccagttaaaatgcagattctgattcagtggttctggggtgaggcccgtgatttttgcatttctcatcagctcccaggagatggcagtactgcctgatgtcaggccaaaccttaaacagcatcgatttagggaaatgtttacagtatatgtattttcttttaaaattgttgaaaatagcccacccactagttttgacatgcatttattgggttatttctctcaaatccttttgtggaaagagaagaggttgaagtaaatatgaagtctgttaaaagtctcatttccaaggactactgtatatagcattgtggaagtcacacattatttagtcacagttcagcatttgactctgaagtcaattcagctgataaaaaatatctcttgatcaaagagacaagacattttacatttcttttaattggaaccagttattatatacttatttaaaaatgtgatgagtcacttttttaaggtttagaggaaaagctgaattgtctcaggaaaaggaaagaactgtcagtgatttgaatacccaaagccagcaaagaaaaaacttcaaaccaggacagtccttcacccacagaagtctttgtctgcctgtcattaaagtggtgggataaatctagcatctgccatgacctgttttattcaggaaggtttacttttcaaatgtagtcattccaatggggttgccgttcagattcagattgtcagattgtcacacagtgaggaaactgcctccttgcacatcttcagaataagatcaactgttttataggttggcctctttgaatactgatagtttttagcccttgtagaaactttaatggggtataaaagacccagaatttcctagtgcacgtactacttaagttcctaagataggattaagcattttcagagctttttagtagtctatacatgttattaaattttataaaaatgggcagtttgtgataatcctcctgacatataatagctttctaaaaaagttagaataattaacataattacttagtatttcaagcctactttttaagggtgacttgactaattataataactccttctcagggagagtcgagtagaaaataaatttttcttttaaggtcaacagactggaggtctgcctgttaaatacaggtgtgtaaagataagcaaaaaaagcccaagagaaaagtccattgcagaatagtctcactctgtaaataatatttggtcactattagccttagggctaacatgatctacgtgactatactgatgatttggaaaggtgatttttgaaatggcttcaggatgaaagtatttgaaattctggactttatatgtcacagtgggtgtgaagaggtaggttactaatggaaaattctttctgagagatataactgattatgattagtttctaaatcattaagctattttgagtcttctctgttttgcaataaccgctgtccatacaatggtgttatacctgatttccaaacctgattacatatcagaatcactttgggagcatttatgaattattgagccctacatgcagagatcttgagtcattaaggtctggtgtctcagaaatcttttttaatactatagcttattctgatgcagagccaggcttggaaataatttcaatatttgtgctaattatcttgtaaaattttcttttaaaaaaagtattaggagtaaaacaagtccaaattacagccaataccaaattgggaaacaagatgtttaatttcctagtgtcttagtccttttggggtgctatgacagactgttatagaatgggtggcttaagcagcatacatttatttctcatggtctggacgctgagaagtccaagatcaaggcaccagaagattcggtgtctggtgagggcttgttttcctgtttaacagacagcgtcttctacttgtgttctcacatggtggaaggggcaagggagctcattgggatctcttttataaggacattaatcccattcatgagggctccagcctcatgacctaaccatcttccaaaggctccaccacctaatactatcctgggtgattaggatttcaacagagggattttagagtgatagaaacattcagttgcagtccatcacacctagagactttcatctatactggcatttttctccattgcactagttcatttaaattcagccttattatgttggcataagaaagaatgaataagacctagtatttggtagcacaatagggtgaccatagtcaataataaaattgtatattttaaaataaatgtaattggattttttgtaactcaaaggatagatgcttgagggggcagataccccattctctatgatgtgcatatttcatgttgcatgcctgtatcagaacatctcatgtaccccataaatatacacctactatgtacccacaaaaattaaaaataaaagtaaaaaaaaattaaaatattggcatagtaatttattaaataatatatcccaatttttactttattaaaatggtataattgtttattaatgaatgccaagctaacataattattgaggcttttattaaagaattaaaatattttatgagaaattatttaaaataaaatttttaggaaaataatgttttgagctgtatccttaaaatttttactagttcttcaaccgagttctgtatctttgagggcatgatagtataaacaggaacattttagactgtgaacatggtaaacactggaattagatcttactcaaaaacatagttgtagtttctctgtgccttcacattaaataaaaattttttttatgagtacatattatgtgtatatatttacagggtacataagctatttcgataacagcatacaatatataatgatcacatcagggtaaatggagtagccatcactttaagcatttataatttctttgggcatccctccacatttttgacaagaaaattttgacataatgtggatatgaaaaagaacgtagagtacataacagagtaaaagaacagtgctagtatacatatttaaaaatgctgtgacagcgcctccttgtgggcagaacccaacatattggtcagatttctgttatgtataaaaagtcaacagatgctttctttaaaaaaaaaaaaaaagaaaacagtattttatgtggttctgtattatattttgtgcttgacgaaataaaaatatgaaatgagttgcattaaaagtataatgatgttaatcttttatttcagaatcttcaatcattgtttcttgtagggaataaaataaaactatttgtatagctttacccccataaaatttaccctttaactgttctgcctgtaggacagggtaaccttcaggagaataattgtgaaaaacaatgccaaaaagagaaaaatgtatgaaagctttattgagtcactgccattccttaaatctttggaggtaagtatatgtttatgcttttattttattttgctttaaaagtttctgttttgctaggaatatttagttctatagaaaaatttctttgaataaaaaaaaatctatccatgtttttatttgaaaagattaaatggtagtgctaatttttataactcattgtttcttctgctatctataatttcatttgttttgttatttgaaagtaatacattcctacccagcatctatagcaaatttatatgtggtctttatctgatagcagacttaatataatcacatagatgtagacaagagccactagttgtaactttacagtgaggcgttctctagatatagaatgtcctctctggcctcttcctctcagtcatctttgctgtttattcctcttttcttctcctcttaaaactggcattccaggcctctgtccttggcctcttctcttttcaggatacacttattcacttggtgaacatgtcgaatcccatggccttaaatacagatgtcccttgacttactatggggttaccttacgaataaacccattgtgagttgaaaatatcataaatagaaaatgtatttaatacacctaaactatggaacattcgagctcagcctagcctacctgaaacatgcttaggacactcacatcagcctacagctgggaacagtcacctggcagcacagtgcactggagagcatgggttgttcacctcattgtggtgaggctggctgggcgttgtggctctctgcctggcgttgtactgcatatcgctagcctgggagaagatcgaaactcaaaattagaagtatagtttctatcgctttcaaacaactgtaaggttgaaaaatcattaatcaagccattgtaagtcagggaccacctgtactgtccatatattgatgcttcttaaaattgatatcactgggcaaggcccctcccttgaaggtcagacttacttatccaactgcaaatgtaagatttcctctcagatgtctaatagacatctcaaacctagtatgtcccaaatctactccttttctctttccctgcagatggcaacatatccttccagtgtctcaggccagaaaccttcgagttagcactgactcatatgaaccaccatcacctcttgcctggctaattgcagagtcatcttttaaaatccctggttgtggcactgctctatttaagctcctcctcacatggcctctaaggctctgcacagactgtcccactcccccacccattttccccaacctcatttcctactgctccacactcatcatctctctgttgacacatcagcttcttgccactcctcaaacacacctgtcccacacccacttcggggtctttgtacttgccgtctgtctggaatgtcttcctacacagctgcagggctccttcatttctcagcccagaggtcttctcaatgagaccagctcttaggtttttatctttgaaggtagagacttatgagagagagtaggttgttgttaccctaaaaattcagcttcattttccatacttcatcattaaattaaatgcttttctatttcactgtcatatttgaagtattttgagagtaattaaagacaggcatatatatgtacccacaacatcttataaaatggcaagtgtcaaaacagcagtgcttctccttttgaatgtctctgttggattatcagcttacatctggtaaaaaatttgtccacatcacacagtgcgtggtagacagctgatcttttccagcagcatatttctttaaataagagtaggtcagggattggaaatctggtgccttcagagctaggcaggtaacacagagaagaaaaccaagccaggaagggactttggcagattggagaacatgtatttcattaaagaaacagctgctatcccaccatagttttattgttgccatgtggaaatatgggctatgtgatgctgatttttcaagagaagctggagattgaatttttatgaaaaattattttaaaatgctggctggtaattaatacaacaaacacatatacaacctacacactgctcgatttatttggcctataggctaccagttttttactcccgaactagataagcttacccagttaatttgtttctatttaatattgtttttctttctttgtagttttctgaacgcctgaaagtagtagatgtgataggcaccaaagtatacaacgatggagaacaaatcattgctcaggtatgatattttgaaatgtaattcagtttagggttatattccaaaaggttcctgtagtggtagatcttgataaacttttcatatttctaaaattagtatgcagtgatgggttaaataaatattacttctaccaaatgacctgttaaaaatggtttcatttatagtcattactctattgaatatttttgtttatgtaattaactcctaatgaaggtgtattaaaccatcaaatggttttctgcatcattgtagtcatttataagaggaaaaaacaggtgaatgttccatgacattaatgaggacccagaaagtacactggaaaattctatagagttttgcatgatcagttcatgatgaaaattcctgaggctgctccttgataaaattcaccaagaaaggaacatactgcaacatatactgttttggcttccaagactacatgtgggtcaacatgttatttaatccctaatacttttctaagatcccagctggaaccaataatattagatacctgggttggagtagggctaccaaaagtagaatttgtgaagactgttgaagttcacaggtaaagcatgcagatgatagtaccttgtttcctagttatatttttgaagcactaagcaaatgattaaaatggatttttaatagattctgtaatttttgtatcacagccttatactgttttgtgctctttatctgaaatgcagtcttttcctttatatgggaaacaagattcaaggtctttgagactgagaaaaagaattgttttagaagacaaatacataagtaaatctttcgatcaacacccctctcccattgctgagtgtgtgtgtgtgtatgtgtgtgttagagcagtcagggattgggaagaaatggagtcaagcaaggttaaagttctactgtataaactagtaaataacaaagcaaagagcatgttttaaatgattttttaaggttttattttgaaataattatagattcacaggaagttgcaaaaatagttttgagaggtcccgtgtactcttcacccagtttctcctaatgcgttttgcatcactgttaataacaatatcaaaactaggaaaatgacattggcataattcacagaccatattcagttttcaccagttttacatacacttagagcgtgctttaaaaatagttaaaaattactcagcagttaatagacctattatgattcagaacactcgaaaacttaatatgaagcttttatgaaaacctgatacaagaataagggaaaggagatatgctatacttagggtttattaaggatattcttacatatttgttgtcttttaagcatttataaatatacatatacaccctatattctaaaaatctaaattcaacatttatttttgtgatagaatcagatgctaaacttcttgaatttgtattaaggagttttgaaatattttaagtttctccagaatcactttgagaggcttagagaagtcagtgtctgtattattatcttccatattgtattgtttaattcagactgcatcattggagatcaaggcagagttcattaagaaacaaaagcaagaaagaacaggtatatgggtagagcaacacttttcttttagaagtccttccaaagccttgaaatggaatgtcagtaggctagcatgtcagagtttggtcctcagttgactgtagtgaaaatgtcaaggcccacatctgctgcttccggctccatctggatgctttctgctctttgcaagttgatggcttatcttgggtcaccacaccaatgcttgcgatgttaggatgacgcagggtgcatgtctcggcacttcctcaggagcacaggatccgcagacatgtttctgccaactaaggggacgctgctggcatacacagcagtgttgccatttccaactatgtatgctgttatctaggctgaaatttgggtgaaattcttaccccagtgttgccacattttcttggttttttagcagaaatacagtggtagagaatatattatttcaaggccaggcacagtggctcacgcctgtaatcccagcactttgggaggctgaggcaggtagatcacttcaaggtcaggagttcgagaccagcctggccaacatggtgaaaccccatctctaataaaaatacaaaaaaataaataaatacgggttctagatccctgaggaattgctacactgtcctccaaaatggttgaaccaatctacattcccaccaacagtgcaaaagcattcctatttctccacaacctcaccagcatctatcgttgcttgactttttaataattgccattctgactggcgtgagatggtttctcattatggttttgatttgcatttctctaatgatcagtaatgatctttttttcattttttttttggctgcataaatatcttcttttgattcttttgagaagtgtccgttcatatcctttgcccactttttaatggcagaaataccatttgacccagaaaacccattactgggtatatacccaaaggaatataaatcattctgctataaagacacatgcacacatatgtttattgcagcactatttacaataacaaagacatggaaccaacccaaatgcccatcagtgatagactggataaagaaaacgtggtacatatataccatggagtactatgcagccataaaaaagaatgagataatgtcctttgcaggacatggatgaagctggaagccatcattctcagcagactaacacaggagtagaaaactaaacaccgaatgttctcactcataagtgggagttgaacaataagaacacatggacacagggaggggaacatcacacaccggggcctgtcagggggtggggagtgaaggtagggagagtattaggacagatacctaatgcatgcggggcttaaaaccagacaggttgataggtatagcaaacctccatggcacatgtatacctgtgtaacaaacctgcatgttctccacatgtatccctgatttaaagtaaaattttaaaaaaaggaaaaaaaaattagctgggtgtggtagcacatgcctgtaatcccagctacttgggagggtgaggtgggagagtcgcctgaatccaggaggtggaggctgcagtgagctgagattgcaccactgcactccagcctgggtgacagagcgagactccatcttgggggggaaaaagaaagtattatttcaaataattttacaaatgaaatcattactacataattgtccatcaaaacctcttcatttagggccgggctcggtggctcacgcctgtaatcccagcactttgggaggccgacgcaggcagatctcgaggtcaggagatcaagaccatcctggctaacacgttgaaaccccgtctctactaaaaatacaaataaattagccgggcgtggtggcagacgcctgtagtcccagccacccaggaggctgaggcaggagaatggtgtgaacccgggaggtggagcttgtagtgagccgagatcgcgccactgcattccagtctgggcaacagagtgagactccgtctcaaaaaaaaaaaaaacctcttgatttagaaaccgagacagcttgttcccttaggatttcacttttcaggtgaatatgtgtactttggggttggatcaattttagggatatgaaaggtaacaagattgttgtcaattaatttgcattttcaccgtctgtttttgttattgattccaatagggagattcggctgattcttttttcattgtagaatctggagaagtgaaaattactatgaaaagaaaggtaagcattctaagtcctcagaacccacatactgttagcaaggaacacaacagatctactttttgatgtttagactgaggttaattttatttttcataagctgaggaaaagctcatctttttaattgccttgtcagggtaaatcagaagtggaagagaatggtgcagtagaaatcgctcgatgctcgcggggacagtactttggagagcttgccctggtaactaacaaacctcgagcagcttctgcccacgccattgggactgtcaaatgtttaggtagggattgcaacagtgggcgtgcttctgctggttgaacttatgtctgcattttatgtattcatgttgagtgaatcattttattgggttcacaggttttgtggtccccacaaaaggtaacaagattaggactcattgccttataaaatcaatttgtggaagccattttttcttcgaaatttttacatccagatacattttgctcttcttgtgtatatatgaaataacatcccatattagtcattaaaataagagttccaagtaccacgttttatatggaatctctcaaataagcaacatgtgctatgttcctcaaaagagaaggctaaagtactatttttataaagtccgttattaagatctgcggggaatgctgagatgttgtgagaatccttactcattacagtattgggacacaaaggttcaggtttgtcaaagcacagtcaaatgttctttgctgttcagttgttattactattttaccagagtagcttggcagaaatgtcatcttcaggtgcaggcatctgtatatatctgagattatatatctgagaaatcacttactttgataagaaaatacagtttagaaggtggcaatatggagggtattttaagaaaattgatctcacagttattaccctctctgtgcttttcatccataattcaatagcataaacttaatgtttttaagatttgcaaggatccttagaattaacttcttagagaagtcattctttaaaagggtttaaataagtataatattaatcaagtgttaaatttggatggaagagaagacgattagaaactggcaggtaatttccctaagtagggctattagaaagagtaaaggtgagtgagtgaaagtctattagaaatagtaaaggtgagtgagtgaaagtctattacagtaaaggtgagtgagtgaaagtctattagaaagagtaaaggtgagtgagtgaaagtctgttaattttttttcaataatagattattatactcacatcaaagaaaacctgagaaatacagaaaatgtagaaaaaacataacaccgccactcagtgatttctgctattataattccttcttgtcctttttatttgtgtgggcttccagttgttaaacagttttccaaacaacttttaaagttcattatcgcttaggaatgttcttattttattacaccaaattttaaaattcttttaggtaaatatatacacgataaattaatcattccttagtggtaaatacttcgaaggttttggctccaacttttttgtggggagcaattttttgtgcatagaagacttttctgtattataggagttttccttagaaatggttttcaggagtgggtttttaaaaaattaacttttgacacatattgccagattacttgtatttgtacactactagcagtgccataatgcccattcaccctattcttgtaaacattgccttttttatctttttatctttagtgtaaaaggcaaagaagatctattttaatttgtacttttatgtatagagtatgatcatattttctatttatatattataaatccagttttaaaatccaggagacaggcaagcaaagtgatttctagcatgtacttatagaagtaaacaaaagcattatgtcagctgccatttttggattgcatagacatagtatggcagcaaaacttacaaaaggttaacacttggccttcacaacatggcattttaaaccctgagaagggaacacaggatagaaaacactcttgtgccacccttgaggagttcacattgctaaggtggagacagcacatttattttttaaaattctaaggtctttccatgatagtccctcattcttttctcagcttggaccaggaacctcccaccaacttagcattgctcatcatattgccgagggactgcagagtgtggtccaagagcgtggccctggctgcttcctttttcaagtggaacatttttatcattatgctttttcttgtattttatagtatttacctaaaatatcattgcactattgatatatatggagtcggtattgtaaatgacttagaaattctgcagatttgcaaagaatgttatttaaaaaaaaatcttctcttttctcagcaatggatgtgcaagcatttgaaaggcttctgggaccttgcatggaaattatgaaaaggaacatcgctacctatgaagaacagttagttgccctgtttggaacgaacatggatattgttgaacccactgcatgaagcaaaagtatggagcaagacctgtagtgacaaaattacacagtagtggttagtccactgagaatgtgtttgtgtagatgccaagcattttctgtgatttcaggttttttcctttttttacatttacaacgtatcaataaacagtagtgatttaatagtcaataggctttaacatcactttctaaagagtagttcataaaaaaatcaacatactgataaaatgactttgtactccacaaaattatgactgaaaggtttattaaaatgattgtaatatatagaaagtatctgtgtttaagaagataattaaaggatgttatcataggctatatgtgttttacttattcagactgataatcatattagtgactatccccatgtaagagggcacttggcaattaaacatgctacacagcatggcatcacttttttttataactcattaaacacagtaaaattttaatcatttttgttttaaagttttctagcttgataagttatgtgctggccttggcctattggtgaaatggtataaaatatcatatgcagttttaaaactttttatatttttgcaataaagtacattttgactttgttggcataatgtcagtaacatacatattccagtggttttatggacaggcaatttagtcattatgataataaggaaaacagtgttttagatgagagatcattaatgcatttttccctcatcaagcatatatctgcttttttttattttgcaattctctgtattctatgtctttaaaaatttgatcttgacatttaatgtcacaaagttttgtttttttaaaaagtgatttaaacttaagatccgacattttttgtattctttaagattttacacctaaaaaatctctcctatcccaaaaataatgtgggatccttatcagcatgcccacagtttatttctttgttcttcactaggcctgcataatacagtcctatgtagacatctgttcccttgggtttccgttctttcttaggatggttgccaacccacaatctcattgatcagcagccaatatgggtttgtttggtttttttaattcttaaaaacatcctctagaggaatagaaacaaatttttatgagcataaccctatataaagacaaaatgaatttctgaccttaccatatataccattaggccttgccattgctttaatgtagactcatagttgaaattagtgcagaaagaactcagatgtactagattttcattgttcattgatatgctcagtatgctgccacataagatgaatttaattatattcaaccaaagcaatatactcttacatgatttctaggccccatgacccagtgtctagagacattaattctaaccagttgtttgcttttaaatgagtgatttcattttgggaaacaggtttcaaatgaatatatatacatgggtaaaattactctgtgctagtgtagtcttactagagaatgtttatggtcccacttgtatatgaaaatgtggttagaatgttaattggataatgtatatataagaagttaaagtatgtaaagtataacttcagccacatttttagaacactgtttaacatttttgcaaaaccttcttgtaggaaaagagagctctctacatgaagatgacttgttttatatttcagattttattttaaaagccatgtctgttaaacaagaaaaaacacaaaagaactccagattcctggttcatcattctgtattcttactcactttttcaagttatctattttgttgcataaactaattgttaactattcatggaacagcaaacgcctgtttaataaagaactttgaccaaggctataaatgccacgtacattattttcagtattgttggttatatttaaattttccttacaataaagcacacttttataataaaatacatgaattattgtttttcatacttttttgcttgtttctttaaagttttctgacgtgcataatgcataattcattgaaaagcatgatagcaatgtggcatgtggaagcgaacccccagggcataacatagtaagaaagtatggttctgtatggcaataggtttttaaaattattagctattcatcatgtgtgggagaaataattgtggtgtgttgcagatttatttggccatttagaataaccaaatcaatctggctaactaggaatttatgtgtaaaattatctgattaaaacagctcaagtttgacttgtggatgtcattatttaattattaatcaacactccttactatgtgagaattctctgttgaccattcattcaaggacagagcctctcgtgtatcatgcgtggctaaggaaaggggtgaggactttttccccaagagtgacggtgctttcccttattttaaataaaggtgtgtgtgtgtgtgtgtgtgtgtgtgtgtgtgtgtgtatgtatgtgtgtgtgtattgttttctacatatccatatgtactagggcttagtgcagatattttaacatacacgttacctgtgacacaacttaggtgaatgtatatgtgttaccattaggattagtattataaactctggctaaatgccatttaaaatgctttaaaaggccggcaccatggctcatgcctgtaatcccaggactttgggaggctgaggcaggaggatcacgaggtcaagagatcgagaccatcctggccaatatagtgaaaccccgtctctattaaaaatacaaaaattagctgggcgtggtggcatgtgcctgtagtcccagctactcaggaggctgacgcaggagaatcgcttgaacctgggaggcagaagttggagtgagccgagattgtgccactgcactccagcctggtgacagagcgagactccgtccataaaacaaacaagcttaaaaattcttcaagtgaaacggcatgaagcaagagacttcggattttattgaaatgtaaaatttaaaaacgctgtgttctttcccttcccaaagcatctttaaagatactgatagaatttttcctctcaaaaaacgttataaaggatgagatgacctttgccattcttaaggaaaattaatactgtgtaggcctagagaggtgagtcatacatctggattaaggcagagctttgttaaattgctggacgggattcttaaaaaaaaaaaaatttactacctaagagaaatatagtttttaaggaatgctggcttctaaaatttagtgtttggtatagcctgatgccaagtatcagaaagaattttgacaaaaatgaagaattggaatgagttgagacaaccttacctgttctagaatacttttaaaggcagcaaaactggttgaatagactacagagttgttcatcttcacaggtataaaaaccctttaaaagtgtaatgaattatggaaatataagcagtaaagtataccagttatttgcagaagacttgtgtcaataactatgagaccttaaatcagttcaatttgtatacctaaggacaatcagtgacttcactaaagtcatttactttgtgagtcaatggcagaacttatggaaaattgagatatattgattcttcatccaattcatggcctcatatattttcccaaataatgttaatgagcctggcatataaattggtatatagtttccaatgcagagaataagattattttgagaggaaaacttttgatgtgaccaacagatctgggtctttctttacctttttatgcttcaaatttataaatctaaaattgcctagaaaatcctgaagaagtatgtatcacatatataggaaaatgtggtgatacatgatagggaagtaatgtctacaccacaaaaatgaatgctacctaccaaggaggtggttttcacagattttgatgtaaccatagcctgagtctcatcatttttccaaatataaaaaatgctactacaaaatgtatatatattaaatcatgttttatcagcaccaattataactgattcattatagcatataaatgcattttttactgtcactggaaaacagaaaatgacctttttttcaggcacaagggaaagttttctgtagcttttgactgtaacaacccagacatgaaaccttaaatattttctatttaacttgaaaagaaaggttacaaagtagaccttcgaatgagtttatgaacaggaaatatgaccagttaaaatcttagataaagttgctattgatgactggttttccatcttggttctaatcagaaaccttcctagatcttgctgaggaacaagagaataaactctgcatccctgaaacttcatcacctctcttaggccaagggctgacatttaatacaagtgtacttcctttacataatgactatattcttgaggtatatacaaatgacattttttaaaagccaagcaatattttaagaaaggtgcacactataaagacatctttggtaaatctattttctcataattgcactttaaagctgaacaattaaatatcctcaacatttttattacttatattctgtataacttgaaggagttgaagtgttaattaggttggtgcaagagtaattgtggtttttgccattttttaaatggtaaaaatggtaaaaatcacaattacttttgcagcaacccaatactttgtttgcctttgagtgactgacactgtgagggaaacaaaaatgaataatagtgcttatcatataaacatagctgaaagatgagacgttctcaaataataacaatgattacatagaggaagtgacagttaaagtgcatgcaagttatttaacaaagtcaaatattcagaccagcatcctatatatagtgctacactacgctgtatatgagaaaattcatgctgcttgtctcccctttttattcatttgttccacaggtaggtatttttttaatagcttattatggaccagacaaaaaaaagcgcatgagatggtgactgataaggagagaatgtaaatgtggaggggggacaaatgtaagcaacaatattcagtttagcacagtgtgataaaagcgatgtgtgtactattcctacttttttttttttgagacagagtctggctctgtcacccaggctggagtgcaatggtgtgatctcggttcactgaaacctctgcctcctgggttcaaacgtttctcctgcctcagcctcccgagtagctgggaatacaggtgcgtgccaccacacccagctaatttttgtatttttagtagagatggggtttcaccatttcggccaggatggttttgatctcttgaccttgtgatctgcccacctcagcctcccaaagttctgggattacaggcgtgagccaccgtgccccgccctattcctacaattttaattgctctttatctgacttaattgcacttaaaatgaggtactttttgctagcaactaaacatagagaaggtcctaggataccaaatagacgggagtagaaaatactatgtgagagtttgtgttaaatagttcagataacagtaatgatctctagaaaacttgcaggacatgagaatagtcatttgagcttgattttaaacatcgagagtgagatgaaatagaattgttgccttctctaaatacattttcatttataccaaattagacttgacaaaaactttttgggaaaaattgggataaaaaaatgagtactcctctctatgtcctgaggatacccaggtttatttctccagacttggacttcctaaatgccagatgaatatattcagctgcccaaggacctctggactcaaatttcttcctgcacagcatgcttatcacccgaggttgaacctatcctttcccttcctcccagtccccaaatctgctatcctctccagcattccctcagtcaataacatcaacataaccacccttccccaacatactgcaattacccaagctggagacacaatcattttgattcttcccttttacgttgatttttcttcctaatgtggttatagtgttaagacattagcttatcagccactgaagaaaggtcttgctttctggtcatcggagcaaaatctaaacttcagttgcatcaagaactacaggaacaggagacagatgactcacttctacaatggccatcattagctcctgtggatttcattacaacttgactgaattacctgagtactttgaactaattagaaaattaactcatttgaaaggatagtaaggtatatggaaggatatttgttggagtttaaacattcaagatgctgtctgaaaactttgagaagtacttagaccatacatgtgttcaatttctccatttagtacttgttcatgtgatttcatttgtttaccttttgacaattcaaagtgattattttcaatatcaggcaatgcatgtacttgaacttctctgtagttaagcaaagcagtcattggtgtgtcaaatatggtggaatcagggaaacacattatttcactcctaaataggatttaccggttttttgtttttcttctgttcgttttttactatctctaacaaattagaacttgatatttaagataacagaggtaactttacaaaccgctggaaagacattttgatttgacaatttcttgacatttttttgcatacattttatgtgtgtatatgtgtgtatagatatggtgactgtaccaatcaagaagaggtgttatttaaagtaactgattttttaacttcaattttatcatggaaacatctgaaagatagttaaaaactgtagttatatctgttttagtctgagagtataattagcacatgtaaaaatttccaaggagatcttactagttttgtactttgatctttgttctggcttataagttggctagttttattggtcactcaattaatgatgatgtctctggtaaatacacataagctactaatgtggtcatttagccccccacggaagtcagaagattggactaagtgtccacttaaaggtgtagcgaattctaatactagtatttaatcagttgtgactaaactatctaaatttaactcatattaaagacttggataaaaatgagaaaaagtgtgcaaaaaatgttttctatctttttattctcaataattggcacagtggtcaaaaaatggaactaaacgtttctgaatgaatggaaaaggctttatggagctattaaaggataaattattatttgtaacatattgtacaatatctggatctaaagttgaattttttttccccatttccggtgtcccccgataaaaaaaatcaccactaaggcatttggtaaaaactttaaaatagtttaacttttaaaaacaaggtttagctgaaagcagatctcacagtttgtgtactggagaggggtaaagcagtatgtcaatctcttgccagctcttttttttttttttttttaagagaaaagttttttagttttctaggaggagttagacataaatatctcaaaacaattttaaataattaggtgaacttcacagatttttcttttttgtcaagaaattacatgttggagtagagtttatattttctattctagtacacgatgaccctccattgtaaaaaaaaaaaaaaaaaaaaaaagcatacacaaagtagcagagacattcatttctttgagtcactaataatttctgaaagatgataaattcaaatcctgtcctttttcctcagggaaaaaattaagcattctgttggctctcctctgaattattttaataaaaaatagaatgctttattactatttgtgaacatagaaagtaagtatttgattacacgggaggactactttataatttcacttcacggattcaaatggggaattctcaagaattttaaactcgatttcaacatgtgggggcttattttggatttcttgatttgttacgcggctttcaggtatatttaaaaatccaagaaatgcaggaggttttaaagaaataactagctgtgtgatttctggctctgtccaaaggtttgcttttacagatttcttactaatgtaggttttcctcatcttaattctaagcatatatttagtgatctaaagttagaaaatctaaagcacaatttaaatgattaaacactaaaggttcaaaggggggaaaaagcttaatcatgcctttgtaatgtgaatggtaaagacaccaattattgactagatgcagccgactgtgaatggacagccatgtttaaagagaagttaactataaagcagggaagcgtctctggtgagtcagagaattcgtaacttgaggaactcctagtggaaatgaagtggaaagacagtttctttcatcaatgagaaaacgtctagaaggaaaagagggttaataaaactcaccagagaaacttactgataatgattcacaaattaaatcagtttacgtcatacattacaccctttgtattacgttaaccaacgagcatactaatcagtatggaaaatgccgctttaacttgcctcaatttcgtaatcgcccgcccccgcccccgctttgtaaattctctagactccagcttctcgcttgctcacagtccatcccccagcctcactcttcctggcacttaggtggcggctcaacaaacttaggtgaactgaacagagctgacaaggcaatctcaagttgctgtcctgggagtggtgaggcaaggcacaagagaaaggacttctagttcttcccactgccagtgcagcccccagcatcactttcgaccccttcgtgcctggggccgtgatttgtgggtgatcaagtccctcgctagcctgcagtacttccgctggtgcagtcatctccttcccctcgcactaaaacaataccctggcctcctgccaaactcttgagcagcgagcaactctggctgtttatggcccggattgggtgctgcaagaggcttgggccgctctaagtgttagcagaggcccggaggaaaagaagaggcccaagctttaaaacactcccttcctccgccccctcccttttgtcccagacaccaaaacaaacgagctgatacacgtgtccctatgactcttgtttactatcaagactgcgctgtgcgagcgcctctgggatacgtagtccagctcttccccggccagcagtctcccacagccaaggaccaaggcttgagactacgaacccacaatccatttcggggacaaagtttggcttgggtccccggactctcggcaatagtccaatccgaagcacttactcttgtgattgacatgccatcttctccagtaaacacaacacaaaagtcaatacatgcccgccccccgagacggaccacggtaccacccaatgggaaaggggaagaaccgaatggcagttctgcagtccaataagagggcgaaagagctgggcggggctcaacccccagggggttgaggggagggggaagacgaagcttgaaagacttggtaatggcgacgggtttggtaagtaggaaagtttcggttgaggagtaagagctgccgcgggagcagtaacccgcgcgggggaggccgacgtcggtcggagagggggtacgagagctgctggtggtgttgtcgtggccggagcggcccgcgcctgggctgccggcacttcgcggcaggtttgttgtctttcagttagggaagaggtgggggtggggaagggaggggcaggagcgcgggggattgggcagactggagggctcgggtcctcgttccttcttctcggagggttgcccttggggtgggggcagttaaccgttcgattggtgcccgcggcgagcccaccggagcagcgtctcccgcgagctcacctgggcttcggggcggcggcgctagggggtctcgggcgggggccgggaggaggcagggggagggcgaagttccgggccaggtcgcgcggtgggtggccgggccgggtgtggagatggggcgggccagggcgggggaaggggccgacgcagcgccggggctgcccaggaaagtttgacttcaactccccgtttgtgggcggagggtcggagcttggccaggggtggggggctggccggaggtgggggaccccagtgaggcgccgcctccttctggactgagggggattctggctgagctgaggagctcgcggagccgctgggccccggggctcattgttacgcagttcgaatgaatgggctcccaggcgcctgcgcgctggggctgagccgaggggaaaaacaagcccggagtccgggctgcggtcacatgatggggggaagggaggggaacgcgatgaatggcgaaagagggtgggggatggacttggcgtgaaccgggaggcaccgctctgtgtgacccaaagaggaggcttggcaggcgattccagtctccgcctttcaacctatgctgccaccgcaggccgattgaaacaaaacaaaacaaaccaggcgaagtggacagccaggtttttgtagctttaaatgctgcgtgctgtctagggtgtttcactctccgctgtgcactctacactcgagttcattcttagggagttttcagctacagtcgtttttagaaggagcactgacagcgaggtaatactcaagttttctgtttgttttgtttttggctcatggtgccactgatgccaggacgagaggaggcttagaaaaggagttatacatactgggaagcgatggagtcctactaacagctcggatggaggctttagctttattaatacttccctctgaatagccgtaagcactcctaatagtggttttgaaattaaaggtactttttgagaattagaataattttaacattggaaatacttttctggtcatttaacagtgatctaaatctgcaatgtatgtcttgtacttttggtttttttttgctattttcctttatcttgcaaatgagtgtggtagagtcggtcatctgttcagttgccttggttaaactcagttcttgcaaggtagacagtagttgacaaaatttcaaggaaatttgaattatattgagaattaaatccactccctaaagtttttgggttatgttatacttttgaggagccgtttaaccactttaaagcaaaatattgtttgtgctttctctactgataaattatagaatgaagttttgatttcactttctagtttcatcttagttttgtaaacctacttatcttttctgtctcgaaaacccttcctctttcttaacttctcaaactcctaactacataccctagttaaaagggtaccttctcccaggattgcccacctacatgtctccgctatcctgtgtgcttcacagggcatacctctcagacgtcaaacatgatactgtcactgtaagagttgttttcttcactatatacatatgtatatgtataaaatatataacatatacatgtatatatataaaatatataacatacatgtatatatataaaatatataacatatacatgtatatatataaaatatataacatatacatgtataaatatatatatatatatatatatatatatttttttttttttttgagagggagtctcgctctgtcgccaggctggagtgcaggggtgcgatctcggctcactgcaacctccaccttctgggttcaagcgattctcttgcctcagcctcctgagtagctgggactacaggtgagcgccaccactctcaactaatttttttgtatttttaatagaaacggggtttcaccattttgagcaggatggtctcaatctcctgacctcgtgatctgcccgcctcggcctcccaaagtgctgggattacaggtgtgagccaccgtgcccggcccactatattttaacttctttggattctttcctcactaatcgaagtggccagtgaagaaggcatatggcacgatggcatggacttatgaaactgctctgtgctgagggttcttcagggtgaattgcaagctggtgttttgtatatgtgtttgaaataaaaatactggtactcccctttccaccccacgcatacattatccattagaagttactactgtcccagcacggtgtctcacgcctgtcccagcgctttgagaggctgaggcgggtggatcacctgaggtcaggggttcaagaccagcctcgccaacgtcgtgaaattgtctattaaaaatacaacagttagctgggcatggtggcgcacacctgtagtcccagctgcttgggaggctgaggcaagggaatcgcttgaacccgggaggcagagattgc

SEQ ID NO: 1199 - DNA, 3658 bp, Homo sapiens
cgcgcgccgggagccgcgggccgggccagccgggccgccggggcccagtgcgccgcgctcgcagccggtagcgcgccagcgccgtaggcgctcgctcggcagccgcggggccctaggccgtgccggggagggggcgagggcggcgcccaggcgcctgccgccccggaggcaggatgagcatcgagatcccggcgggactgacggagctgctgcagggcttcacggtggaggtgctgaggcaccagcccgcggacctgctggagttcgcgctgcagcacttcacccgcctgcagcaggagaacgagcgcaaaggcaccgcgcgcttcggccatgagggcaggacctggggggacctgggcgccgctgccgggggcggcacccccagcaagggggtcaacttcgccgaggagcccatgcagtccgactccgaggacggggaggaggaggaggcggcgcccgcggacgcaggggcgttcaatgctccagtaataaaccgattcacaaggcgtgcctcagtatgtgcagaagcttataatcctgatgaagaagaagatgatgcagagtccaggattatacatccaaaaactgatgatcaaagaaataggttgcaagaggcttgcaaagacatcctgctgtttaagaatctggatccggagcagatgtctcaagtattagatgccatgtttgaaaaattggtcaaagatggggagcatgtaattgatcaaggtgacgatggtgacaacttttatgtaattgatagaggcacatttgatatttatgtgaaatgtgatggtgttggaagatgtgttggtaactatgataatcgtgggagtttcggcgaactggccttaatgtacaatacacccagagcagctacaatcactgctacctctcctggtgctctgtggggtttggacagggtaaccttcaggagaataattgtgaaaaacaatgccaaaaagagaaaaatgtatgaaagctttattgagtcactgccattccttaaatctttggagttttctgaacgcctgaaagtagtagatgtgataggcaccaaagtatacaacgatggagaacaaatcattgctcagggagattcggctgattcttttttcattgtagaatctggagaagtgaaaattactatgaaaagaaagggtaaatcagaagtggaagagaatggtgcagtagaaatcgctcgatgctcgcggggacagtactttggagagcttgccctggtaactaacaaacctcgagcagcttctgcccacgccattgggactgtcaaatgtttagcaatggatgtgcaagcatttgaaaggcttctgggaccttgcatggaaattatgaaaaggaacatcgctacctatgaagaacagttagttgccctgtttggaacgaacatggatattgttgaacccactgcatgaagcaaaagtatggagcaagacctgtagtgacaaaattacacagtagtggttagtccactgagaatgtgtttgtgtagatgccaagcattttctgtgatttcaggttttttcctttttttacatttacaacgtatcaataaacagtagtgatttaatagtcaataggctttaacatcactttctaaagagtagttcataaaaaaatcaacatactgataaaatgactttgtactccacaaaattatgactgaaaggtttattaaaatgattgtaatatatagaaagtatctgtgtttaagaagataattaaaggatgttatcataggctatatgtgttttacttattcagactgataatcatattagtgactatccccatgtaagagggcacttggcaattaaacatgctacacagcatggcatcacttttttttataactcattaaacacagtaaaattttaatcatttttgttttaaagttttctagcttgataagttatgtgctggccttggcctattggtgaaatggtataaaatatcatatgcagttttaaaactttttatatttttgcaataaagtacattttgactttgttggcataatgtcagtaacatacatattccagtggttttatggacaggcaatttagtcattatgataataaggaaaacagtgttttagatgagagatcattaatgcatttttccctcatcaagcatatatctgcttttttttattttgcaattctctgtattctatgtctttaaaaatttgatcttgacatttaatgtcacaaagttttgtttttttaaaaagtgatttaaacttaagatccgacattttttgtattctttaagattttacacctaaaaaatctctcctatcccaaaaataatgtgggatccttatcagcatgcccacagtttatttctttgttcttcactaggcctgcataatacagtcctatgtagacatctgttcccttgggtttccgttctttcttaggatggttgccaacccacaatctcattgatcagcagccaatatgggtttgtttggtttttttaattcttaaaaacatcctctagaggaatagaaacaaatttttatgagcataaccctatataaagacaaaatgaatttctgaccttaccatatataccattaggccttgccattgctttaatgtagactcatagttgaaattagtgcagaaagaactcagatgtactagattttcattgttcattgatatgctcagtatgctgccacataagatgaatttaattatattcaaccaaagcaatatactcttacatgatttctaggccccatgacccagtgtctagagacattaattctaaccagttgtttgcttttaaatgagtgatttcattttgggaaacaggtttcaaatgaatatatatacatgggtaaaattactctgtgctagtgtagtcttactagagaatgtttatggtcccacttgtatatgaaaatgtggttagaatgttaattggataatgtatatataagaagttaaagtatgtaaagtataacttcagccacatttttagaacactgtttaacatttttgcaaaaccttcttgtaggaaaagagagctctctacatgaagatgacttgttttatatttcagattttattttaaaagccatgtctgttaaacaagaaaaaacacaaaagaactccagattcctggttcatcattctgtattcttactcactttttcaagttatctattttgttgcataaactaattgttaactattcatggaacagcaaacgcctgtttaataaagaactttgaccaaggctataaatgccacgtacattattttcagtattgttggttatatttaaattttccttacaataaagcacacttttataataaaatacatgaattattgtttttcatacttttttgcttgtttctttaaagttttctgacgtgcataatgcataattcattgaaaagcatgatagcaatgtggcatgtggaagcgaacccccagggcataacatagtaagaaagtatggttctgtatggcaataggtttttaaaattattagctattcatcatgtgtgggagaaataattgtggtgtgttgcagatttatttggccatttagaataaccaaatcaatctggctaactaggaatttatgtgtaaaattatctgattaaaacagctcaagtttg

SEQ ID NO: 1200 - protein, 418 aa, Homo sapiens
MSIEIPAGLTELLQGFTVEVLRHQPADLLEFALQHFTRLQQENERKGTARFGHEGRTWGDLGAAAGGGTPSKGVNFAEEPMQSDSEDGEEEEAAPADAGAFNAPVINRFTRRASVCAEAYNPDEEEDDAESRIIHPKTDDQRNRLQEACKDILLFKNLDPEQMSQVLDAMFEKLVKDGEHVIDQGDDGDNFYVIDRGTFDIYVKCDGVGRCVGNYDNRGSFGELALMYNTPRAATITATSPGALWGLDRVTFRRIIVKNNAKKRKMYESFIESLPFLKSLEFSERLKVVDVIGTKVYNDGEQIIAQGDSADSFFIVESGEVKITMKRKGKSEVEENGAVEIARCSRGQYFGELALVTNKPRAASAHAIGTVKCLAMDVQAFERLLGPCMEIMKRNIATYEEQLVALFGTNMDIVEPTA

SEQ ID NO: 1201 - DNA, 30277 bp, Mus musculus
  misc_feature (1)...(30277): n = A,T,C or G
cccccacccacagttcaagaaaggaacttaggaacatatagtttcaacttgagccagggagacaaaggagtattttttagagggggacaagagactgtcttaaccccggggtacttcatccattcagttatttgattattaagcgaagttttaaagatttattttcattttatgtgttttttgtctgcatatctgtctatgtaccatgtgcacgcagggctctaggaggctaaaagagggcatcagattccctggaactgcagttacagtcagttgtgagccatcgagtgggtgctgggaaccaaaccaggtcttttgcaagaatagtcagtgctcttaactgctgagcactggctgtgccaacatagccccatagctggtttgagacaaggtctcatgtaggctagtgtccagttgagtgcattcttgaactcctggattttcttgcctccacccactgaatactgagattcaagatgtataccactacactcagtatatgttgtgctggagatagaatccagggcttcatgcaagctagataaacactctgccagcaaagcaacatccccccaaccctgcctccacctcacaagtagcaaggagtacacataggaaaacactgatgattttatgacacagaagagctcagagcaactggaggagcttggatgttgaaggcagaacaaacaggcagtgagtgaatgtcatgagattaaagagacagaagccactgagcaacctgagggaagaggagggggaaaaaaaaacagaaagaggaacccagctctaaaggctggaaggggcaagcctccaaccttgaggcaccatagtgctctcttttgaaaatggacctaatgatagcaccagtaccaccctctgtgtgttgaaaggaagttgaagtaatccacttaaaaatcctggtcacaagactggagaaatggctcagcagtaaacaacactgatgctctataatgagattaaaggttaagggctcagcatccacatcctgtttattacctccaggtcctaaagaaccaacctactaacaccctcttctggctttagcgtgcacacaggtgccagtacccccaacccacacacacacttatacacctacatttgtatatacatgcatgcatacatacatacatacatacatacatacatacatacatacttttttaagcttagtcatgtagatcatgacttagtcatagcatgtaggtcagttagcagagagcttgcctagtatgcatgaagtcctgggtttgatccctagcactccacaaaccccaagtaatggatacactggtgcacatgtgtcctctcacactggggaggcaaggcaatagatcagactctcaaagtcatccttggctacataacagatttgaggctggcctggactatatggctttgcctcatcaccctttactagaggattacaggtattacaatccttgccccaaggcctaccctggtgggttctatgcttgcctttacatatgtgtgtctatataatatacatatatatgcatatatccagtatatatgcatactatacatgtatattatttctataatagtctttgctgacctagaactcactatgtagtccaggctgtccttcaacagtgatccatttgcctctgccttcggagtgctaggactaagtgcatggtagtgcccttaattaaaaaaataaataaataatggcaagcaggatggctcagtgggtaaaggcacttttaagcaaccctagttatccaagatcaatccctaggacccataaaggtggataaagagaaatgacttcacagtgttgttctctgttgtcacacgtgacccccactcgtcccatgcacagacacatacattagtaataaataaaaattgtaaaaaaatgaaaaatacaaaacaaaaagcttagtaaggactggaagtggagcataatgattgaacaacatgtaagtctcaggatcccagccctggcactgaaaagttagtcaaacatggcggcactcaggatgttgaagcagaaggaacagtagttcaagaccagcctgggattcatagcaatcccaggccagttcgaacttctgaggaagaccttatgcccaaacatagtttatcctatgcagtaaatgaatgttaggaagctagccatggctgctattgctatttactgtggtcaccaaacaagagcccttccttggcactctacagacctatagtacacttcctgccccatcagccacttacacagcctgcctggccagaccccagctgttcttcatacttcaaacattaactgagagaatggcagattcaccttttcatatcataccagactcatgagtgactccaccctaattgtcatggtctgtcctcaccaccactgtctgggtcttcctatcttgcaaacaggaagcacccgacctctctccccagcctctgcccttcctcttctcagccagactggctaatggtgagttctcacagtccatctacacttcccaccatgatttcagaccaggatcttgccaaaaacctccctcgggtcattctcagagtgcagtcaactttcaggagcttggatggcttgcagctcccaacacagcctcatctgacctagatacttctgacctcccaggcagctctttcttagcatctccaggtatatgtcaccccatcacccttaatagctgcacactgttgcattccatgaacgtctccctttgctgtctccttcatggagagagagagagatcttgttgcattatacacaatactcttttttaggtaagagcccagagtcctgtgcatgtaaaggcaagtatagaacccaccagggtgggccatggcgcagtgaacccccttatagtcttttagtaaagggtgataacccccacctagacttgcccagtgagggagggactggggaatggctcagaagtagagtccctaactagaatcccccagtgacagagtagggcatggctcagggatggaactcctgtctaaaatctcccaggaaggtgctggggtgcatctcaggggtggagcctctgcctagaattccccagaaggaggctgggagtggggtgcaggagtgaagccacacctagaaacttcaagtgagaggctggggttggctcaggagtagaatgcctgcttagcattcaggtgtgaggccctgggttctagcacctgtttcaacatgaatgaaagaaaggaaaaagaacagtatggaagaaaggagaataaattcatgtagtcccctgcaatgccgtggggaaagttaaaggtgctaaaatatgtatcagcaaatctgaaagtggtcacactagtggtctcaaaatgtaatggagccaccatatgtgcccacctgtgaaagggctcagatgaaagctcaagaggaaccctgagaaggattattgggagtagggcttttgttaaaagttaacaccatggacagacagactgaaaaaatgtatatatagcccaagctctaaggagagttcaggcagtggcatcagagagggacaacatggcagggactctgaagagagtaaatcagggtcctgtggcacacgtaggagtctcagccatccctttctgaggatggagagtttacaacgcaagactacagccaggtgctctgacttccaagcaggctccagagatatggaattacaggcatgtaggtatccctgcagccagctcaaacttgagtatcaataaaatacacaggtgaagaattccacacctgacctcatgtggcatccctagagaaactcagtacactaaataggatgaccttcaaagctttgccaagtaccctgctactgagccggcactccctctgttgcacagtctcatgggcagtgatggcagcacccactggaagtgggaggtctcactgctgactgctaaaggttgtgcttgctctccaagtatcttgtatggtttccagttgcacatcacaatgaataaatacccagccctaggtataaagcaattaagtaactaaaatgactgtcctagtcagggtttctattcatgcccgagaagcaagttggggaggaaagggtttattcagcttacactcccacattgctgttcatcaccaaaggaagtcaggactggaactcaagcaggtcaggaagcaggagctgatgcagaggccatggagagatgttacttacaggcttgcttcccccgccttgctcagcttgctctcttatagaacccgagactatcagcccagggatggcaccgcccataattggccctcccccctcaatcactaattgagaaaatgccttacagctggatcccatggaggcacttcctcacctgaagctcctttctctgtgataactcaagcttgtgtcaagttgacacacaaaaccagccagtacaatgaccttcctgctatgtatagctataaaggaaatatcagtgaatttcctgttagaacttgggtcctagtcccaaaatatctcataatatatgtgcaaatattccaaagtaaaatatcttttgagacagggtctcatttatccccagctaacctccaatttaatctgtcatagctgaggatggacttgaactaattctcctgtggctacctcttgagtgctagaaggagaggtgtacaccaacaatgtcaggtgttatgcagtgctagggatggagcccagagctttgtacatgctaggcaattgctctactaaatgaaattgcattggggggagggtggtaaagatgtgtatatttatttattttgtctgtgtaaatgtatgtgtaggtgtgtgcacacagagaaacctctgtacatgcttgcactagatcagaagagggtggcaaagtcctcctccatcatgcttcattcactcctctgaggcagagtctcttcctgaacctcttgctaggctgaaggctccaaactccagcagtccttctgtctccagtcttgcacccacagctggagttacagtcatttttcagagatgcccagcttattacacagtaaatctaactctcatgattttggagcaagtgctcttaccttccaacccatctctttagccgtttttaaaaatttgtcttgttttgtttgagacagagtctcatcctgcagcccaggctgtcctcaagcccctggcaatcttaccttagtctcccaagcacgaggagccaccattcttggatttcaaaatgggtttgctgcttggtgtttcttggtaatggtggtgggttttgagttttgttttacattggtttggtttggtttggttttggttttgctcattggttgattgatttgttgtttaaaaataagaaacttgccaggcagtggtggtacatgcctttaatcccagcacttgggaggcaaaggcaggcagatttctgagttcgaggccagcctggtctacaaagtgagttccaggacagccagggctatacagggaatccctgtctcgaaaaaccaaaaaaataaataagaaataaaataaaataaaaataagaaacttgaagtacttcagtttcctaacaatttgattaaagatacacagctggtattgattttctctttacacataaaatatttttgttggaccacgagtgttgacaatgatgttaatccttaactcagaagtagagttaggagatctctgtgagttagaagaatccttgtctacacagtgagtcagtctcccctctcccagctctttcattgtatgcaggcacccacccactaaaaatgtcagctacatccccatctctaagacaaccagaaataatcacacaggctgtgggtgtagctcagtactagaccacttgcctcacatgcacaaggctctgtgttccaaactctgcttcccctacgtgccactagggacaccatgccctggttcagaacacctgaaggtgttaatccctatttacctgtaagtcccagcctttttgccccctgagcacatagtaacccctttgcacacagagaatcctcagaccttcagacttgaaagtatctctttttcagtccagtatccatacatgcccacctctcttatcatagcatatcttctgtattagttactactctattgctgtgataagacaccgtgagcaaggcaacctatagaaggaagtggtctgtgaaggtttgaattagcatggtcccaacagctcttatatttgaatatgttagtttgagatgttagtctcagctgatggcacggtttgggcagtttgagaggtgtggccagcttggaggaggtttcaaaacttgtaccattcccagtgagccctctctgcctactaattatggaacaggatataagctctcacctgttcctgccaccatgactttgctctgccaccctggactctaaccctctggatctgtaagtggaatttcacttctttataaagactttgtcacagtgttttgttacagcaatagaaaagtaactaagtagatgtatttggggctatggttccggagggataagagcccatcaccatcagcgtggggaatcataggagcgggaaagcatggtaactggacttagaatatgagaactcacatctcaaacctcaagcaggaagcagagagacctaactggaaatggcatgagtatgtgaactctcaaagccttcccctagtaatgtacttcctgcataaaggccacatctgccaaactgcccaaatagtgctaccaccatcaaagtagtgaccaagtattctggggaccaaagtattcaaaaaactgagaccgttgggaacatctcattcaaaccaccatgcctcctttgccttcccatccctatatgtccttctttcacttgctttgtcttcactgtgacaaaataccagacacagacaataggggaaagattgattcctggtttcatcaggatccattacttaggacctgaggaaaaatcagcatatcatagccctgggagcttgcggtagaggctgctcattgttcaggaaggagagaataggagacaagaaaggagctggtaaagtgctcgctgagcatgcacaaaaccctgggtcacatccccagcactgcatataccacatatggatgtgcactcttcttatgccatcacttgacagaaaggcagaaagttgaagctcaaaaccatcctttgcttcatagtgagattcaggccaaactagtctacaaggtgtgagggctcatttgaaggaaggaaggaaggaaggaaggaaagaaggaaggaaagaaagagggactgaatgaacgagtggacgtaagtgtagacaggaccacattccatagggatgtatgtcaaagcaaagaattcactatactttatatatatatatatatatatatatatatatatatatatatgcaattttaattacattgattgattgattgattgagagaatgtgtgcatgctattgtacacaagcagaggacagataaccaggagttggttctctctttcccattgtgtgggtcccaggagttgaattcaggtcatcaggctcagcagcaaccacctttacccactgagcgatactgtcagctctttttagaaacagaatttcactatatatccccagctggactgaaactcactatgtaggtcaagttggcctcaaactcatagaagtcctcccaactctaactttctaagtgctgggattacaggcatgtcacatgaggaaagatataactcaggtagacgagttcttgcctgcgtgcccaaagtctttggtttgatctccagcacttcataaactagacctggtggcacactgaggatgtctcaggcagagaagtgaattgtgaagagatgagaaggaaaacttggttcagattgacttcatcaacatggatcaagacttctagctgggcagtagtggggcacacctttcatcacagcactccagaggcagaggcagatggatctctatgagtttgaaagtcagcctgggctatagagatagttctaggacccccaaggctatacaaagaaacacagtcttgaaaaactaaaacaaaaacagagacttctaaagagtataatgacaagtggttcgttgtcagcatatttaaagcacagtacaatttgggggaaagtttcttgttttaatacaattccagtacacaaagacattgaaacttgactcagggtacatgctatttcttttaaaaagagataggctacctgtgctagcttaagggcctagggaagactctggcctgatctccattatacagatagcacagaagtcatttgggctattagccacctctagtcctcgttatgggagcttgggagagcccttggctgaaaaggtcattgagattactagccacctccagtcctggctgtaggatggtctggcctaacacaaatcaccaggctgttaatcacttccaattccctgctttctgggtggaagagtgggtatttcatctttcccactgggaatgataatcctgtgtgtttaacattcctggtctccctggacatctgtgggcagaaagacctttgtgctatgctcccaatggcacaaacctgtcattcaaacactcagaaagtcacatcatatccagtcaggagcagagagaagcagggtcatactacatagtgagttcaagcccagtgtggcctacatgagtctctgtctcaaaacaaaccagttatttgtagacttgaagaatagaggtgtaacaggaagccatgaatgagttttctgaaacagagagataggatcagatcagtcatatgagggagttacctttgcatcactgtgacataccctcctaacagaaacaatgcaaatgtagagagtcttattttggagcacagcttcagggagattttattggtggggaagctatggcaataggatggtgccatcctctgtggctggaaggtacaaggtgaaggtatggatggaaagatgaaccaaaagaggagtttcaggactgcatgttgctctggacaggaagccaacaggggccttattcacctccatggagttcccaggagaggaggaagaaacagttttctttttttgtttctgtgataaaatatcctgacaaaaacaacgttaaagaacaaagagtttatttggtgcacagttccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagtggatgacatggtgctgctgccccagatcaccgaggacgccattgtgagcaacctccgcaaacgcttcatgggatgactacattttcgtatcccaagtagcgcaggggcacaggaggatgaagtactgggacagggaaggatgccaaaggaatggcagtgcagagaggccattgacagaccagcccagggttggaggggaagatgaataaatggaggaaggacgggcagattgaaggatacatcgagtaacaatagtgctatggtttgagatgctgtggctgctacagtacaatgtgcaagtacaagtccttgccttgggagagctaaaccactacactacccactctcctatttctcatccctattccactacccctatccccagtgacttgtacttgccttgggagagctaaaccactacactacccgttctcctatttctggatccagccatcattttgtaagagacacaaggtacattcaggcatctcatctctctctttccaagcaaagggtggtcttgtcgggatagagtaaggggtaagaagagtttgaaaagcaaaacaagatactgtatggttcttaaccacctctcaagacatacatcggctcagtgctaatctctgtaaaccccttcaagcagatgccctacttcactgaccgagaaattgacctctatcagggcgcggtgagtccagggttggatgggtagaagtatctccatacctaccccgaaagccccaaagctctgggctgagtcctgacctcccacaccaggctcaatatgagaatcccccgcacatctatgccctcaccgacaacatgtaccggaatatgctgatcgactgtgagaaccagtgtgtcattatcaggtacagcagggtgagggattctggaacattctatctaggcatgacctcaaacatgaccaccgatggtggtttgtcatgaaccatgcagtgccgtccctctgtccctattgctctgttctacgttccttatatctcttggctcctgaatcagtatatttgttcattttattatttcccatttggttcctcctaaatataagctccaggatggaggagatagcttagcagataagagtgattgctgttcaagaatgagaatctgagttcaaattcctagaacttagattaaaaagctaggtgtaaacacacaaacctgtaactctagcattgggggagactgagataggcgtgttactggggcttgatggccacaaccctagctccagattcagtaacaaaccctgtctcaaaggaataaggcagagagtgatcgaacagcacaccatatggctcctccaacctctgcatataggcacatgtgcatttacatacaccaccaacacatatgccaccctcataacatgtacacacatgtaaaataaatgtgagggtatgatattttacattatattttttattattttgtggatgtgtgtgggtgcgtgcatgcatgcctgccaacgtatgcatgtagcagttcaaagacaatttccaagagtcagttttctcctcccaccatctcaagacttgaactcatgtcttcaggcttggcaacaggtactgagccatcttcccagcccaagggactttaaaattatatcgacttacttatttatatttattgggggtgccacatgccacagtacaagtgtgaaggtcaaaggacaacttttaggaatcaggtctctgcttccaccaaattcagcctggcagcaagcacctttacccactgagccatctcactagccccttcttttttgagagggagacggaattttttttttaatttactgttttcattttaagtgtgtgcttgttttgcctacatgcatagcggagcaccatatccatgcctggtgctctcagaggccagaagaggatgttaaaccacttgtaactggaatgacagggggttattaccatcatgtgggtgtagagaagcaaacactctcaggtcttctgcaagggttaacaagttctcttagtcactaagccatctctccatcccctgaggcaggggcttttttttttttttttcaatctttcttgatcacttttgactctctggaacctagagtagggctggtgcttagtaaacttagcaacagtgggtgcttagtaaaagaatgaataaatgcatgaattaatgaataactaggcattagaaaaggtcttttcaatattactgcccactaaccattccttcctcccaccccctctagtggggagagcggagctgggaagacagtggctgctaaatacatcatgggctacatctccaaggtgtctggtgggggagacaaggtccaggtaagacaagaatggaaggagatgtgggttacacccatctgacccagactgatctctttctacctggctctacccctagcacgtcaaagacataatcctacagtcaaacccactgcttgaggctttcggcaatgccaagaccgtgcgcaacaacaattccagccgctttgtgagttattataacctcaaataagcacttgctgtctctacacacacacacacacacacacacacacacaggcacacattcatacaaacaagtatatacacatttgcacaaacatacatgcacacacagagacttgtatggcaagtacttcacaccctgaatcatctccctagcctccaagtttctttttgtgtggggtgcatgcatgtgtgggtgcacacttaatgtgtgcccatgaacatttacgtgcaagtatgtgagttccaaaggttccagacgttgggtgtcttcctcaatagctcatcaccttaactatttttttgttttattagtatttattttgtacatatgaatgttttgaatgtgtgtctgagtaccatgtgagtgcatggtatgcttggatacccgaagatggcattagaaccctggaactagagtaacagatggttgtggacagacatgggggtgctgtgcatagaacccggtaatctgaaagagcagagctgtttactcctgaactatagatacagcccttctgttctattttttgagacaaggtctctcactgaatctggagccgctcaggagagatcgaaatttaatccccagcatccatgtaaaagctggatatgatagtacacacctgtgacactaggatctacagacagaaggatccagagaaacactttggtcattcagtctagccaatcagtgagctctagattcattgagagatcttgtctcaagaaataaagtagagggattggagaaaaggctcagcatttaagagtgtgaggaggacctgagtgcagatccccagcatgtgagaagtagaggcaggagattcttgcagcaaagtggttagctaaaactagtcaattgtcaagctttggattcaagagttctttccttgatgtatatggtgagaacagttgaggaagacacatagcgttaacctctggcctccacacccacacctacacaagcatgcaccctctcattcacacatccatggacacacacacaaaagaaacatagaaatttctgaaatgtgctgagggggcggagaaacgtgaggtgagcacaaaggtaagtgcaattagcaggagcttagagcatcacaggagatgaatatgttaaggatcgtggccccatacagtctgtgaaatctagagaaaagactggtgaaaagagcaagcttagtcaatatgtaagtggatggtcagcgagatggctcagcagatgcttgccaccaagcctgaggacctaagttcaatcctcaggacttacatgatagagaactaactcccacaagttgcttcagatgactacatgttcaccatagcacaggacacatacatacatacatacatgtaatttaaaagtaagtgagtggaggcaagagagacaagtccagatcataagaggaagtggggaagaggctcatgagattgtaatccttgccccatatatattcctgggagtcagggatatgctaacgtggttctctggaattcagggcaagtactttgagatccagttcagtcgaggtggagagccagatggaggcaagatctccaacttcctgctggaaaagtctcgtgtggtcatgcagaatgagaatgagaggaacttccacatctactaccaggtgcgtgggggaagtctaaggggctggaggcagagggagaccacctggatcccaggaacggaggaaagagaacaggggaagggcagtgtgtgcgaaggtaaggcaaccactatggttgcaccaggctgggtcagatgcatgactttctgacaccctccagcttctggaaggggcctcccaggagcagcagcagaacctaggactcatgacgccagactactactactacctcaaccaatcagacacctacaaggtggaaggcactgatgaccgaagtgacttcagcgagaccctggtaagcaccaaccaccagttcagcccccagggaaccttttcatgttacaaataaggaaaatgaggcacagaaagactcaggcacttatccaaggttatacagaaaattggtgaaagaggcatatcagggagccaaggaatggctcagtgggtaaaatgcctactgtaaagccagacatggtggtgcacgcctttaatcccagcactcgggaggcagaggcaggtggatttttgagtttgaggccaacctggtctacaaagggagttccaggacagccaggactatacagaaaaaccctgtctcaaaaaaccaaaggaaaaaaaatgcctgctgtagaaacataaagatctgagttcaatccctaaaggccacataaaagaggtgggtgtggcagcacatgcttataccccagcactggggcagcagagacaggccgaaaatcctgggattccctggtcatctggtctgatcaaatcagttaacttcaggacgagtaagaaattgtgtcaaaaataaggtggagctctggggagaagatttagaaggtaaaaaggcatttggagtgcaagcctggtgagctgactttagaattcctgaatccacataacagcgggagatggcagcccaggtgtgtgtaatcccggtgcttccatgaagaacgagacggtgagacaggtccagcagctcctgaaccacctagactagctgatgcagcagctgagagagtttgtcccaaactaagtggaaaaatgaagacagacaactgcagttttttctctgacctccagtcacaggcagtgttgcgcgcgcgcgcgcgtgcgcgcacacacacacacacacacacacacacacacacacacacacacacacacgtctttctaacacccaattttttttttaacttggagatcaatagaagaatacacccaaagtaaatctctggcctccaagtaaacttgaattcacatatacatgtgtactcatacacatgcatacttacacaaacatatcaatgcatatatcacacacacacacacacacacacacacacacaaggcaaatcaggcagttaagatgtgttagtcagtaaaatacttgccatgcaagttcaatcctcagcacttattttaaaaattaaaaatccagagaaggagccgggcgtggtggcgcacgcctttaatcccagcacttgggaggcagaggcaggtgaatttctgagttcgaggccagcctggtctacaaagtgagttccaggacagccagggctacacagagaaaccctgtctcgaaaaaccaaaaaaaaaaaaaaaaaaaaaaagaaaaaaagaaaaaaagaaaaagaaaagaaaagaaaaaatccagagaagatagtccctgcttgtaacaccagtactggcaaagacaagattactagggttcaccagccaggtaacctagtctacttatcaagttccaatccaatgagaaaatcaaggtaggtggtacctgaggaatgacacccaaggttgacctctgcctgccatacacatatatgaacacagatgcctagcacacacaaagtaagatcaggctaccaaacatcttgtctccctgagttcatgccacgggcccaggaatctaatcctggatccttggtggagaacaaagttggtagcataagctgtccctgtctttcccacagagcgccatgcaagtcatcgggattccgacaagcgtgcagcagcttgtcttgcagctcgtggcagggatcttgcacctggggaacatcagcttctgtgaagaagggaattatgcccgcgtggagagcgtagaccgtgagtgtgggtgatgtcgggcatcaggctctagtataaggactgcttcttcccacttcaaatcccaagagaaccatgttggtgtcactggggaagctcctatgtccagagatcctgaccagctgcttccttttgctctggcctggcagtcttagctttcccagcctacctgctgggcatagacagtgggcggctgcaagagaagctgaccagccgtaagatggacagcaaatggggtggacgcagtgagtccattgatgtgaccctcaatgtggaacaggcagcctacactcgtgacgcactggccaagggactctatgcccgcctcttcgacttcctggtggaggtgagtaggaccagtcctgggaagtctgacagatgcctggtgcttaacaagcccatggaatttgaacccacaaatgggaaggtaggctttatttgtccgtctcaccagttcctgaggatacacactcacatgcagctttcagcttggacaacctacaagtggagggactgctgaagccctcccagtcccatcacagcaagggagatagagctggatgggtgcatttgagagctaagatggttgtcaaggagacatagggataagtatggagttgggtggagtgagttgaaggggacattatatgtcagggccagtgataatcacactactaacaaacatataacacttagtggagccagatatggtaacacacaccagcactcatgagcctgaggcaggaagattatgaattgaaggccagtttaagctgcatagaatgaccctatggttttccatttatttgtttgcttattattttgagataggatctcccaacctggagttttctatgtaagtcaggttgccctcaaacatacagacatcgggcccacctctgcctcctgatttctgggaataaaagtgtgtactactgtgcctactataagtagaggtctggggcaagacctcagttgataaagtgcttgtttttcaagcatgagtatgtgagttctgtcaacagaacccatattttaatttttatcacgcctatgtatttactttgtgtgcatgtgtgtctgaatgctgcaacatgtgtgcatgtgtgcatgtgtgtctgaatgctgcaacacgtgtgcatgtgtgcattgtgttgcatgtgtgtctgaatgctgcaatgtatgtgtggatgtcagagatcaacttgaggggtttggctctctccttctgccatgtggattcctgagatcaaactcaacatcatttagcctatcatcaagcatctctatccactaagcctcctgccaccccacagttttaaaagccaggcatgagtctggataaaggatctcatcaagcctgatgacctgcgtgtgaatcccagaacccagagagaagagactcctttaaactatcttctggcctccttatgcacactatggcatgcaaatgtatgcactttagcacacacacacacagatacacatacatacacgaattaggaaaaaggagtttttaaaatataacaagagggtggtgaccagtggcatgggtttggccatgtgtccactggccccatttttaccctctcataggccatcaaccgtgccatgcagaagcctcaggaagaatacagcatcggcgtgcttgacatctacggctttgagatcttccaggtttggctctggctgcccctcaccctcagcccaatcctgtctgtctgtcacctaggctcacccagtatttgccagagacattgcatagcccactaacagaaaggccctttcctctcctccacagaaaaatggctttgagcagttctgcatcaacttcgtcaatgaaaagctgcagcagatttttattgagctcacgctgaaggcagagcaggtgggcagggcagccaagtgtcacaagacagcacgtcaagcctaagggtctctatgccactgaggacccccacacacaaattcattccacctctctctgctcgctgcattagattcagcttcctgctactataacaaaataccacatataatttataaagagaaaaggaaagctaggaatgccattcggttggtagagcgcacttgcctagcatgcatgaaggtgtgagttccatcaccggctgcataaactgggtgtggtgctgcatgcctttcatcccagcactcaggaattcaaggtcatccttgactacatagggagtttgtggccagcctggaataggagtggggagagagcaggaggaacatgcagggcatgcctgaaaccagaacatagaggttgctgctgaggcagaggtgggaatccaatttaaataagaaacatagagttgtgtgttgtagtgcatacctttaatcccagcactcactcagaaagcagaggcaggcaggagctctgtgagtttgaggccagcctgatctagaacatccagggcaacatagagagaccctatctcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataaatctgctttgattttttttctccgtcttaaatgcagagtctgaggcaagggtttagcacaaatgatgtattctggaggtgctcatacaaagcaaagacaatgaaaaagtgatttaaaataaatattagaagagcacagcctagggatgtagctcaataagtagagtagcttgcctcctacatgcaaaattgtggattccatccccagaaccattataaaccaggcgtggtggtgcacgtttgccatcccagcactcaggaggtagaggcaagaggagttcaaggtcatccttggctacctattgagttcaggggtagcctgagctacataagacctatctcaaaaaataaaataaagggatgggtatacctaatcctgctgggattacatatcccagggtggggtggtacccaagataggctccagcttctctgagaagagaatggtgggaggggtttgtaagggtgggactgggaggagaggagagagggggactgtgtttgggatgtaaagtgaataaaaaaaattattagagagagagagagggaaaaaaagcccaaagctcaaataagggtattaatttacaactcctgctggctgtatgtcagcaggaccagaggcagggatatcctcccaaggaagagtgatgagatggagaggcaggctccacactgtcttactgccccccacctccaggaggagtatgtgcaagagggcatccgctggacccccatcgaatacttcaacaacaaaattgtgtgtgacctcatcgaaaacaagctggtgaggactttaggagggggcattacaggggactccagagctaaaccagtgtatctggaaagggtttatgatatcctgaggggtgaggagaacccatatttgaaatatatttccagccacccatccattgattcttctgcccacctttcttttatttactcaacattcccattggtaacattttcagagtctggtaatatcctccaagcaatatcaacttggggaaggaaaagaggcacggattccctgcacgccagaagtgggaggagaggaaagacaaagatgggggtgtggggaaagaaggaaagggaaaggggaagagaaagagaaaagaaagcgatcacgttttgagcttgtatttaggagttccctcccaggccccggctcaatcagggaggaccccagccaggctgagccggacctctgctcctctcagagccccccaggcatcatgagcgtgctagatgatgtgtgtgccacgatgcatgctaccggtggcggcgcggaccagacactgctacaaaagctgcaagcggcagtgggcacccacgagcacttcaacagctggagcgcgggtttcgtcatccatcactatgcaggcaaggtgcgtggaactcccttctaagtgggcgccccctcacaaatccctgtccagtttgcaaacttcctactcctctgaccaaattcctcttccagaggggccccagctaggattgtcccagtggcccaaaggtcttccgaaatcgcctagacacctgcctcatgtcccctctgccagagctacagacacacactggcctctaatcacagtttacctaattagcaaggcagctcctaacagacaagatgggtcttctatgctggcacacacaccacagtgttcaatgttagctataagtctctgacaaaaaaaaaaacctgacccacagttccccaaacccatcacaaacaaacaaaatggccgggcgtggtggcgcacgcctttaatcccaggacttgggaggcagaggcaggcggatttctgagttcgaggccagcctggtctacagagtgagttccaggacagccagggctacacagagaaaccctgtctcgaaggaaaaaaaaaggggggggggggctggagcccgtccacctcacgcctcccagaggctacagaaatctcttagtttctgacccaagctatagccaccttcccaagagattccttgctatttccgccacctcggcaggggtagcaaatattcccaaatgtcctcagccagggctgccaaaaccatgagcaagacctctaaaagatcccacttaaaatagcaaccccagggggctggagagatggctcagtggttaagagcactgactgctcttctgaaggtcctgagttcaaattccagcaaccacatggtggctcacaaccatctgtaatgagatttgacagcttcttctggtgtgactgaagacagctacagtgtatgtagatatagtaattaaataaatttaaaaaaatagcaaccccagctgaagccccattccaaaaaaataatctaccaccaaaattccaaatcaccccctgatagccactcacatctacaatcccagaaacagaaagagcagaccatccttggctatatagggaatttgaggccagcctctaattccaaccttccaggggcaaaggcaagcagagctctgtgaattcaatgccagcctggtctacaaatagaattacaagccccaattggctacacagtcagaccctttctcaaaacaaacaaacaacattattctgggagttaaggagatagatcaataaagcacaatcaggaggatctgagcccagatacccagcacccacataaaacaaacccagacaggcggcctggagacaagggacccctgggactttggggcagccagtttagctaaacattgaactaactctaggatcagtgagagacctctccctctccctctctctctctctctctctctctctcacacacacacacacagacacaaacacatttacacaatgacacacagacacacacagacaaacacacatttttaaagagtgaaaaatataaaaagataataaaacgaagagagaagatgacggggtaggtagatgaagggagagttgaggttgacgttggagatacagctcagtgacagtgcatttgcctagcatatttgaggtcctgggtcccatcctcagcaccagagagagacagagacagagagagtgcatgtgctggtctggtagtacacaacacctataatcccagccttccagaggctgaggcaggaggctctaagttcaaagtcagagtaaaggtacatagcaagaccctgacggggtgaaggggaggctttcgttactttgtgacaccactgtgtgaccttcatcagaccttgtcacctctccaagcctcagtttccccatatggaaatgaagcaaagtaagagccaccctccaggactggaatgaggattaaacaaagcaggaagtcacctgcatagtgcctgagacataagtacgtactcagaaaaggccctgtttactggccagttcttgggggaccagatcagggagaggacgaatacagggtatagtgtggtggtgccccttaggtagactaaagagcccccatttgtgcagagatccctttctcattgtccttctctattcctttgttcattccttctgctcctctcccccattctgcttctccccctcctaatatatatacagatacagatatacatgtatattattagatgtaatatatatatatgtatgtatgtatatgaatatgagagagaaagagagagaggtctgaatgtctcaaaagttaaaattcccacctagaatctgctagtagggactgagagggcgagctaaaggatgagaccctgcctagaatcccccagtgaggggctggcatggccatttgatgatggagccattgcctagcctaaaaatccctgtgctccattcctcagcaccataaaaagaaaaaaagttcaaagtattactaatagaaattattacctaacaatatcaaccaaccggacaccccagagctcccagggactaaaccaccaaccaaagacacatggagcaacccatggctccagctgcatatggcctccagtagcagaatgaccttgtccggcatcaatgggaggaaaggccattggtcctgtgaaggctcgatgctccagtgtaggggaatgccagggcagggaggcgatagtgtgtatgtgggtgggggagcaccctcatagaagcagggggagtgggaataggattggggtttgcgaagaggaaatggggaaaggggataaagtttaaaatgttaataaataaaatatccaataaaaatttttttacctacaatgcaagcactagcagctgaagcaggagtctccagccctgtgagttcctgaccatgctatgctacagaatgagaccttgggaaggaagggaaaggctgagtagagagtaggggaagaaggtgggagaagtaaagggttatcaaagaacaaaggtgcaaatgtgtaaaactgtgcctaggaaaacttagttgtaacatgtaagacaggacacaggagggggcaaatggggggagggaagagaatgagaggatgggaaagagaatcccagcttcttaattattgcaggcaaaattcccacaagaaattaatcctccaaaaattgacacacggtagaaaaaatacatagaataaaaaagagctaggccaaagccttctttttcttaagacagagtcccatgaaaccctggctggcctccacctcactgtgcatctttaaactttggttcctcctatcaccacctcatacctggtgcatcacagccacgggttttggtatttctgggggtggagcccagactttgtgaatactaagcaaacaccctgccaaccgaggtacatcccagtccctctggtaaagctatataagaaaaattaaaatttgaggttggctatagtagcttatcgctatatgccaacacttaggaggctgaggtattgggaccagttccagaccagtttagtaagagaccctgtctcaaaaaatttatttgtgggggactggagagatggctcagtggttaagagcactgactgctcttctgaagattctgggttcaaatcccagcaaccacatgatggctcacaaccatctgtaatgagatccgatgccctcttctggagtgtctgaagacagctacagtgtactcacatataataaataaataaataaatcttttttttaaaaaatgtattatgacaaaatttttagtgtgcagacttgaattttgggaaactttactaagtgagaactattaacacatgacaagttagtggtcagtttttattagaatggggatgggggaaacggaattatttgttgagagttttgtttttgacaaggtctcactatgtagccctggctagcctggaattttctacatatatcaggctggcctcaaactcaaagatccccctgaatgctggattaaaggtgcgtaccaaccacgtgttctggtacatccctttaatcccacctctcagaggcagaagcaaaaggatctctctgtgagtttaaggccagcctgatctacactgtgatttccaagacagccagggtcatgtggagagaatctgtctcaaataaataagcaaataaacaaataaattttgtaaatattttacttcttttatgtgtatgggtgttttacctgcctatatgtctgtattccatgtgcatgaagtacctgtggcagccagaagagggcatcagacccctgaaactggagttacagagagttgtaagccaccatgtgggtgctaggaaccaaaccaacccagggcctctggaaaagtagccagtgttcttaatcactgaaccatctcttcaattccctaaatgggaagaactttgggtgcagtcatgaagagaaaacaaaaactattttggatgttgagaatgttgctcatttgatagagtgcttgcctagtacacacaaagccctgggttccttttagcagcccataaaccagatgtaatggtgcatgcctatcatcccagcacttagggagaggcagaaggatcaggagttcaaggttgtcctcaactgcatagcaagagtgaggctatccaggagggtccatgagaagtcagggacttgagagatgccactcgccactctccctccctcctgtccagcttttcctcctggaagagatgcgagagaggaagtttgacggcttcgctcgcactatccagaaagcctggcggcgccacgtagcagtccgaaagtatgaagagatgcgggaagaaggtgaggggccttcattaggaggctcagtctgggggcaagaggattaaggagaggccatgacttttaactacacacatgtccgctcagcttctaacatcctactgaacaagaaggaacgaaggcgaaacagcatcaaccggaacttcgttggggactatctgggactggaggagcggcctgagctgcgccagttcctggctaaaagggaacgagtggactttgccgactcagtcaccaagtatgaccgccgcttcaaggtgagacctgggtgggtgtttgcatctgaggctgtgcctctgctgaggaagcacaccggaaacatacagtaacccatgggacccagatgcacctttccacataagtgtgctcacctagcctccagtcatcctctctcgcagacatgcccccaccaggcccagacacgcctatccacaaggaaaacctccactgtggtagatactggtgtccatcaaacaggacctcatgcggctgtagcggaattggcagagcgcttgcttagcatgcaccctgtgttccattcccagtactacatagaccaggcatggtagctaatgtctacaatcccagctcttgggggaggggggggagatcaggatttcatggccatcctctactatagagtgagctccgggtcagcctgagctatatgcaaccctgggtggaggaaaaggaaacatctcacgctgcactgtcacacccagccccacacccacagccagtaatagagctgtcattcaggtctgtccttgtgtaacccagacagacctacatcagttacaccctcattttaccagatgtctctactctgacatagtcacctgatctagaagccctattccccaggaccacttccctcacctggcttagacacacatgtccattgtaccttagcttgactctgaagcccctgtctatataaacactctaaccaggtcaaggaagccttgttcacatgtgcacgcctgactgttccagaaatcattaatagtcatgaccaattaacataatctagaaaatcccttatagacatgcagttgtatagatgtgtatatgagatgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgataggatttcaatatgtagtactgacacttaaagagatccatctgcttctgcctccccaagtactggagttaagtgcatcaacatgtttttgttttggagacagggtctccctatctggtcctggctggcctagaacttacagagatccacctgccactgactccccaagtgctgggactaaaggcaagcatcaccactcctggcccttagacacatttctgaccacactgggttgagagtggctgcatcttctgtcaggcttagaacttagagataactcctcaaatgttcacagccactcatgacacatatctctatctttgcttccaccataggtttgaatcgaaatggggtaccaccctcttcccaggtaaggtccctacccctggagatcacatctggtaggagttcccagaggcctccacggggccctccatcctcaaccctaggagccagcagacgtcctcgagcacggccaccttcagagcacagtacagaattccttaatgtgcctgaccagggtgtggcagggtaagtgaggaaagatggagggcacagccccgggaggtcctcatgggataagggagtatctagggctgtcctgagacccatgctgttcccccttcagcatgcaaaggaagcgaagtatagggcagagacctgtgccaggagtgggccggcctaagccccaaccacggacacatggcccgaggtgccgggcactgtaccaatacataggccaggatgtggatgagctgagctttaacgtgaacgaagtcattgagatcctcatagaaggtttgtattctgggacaggggtcgagagtggggagccttcagaactcggacacag

SEQ ID NO: 1202 - DNA, 1419 bp, Mus musculus
atggtgctgctgccccagatcaccgaggacgccattacatacatcggctcagtgctaatctctgtaaaccccttcaagcagatgccctacttcactgaccgagaaattgacctctatcagggcgcggctcaatatgagaatcccccgcacatctatgccctcaccgacaacatgtaccggaatatgctgatcgactgtgagaaccagtgtgtcattatcagtggggagagcggagctgggaagacagtggctgctaaatacatcatgggctacatctccaaggtgtctggtgggggagacaaggtccagcacgtcaaagacataatcctacagtcaaacccactgcttgaggctttcggcaatgccaagaccgtgcgcaacaacaattccagccgctttggcaagtactttgagatccagttcagtcgaggtggagagccagatggaggcaagatctccaacttcctgctggaaaagtctcgtgtggtcatgcagaatgagaatgagaggaacttccacatctactaccagcttctggaaggggcctcccaggagcagcagcagaacctaggactcatgacgccagactactactactacctcaaccaatcagacacctacaaggtggaaggcactgatgaccgaagtgacttcagcgagaccctgagcgccatgcaagtcatcgggattccgacaagcgtgcagcagcttgtcttgcagctcgtggcagggatcttgcacctggggaacatcagcttctgtgaagaagggaattatgcccgcgtggagagcgtagacctcttagctttcccagcctacctgctgggcatagacagtgggcggctgcaagagaagctgaccagccgtaagatggacagcaaatggggtggacgcagtgagtccattgatgtgaccctcaatgtggaacaggcagcctacactcgtgacgcactggccaagggactctatgcccgcctcttcgacttcctggtggaggccatcaaccgtgccatgcagaagcctcaggaagaatacagcatcggcgtgcttgacatctacggctttgagatcttccagaaaaatggctttgagcagttctgcatcaacttcgtcaatgaaaagctgcagcagatttttattgagctcacgctgaaggcagagcaggaggagtatgtgcaagagggcatccgctggacccccatcgaatacttcaacaacaaaattgtgtgtgacctcatcgaaaacaagctgagccccccaggcatcatgagcgtgctagatgatgtgtgtgccacgatgcatgctaccggtggcggcgcggaccagacactgctacaaaagctgcaagcggcagtgggcacccacgagcacttcaacagctggagcgcgggtttcgtcatccatcactatgcaggcaag

SEQ ID NO: 1203 - protein, 473 aa, Mus musculus
MVLLPQITEDAITYIGSVLISVNPFKQMPYFTDREIDLYQGAAQYENPPHIYALTDNMYRNMLIDCENQCVIISGESGAGKTVAAKYIMGYISKVSGGGDKVQHVKDIILQSNPLLEAFGNAKTVRNNNSSRFGKYFEIQFSRGGEPDGGKISNFLLEKSRVVMQNENERNFHIYYQLLEGASQEQQQNLGLMTPDYYYYLNQSDTYKVEGTDDRSDFSETLSAMQVIGIPTSVQQLVLQLVAGILHLGNISFCEEGNYARVESVDLLAFPAYLLGIDSGRLQEKLTSRKMDSKWGGRSESIDVTLNVEQAAYTRDALAKGLYARLFDFLVEAINRAMQKPQEEYSIGVLDIYGFEIFQKNGFEQFCINFVNEKLQQIFIELTLKAEQEEYVQEGIRWTPIEYFNNKIVCDLIENKLSPPGIMSVLDDVCATMHATGGGADQTLLQKLQAAVGTHEHFNSWSAGFVIHHYAGK

SEQ ID NO: 1204 - DNA, 256157 bp, Homo sapiens
  misc_feature (1)...(256157): n = A,T,C or G
attgtatagaaatgcacctgagccatgtttcctacatggcatcaggacaatgggccaggcaacaaaggaaccttttgagctatctcttggcggtgctgcctgccagtccatagctcaggtccacctgtgctaccagcattgtcaaactacagtatttactcaattacattcatactgggttccatttagccttgtcgctttttcaaaattagtgaaatatggagaaaatataagtgcaaacactagtaaaagggagtgttgttctcataaacataaaacaattgagacaaagaagggaatcattaggtgtggagaaggtagtgaatatttagcctcaataatgacaactcataccgagacgttgctacgcatcactcatcattgctattactttatatgatttaattcatattcttacaacactatgtgagaaataaatgatgaaggtactattattatctctgtctttacagataaaaaaaaattcatgatttataaaggtaaatagcctgacccaaatcttaaagctgcctattggacttcaggtggtcaactttgctcagctaggatggagatgctcagattttaaaaacatctatgcatgctggaattatagcttaagactatgtctaggggacagcacacaatcagggattttatgctacattttagatctctgaaaatagaaacctgtgcttaaagcacacggatttgtctttgaactttatatatctgacattggtgtgtgttttgggaacgtgttctatatgaaggtagaactctcttgcattgttgtatgttttggatgtacatgtaaacatgtgaatcctatgaggactgggaacttgtcttctacttctccagcacctacaacagtgctcagtaaaggttggttgtggtggtgagtgataacagtagtcagttggaaaccatgctgccatcatgctgaacaccaagaaacactctattcaatctccccaagtgtttgtaacaatatattgaaaaacatgtcatctatctgagcatggtggctcacacctgtaattccagcactttgggaggccgaggagggaggatcgcttgagcccaggagcttgagaccagcctcggcaatatagcaagacccagtcctacaaaaaaagaaaaaaaaattagctagccatgttggcaccgcctgtagttctggctacttgggaggcagaggcaggaggattgcttgagatatgtgttcacaccactggagtccagcctgagtgacagagtgagaccctgtgtcaaaaaaaaaaaaaaaaaaagaaaaaaatgtcatcttaaatacacacacacaacacacacatctatgtgtttacacaaatatttaaaggcatgtaatcaaaaacacatttataagtacatgataataaaggaaaaatgatgtcacatctcaagtatgtaaacacatttacaggcacaatgatgacaaaggggaaatgatgatgatcattacaaaggccatacatttttttctattgaagaggtgaacggaattaccctcctggactcactaagtgtagaaatcgaggcagcagacaggcaaagtcagcaaactgctgcatgccctaaatttggagtgtctaccctgtcttccttccccagagactctgtccccatctgccatctctttttaatggggcagtaagctttaggacatcactcctctcacagcatttgcttggaatgtgactggacaggcacctggtcccagcagagccttccttgtcagtgacctatgacctgggtggcgtgatttaaaaggttgagctgggtgagtcagattctttctttttttctctccgtccctttctccctatggaacttgaatcaaaagtctagagggcagtttccagtgagctgtgggcaacattgtaaaaaacgttattctagggcccaagtcagatcatgacaggctacaggcactttgcaagctgaaatcggggaagaggaacaactgtgagttaagtgggagaagcttcaagagacagacaagaaaagaacatccaaccacgcagagatgcacagccctgccttcttttgtcttgtttttcctgggctcctgggcatgtatactttaaaaaaaaatttctttctggcctagtgaagtggctcacgcctataatcccagcactttgggaggctgaggcacttggatcacttgaggccaggagttcgagaccagcctggccaacatggcaaaaccccatctctactaaaaattcaaaaattagataggtgtggtggcacgtgcctatggtcccagctactcgggaggctgaggcatgagaatcatttgaacctgggaggcagaggttgcagtgagccaaggtcgtgccagtgcactccagcttgggtgacagagtgagactctatctcaaacaaaaacaaaaacaaaaacaaaaaaataaagcaaaggccaggcatggtagctcacgcctataatcccagcactttgtgagggtgcagcggctggatcactggagatcaggagttagagaccagcctggccaacatgatgaaaccctgtctctactaaaaatacaaaaattagccaggtgtggtgacgtgcacctgtaatcccagctacttgggaggctgaggcaggagaatcgcttgaacctgggaggcggaggttgtagtgaaccgacatcacaacactgcactccagtttgggcaaccgagtgagactccgcctcaaaaaaaaaaacaacattattttctttaaagtaacccatgtgctcttctgatccttgttagtaaaagagactaaattggagcaacacataacggcagaaaaaagtctctcttggccaggtgtggtcactcacctgtaattccagcaatttgggaggctgaggcaggaggacagcttgaggccgggagtttaaggcagcagtgagctgtcatcatgccatcatactccagtctgggcaacaaagcaagatgtcatctcaaaataaatgaatgaatgaatgaataaataaataaatgaataaataaataagtctctgccagtggaggatataaacacacacacaccaaaaaaaaaaacacaggagaaccatataagtacagcagtccaagaccatgaaagatagtggcaaacagtcatttcatctgacagtcccccaggaccttggttcgtgcaatcctgtgcaataatcaatatttatggtaatgaccttgagtcttaaagcaaaagctgcctgacattcaatgtattttcagaagtcaatgaaatgtgtagtttcattcagaaaaaacttttcttaaagttaaaaaaaaaagtcttggtatctaaaaatgacaagatttggctgggtgtagtggtttatgcctttaatcccagcactttgggaggctgaggctggaggactgctttagcccggagttcgagaccagcctgggtaacatggtgagactctgtctctacaaaaaataaaaaaattagccgagctataggtagtgtgtacctatggtcccagctacttgggaggctgagacgggaggatcccttgagcctggcacagtgatacctgtttgtgcctctgcactccagcctgggagacacagtgtggtgctgtcaaacaaacaaacaaaaaaacaaaaacaaaaaaaaaaaaagaaagaaaagaaagaaaaaaggaaaaaaggcaaggttcatgcagagatttgttattttttactttttgaaatgcacatatttattgatccacgccttgccttgttgtagcaaagagctcagatgacttataagaatacacaggatccaacaggaaagtaaacattgacagtgaatggggaaaataaagaacatcaaggtatggacaagagatttagttatctgcaaagctcatttccatggacttcctcattccttgctagatcatggaccaccataactagtattaatcattgtttcaactccaaattttttagatttggagaaagatcaaggtttatcttctgaatgtaaaaatcaaattgaaactggaagaaaagaaaatattgatttaaatcagagaaaatataataataaatctacacaaacatgcttttaataagctgctaatttaagcatatatttaaatcatttctattcctttacttcagtaaaataattcttaaggcaaaataattttattttattttatttttttttgagacagagtctccctccgtcacccaggctggagtgcaatggcactgtctcggttcactgcaacctctgcctcctgggttcaagtgagtcttctgccccagcctcctgagtagctgggattacaggcacctgccaccacgcccggttacttttttgtatttttggtagagatggggtttcaccatgctggccaggctggtctcgaattcctgacctcaggtgatccacctgcctcgacctcccaaagtgctgagattacaggtgtgagccaccgtgcctggccttaatttatcttaatcagaagtagcatcatgttacattatacaactggtgaaattctcttcaacatcctttttataaaccaatatcaacatactgggggaaaaagtgtttagagttaaacttactgtgtaaatgtaatttttatattccattaaaaagcaacaatttttctgggagctctggtttggaaaggctcacggggtttcaataagtgtgttcctattcattttgggcctgcattagggacaatttcttctgatggacatttctattacgcaatcactgcttaaagggtaatagtgtaggcttcagagccagacaaatgtatgtatttgatgcaggatagctgagtaatagcttggtcaaattactttaagtcttctcaacttagtttcttaactgcaaatggagctaacagggtcgtatggaagattacataagatattgcacattaagcacttagctcagtagctaacagctagtgaacctaatacatgatgtatgttatgataaaaatagtgattgtagaggacatttcacactgatatgatacaagtctctctttcattagtgtcttgttaaaggtttctaattttcccattgacaaattttcttttttttttggagatggagtctcgctctgccacccaggctggagtgcggtggcaggatcttggctcactgcaacctccgcctcccgggttcaaacaattctcctgtctcagcctctactacagttgggactacaggtgcaggacaccatgcctggctaacttttgtatttttagtagagacggggtttcaccatattggtcaggctggtctcaaactcctgacctcgggtgatccacctgccttggcctcccaaagtcctgggattacaggtgtgagccactgtgcccagccaaattttcttttcttttctttttttttttttttgagacggaatctcactctttttgcccaggctggcccgcactggcctgatctcggctcactgcaatctccgcctccggggttcaagagattctcctgcctcagcctatcgagtagctgggattacaggtgcctgccaccacagccagctaatttttttttgtatttttagtagagacagggtttcaccatgtttggccaggctgctctccaactcctgacttcaggtgatctacctgcctcagcctcccaaagtggtgggattacaggcgtgagccaccgcaccagccccacattaattaactttagtgttgtgagtgcattctgaatgattttttatggtattgacagggaaactagttttattgctcgatattattttcttgctgctttccaaaatgcataaacaatgatttagttcactgatagatttatacagaaaattttactttgtattcattttgatttttttatttgttccttttcattcagccccagaaaaaatgcaattaatcatgccaaggtatttacaaagccttatctgactagctccatcatgtgtctagaatgagttttacaattttaaaagttgcttccacttcactgctactatggtcttgaataagaataaatatctggctgggctcagtggctgaagtctataatcccagcactttagggggctgaggtaggcagatcatttgagatcaggactttgagagaccagcctggtcaacatggcgaaaactcatctctactaaaaatacaaaaattaaccaggtgtggtggtgggcgcctgtattcctagctactctggaggctgaggcaggagaatcacttgaactcaggaggcaagaggttgcagtgagccgagatagagccactgcactccagtgtaggtgacagagcatctcaaaaaaagaaagaaggccgggccacggtggctcacacctgtaatcccagcactttgggaggccgaggtgggtggatcacgaggtcagcagttcaagacaagcctggccaagatggtgaaaccccatctctactaaaaatacaaaaattagctgggtgtggtggcgggtgcctgtcattccagctacttgggaggctgaagcagagaatagcttgaacccggaaggcagaggttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctccgcctcctgggttccgccattctcctgcctcagcctcccggtagctgggactacagtcaccagccaccatgcctggctaattttttgtattttttttttttttagtagagacggggtttcaccatgttacccaggatggtcttgatctcctgacctcgtgatgcacccgcctcggcctcccaaagtgctgggattacaggcgtgagccaccacgcccggcaaaaactgcttttatatatatatatgactttataataatctcatgctcatatatattataaaatgatatataatcatatataaatcatatgtacatataaaatctcatatatattataaaaaatgaacacaagcatacatcttcatcaaagtcctgcctactacagttagatgtacctcttgaaacttggaagagattatagattattagggcaataaaagtaaacgctaaaacatttttttaaaaaatcagaaatgatgatataatggactaatagtctcaaggtagtttttgataaatccaagactgatcaattgtcagtcgactgtcaatggcttattaagagattttcagtgtttcattgtatacctgggctaatcttgggaaaaaaactatgcctttgtctgtacatctcaaagcccatgtcaatctgactactaatgagggttgaccatggatgggatggtgtcttaggtagtgtttcttgtgttactggtaagctgacacttccgtcttggtaacctctgttcatacactcctaaaattcctgataggttttgttgttgttgttgttgttgttgttttgagacagggcttcactctgttgcccaggctggagtgcagtggcacgatcaaagctcactacagcctcgaattcccggcctcacatgatcttcctgccttagcctcccaagtagctgggactacaggcatgcactataatgcccagctaatttttattattataatttgttgatagagacagagtcttgctatgatgcccaggctggtcttgaatgcctggcttcaggcaatcctaccatcttggcctcctaaagcgctagcactgtaggcatgagccactgagcttggctgacctaataatattctgaagctgatatttccctatgagatatggagtcagacttatctgagactttatcatgtctgtgtgtacctaggcaatgcctagtacagatggcatgctgttttctttccaattcatactacataactatgtcagatgaatttcctgccctaaactatagctccaaatatggcagttccttgcacaaaactactgtcgcatttcattatgcttgcttctttcctgtatttattctttctaaaaatttatcgtttgttttccccatcctaaaattgtaagctcagtgagggcagggaccagttgtagctccagtgtttagctgtgctgtcttataacacacattcgattatattgttgccaaactatgtaaatgattactacaagaatttggacaatatggttttctttcaacttttaaaagtgagatataatgaacgtaccataagactcacccatttaaaaagcataacacagtggtttttagtatattcataaacttgtacaatcatcaccactaattccagaatattttcatcacttcaataggaaaatgcatacctgttagcaattacttccatttcccctctcccccagcccctagcaaaccactaacctactttttatctctatagatttccctatcctcaactttcatttaaatggaattatataatatgtggtcttttgctcctggcttaacacgatattttcgagattcatccatgttgtaacattttgtttacccttttagacaagataaagtttaataccctttctaactctatgctcagatagtcaagtgaagagctacaaccaaatttctttttcctttcttcctttcttctctctctctctctttctttccttcttttttttttgacagaatcttgctctgtcgcccaggctggagtagagtggaacgatcccggctcactgcgacctccgcctcccctgttcaaacgattctcgtgcctcagcctcccgagtagctgagattacaggcatgtataaccatgccgggctaatttttgtatttttagtagagaaggggtttcaccatgttggtggccaggctggtctcaaactcctgacctcacatgatccaccaacctcagcctcccaaagtgctgggattgtaggcgtgagccacagcgccctgcctcaaccaaatttcagaaagtatcataatatcattatgcttcatagtttctctatgccctgaagtttaccaattttatcttctacagatcccaggaaggcagcctgttaagactcaccaaatttacttcctcagcctccagaacaataaaatcaaactccctaccttgattttaagattctgcttccccccaccccgccccaccccaatcttctccttggatattcgacagtctggaataatgcatttttacagttctgattgttttcagcagatgtgttggctgaggttggatggggtttcttcccacctatctctcctctctccttccctctgcccactgcacgtgcaacaacttttctgccatcaaaacgtgcaaaaaagaaacaagaaagaaaggaaagagaaagaaaagaaaaacagaaaaaagaaaagaaaaagcagccggaagtcttcctttgttttccaaggaaattcaggtaaaaggaggggtggggaaatgatatttttgactttgctcacaatccagacgtaggaaagaaaaaggatttcctttgggctgctgccacgactctgatgttttatgctgataaaatatttccttcttaaaaaaaagttctgggaaaatcatgccccttcaacttggaagcgaaacccaccctaactttcgtcttaaaacgcagcgaagtgaaaggtttgctcctctttcacgagggttttgttccttacagttcgggtcttgctaccaggagcgagctgggtccgcagcgttcttcggtggctggcgcgggaggaggactacaggatccagagatctttggaaactccagcagctccaagcttgttggctactacggtttccctgaggagtgacgctacgaaaacaaaccctgattggtcaggcctgagctgagttctccatttatggacagattgcccggcccgagccgagactcagccagaggagtacggattaagtggccgaagaaagaggagtgaggcaggggagcgaggcggacgctccgagcgcatcggactcacctgggccggcggcgagcggcgagtacgagtggactcttgccctccgcagcatgcgccccgcctgctaagtcgccgccgtctcgccctcacctagcaccgccaatcccgcctggatggagtcccctctgggttcccattggctcctgtgagtgcttgggtgtcgggagcctgtttttggcgaggggaaccaacttttgaagttcgcccagaagactgcgttccagccccagttccccggcagcgggacccggcgaagacgcgaccgcggcgcgagtcaccatggtgagttggccgcgccgcgtcctaggacgccggacccggggacggggcaggaaaccccggcgtggtgcacccaccttgggcgcgctgcctgggccaggggtggagaaggtggacgcgggagccggcacgtcgcgagctctgatttcctgccgctttccgtaaacccgggccgggggagagcgagcgaggggccaaggaaaactttattccaagtcggtttctgcgtcgcgaaactttctgtggccgggttgctatggctgccagctgtcggaagccagggtgtgggcgcatcggctgcgaggggcacggcgcgggagggggtcccctcctcctgctgggacgtggggggcgcagccggcaggggaggtgctcggagactcgcgccgcagccgctggcggcgtcccctgccctccccgcggccgtgcccgccccgccccgggcaccctcgcgccgactccctctcctccccgccgccgctccgctgcccggcagcgcccgcagctgtcccgcctggcagcggcacgcgggcgggggcggtccctggcccgccttggcgaggggcggcgcgggccgcacaaaggcaggcgggggcgccaggtagggcgagcacctggcggccggcgggctgtcaagagccagggagactcgggcgcgggcggcaaccacgccgccccggacctgtgccgggcgccggccccgagggtctccgcgccccggacgccaagtaaacacctcctgaagaggaccccaccccttcccaagcgcgaggggatcggggcttttcggggatccaggggacgcttcgcacgggaagacgccctcgcgagtttcgagtttgttgctgttttccctttggcactttgggaatgtgtggaaggggccgcctctttgacttgtgacttttctgctattccaactccccagtccagctacactcccctccctccctgtataaccttagccacctcccttgggctttggcgtggtgtacttttctttgcggggcacgaaagcaaggactctattttgaagagatcggcagttcatcaaaaaaaaaaaaatctattacaaggcttcatagtttccacacttgcttcttttcaagtagtcctgcttaggtggattatctcgtcctcttctggtttgctgttgttttctaatggctgtggaagagaagccaagtcaaaatgataaccagcacaacactaattaaaaaatcgatatcccggtgagcagcctgagggaagtgcagtagaggcccatcgaaacctgcacacaaagctcagaagcccccttgccccgtgctgtttattccaaagaatgattacaaacaaacatcaacgagaaacctttcaaggcatcctcggccaaagccttttctttttacatagtccaaaattaagtcacttttgccccatctaagagaacactttgtctatacatttcctcttctagttttaaggtttaagaagtcagtctactctacgttacttttggaccccttccctcaccccagcagagaaccattcccattgggcatgtgtttgggtgaagctacctcactgggcacctggtcccttgaagcagtgtgatagtcctggtacttgagaattgctgtaatcattttccgtgggtcaatatttcttaaaaaaatcaatgtgtttatgtcaagaacttaaagaatcttactgaatttaagtacttgagtggtaccttgaggaaattaacttcccctcagttaaactcatttttcatgctgaatggactgaaatatactctaggttgccttttccgaaacctgtgataccatgcttaattcagccccattgcagatgaagtagagggttggtcaaatgcatgcgaagaaggcatgctgtagggaagaggtggttctatctgaggacagtgtgtgacttccctattgatgggctccctgccatcagcacagatgggcatgttgtgtgcccccaggcgactatctgtgcatcagatatggttgctgaagtcacaattcactgatggaaaagttgaaacagctggctgtcctgaaacaggagatgtgccattgatagatctactggatccagagtgatttggccaaagttaatcatttctttcctgacttgaaaaattgttcattatgtatgtgaagttgccttagaatagagcatcatcttaaataatcagaaacccaagttacaatatttaatgtttatgtcagactctgtcaagccaaatgatacttcattttgtgttccacatctgcccaggcctgcccaagttgtatcccttcagctgcttagaacaggaagggaaaggacattaccttctttgggtgtggctgaagattagcatggaggctaaaattcatcagaaggcccttggcggccaggcgcagtggctcacgcctgtaatcccagcactttgggaggctgaggcaggaggaatacttgagcccaggagttcaagaccatcctgggtaacatagtgagaccctgtttcagttaaaaaatattaagaagaagaagaagaaaaagaaggcccttggctgggctatagggagaacacctataccgtggacttcttctgtgtgagtgtgtgtgtgtgcgtgtgtcttttaggaagtctggtagcatagtaggagggctctccatctgtacctgaggccctactaagactcattcagttgtgactcataaggaaaatagccattttcattttctgactcatgaacacagtgtacagcttgtagttcaccttctatcttcctcctgaaaactcactttgggacacttttctatcttgagaaaactaggaacactaccaggcaatagttacttgtgtctttttcctaaggagacttgaagaagttaaaaaaaaccctgcacatctttataatttagtggaggttgtttagcagagtacaaaaaaatctctgttgactttaaccgtaatacccatctaaggcttccttcgtagaatctgggcttatcatcatctgcaaaggaagttctgcttttgtggccatgaccagtttggactctctgatagactgaaacccatggctgtaggtccgctatgtgctttggatccagaaattgtgattcatttttatgcaaggtttctgtgcattaaatatacagaaatatttgagcaaatctgaattgaccatcacctcaaaacatgttcaagagctgttcccttttccttacttgcatatacttgtgaggaaattatagatatgacacataagaatacccaggaatagatttacaacctagaaatctgatgaatagctgatgataaggtaggtaagttcctttaggtgatggcatggcatgtatttagaaagtctggaatacatttcaaatgtttcctgggaaggtaacctacttgatttccacagattagtttatcagattgctagtagtctcctagtcaaaacaacacaatacaacaaaacaaaaccagaaaggaatgggatcaagcacaaaaaaagttttgatggaggcaaagggttggggaaatacctagagtccgggacattatctagggacaagtgtgagtgggccatcctagtgggaaatatttgacagcccaggcatctccttggagagaaaatgggtggagcagtggatggagagggatggagaagtataagaagcagacatttactgaagttgaaagtcacctccaccacacttttgctgaggactacagtcttgtcagtggttgcaaactttttttttttgagttggagtctctcactgtcgcccgggctggagtgcactggcgcgatctcaactcactgcaacctccgcctcccggtttcaaacgattctcctgcctcagcctcccaagcagctgggattacaggtgcctgccacaacgcccagctaatattttgtattttttagtggagacggggttccactatgttggccaggctggtctcaaagtcctgacctcgtgatcctcctgcctcggcctcccaaagtgctgggattacaggtgcctgccacaacgcccagctaatattttgtattttttagtggagacggggttccactatgttggccaggctggtctcaaagtcctgacctcgtgatcctcctgcctcggcctcccaaagtgattacaggcatgagccactgtgcccggccagtggttgcaaacttaaatgtcttataatttggtggagggaggctggcctctagagagtaaatatggaatatatgtgccattctaggaggcaccactacttgattctaggccatggttatatcgaccatattaccaaattatcttgtttttcaagagaaactagaaatctagatttttatgctatatctgccagttcttatttttatttattttgagacagagttttgctcttgtcgcccaggctggagtgcactggcgcgatctcggttcactataacctctgcctcccaggttcaagcaattctcctgcctcagccccctgagtagctgggtttacaggccccaccaccacacccgcctaatttttgtatttttagtagagacagggttttaccatgttggccaggctggtctcaaactcctgacctcaggtgatctgcccgcctcagcctcccaaagttctgggattatagacgtgagccaccacgcccggcctctgccaatttttatatgtgatttgatcatctcagaggggccaaacacagctgcagattagctgtttgcagccactttattgtaagtcttaacatggtgtccttctgtgaaccacagtgattcttctcattcactcaccaggaagaatgtctaaacgttcactacatacccagtagtggcattcagtatttatccatacatccacaccttcctactgggtctccctaaagagagggaatagcctggtattttcagcctatgcattctctaagctattataacagggaaaatctgcatccagctgctactgtttggcgctatctcaacacctgtgtaggatggttccacgagtggtgaggctgcaaattgagcttttctcttcaacccttcaactccttcctccactgaaaatgccatggcctccaatgtcacatgatggacttcttgtttttcactcctttttcagttgaatctcatgaattggcggtctgtctcaggcgttttcctgagggttagataatgagcagcggcgtgcattctgataacttagaatacaacattttgcctctgtgcctagtgtgggcatgtgatgagcccctgtgagactcagtgaaagaacatatagtaccttgcgtttcctcatgagccaagtgtggggccttattattcattaggaatttgagaaatctctttttatctgcttcaacaagcagaaatattttaaatcttctgtgtaagtgcaaggtattataagcttcatggtaggatatataggaattatgtacagtcatggttttccaagtttgagtcatctcttttttttttttttttttttgtgaaaatgcagcaacttgtgtttttaccaatctgtgattaaaatgtttcttaatggtgagtttttaaaaactttttttttctttttctcaccatgctgaaatatttacaaagtaaataagaggttaaaggttaaatgccaaaggtattaaaataaacatctcagccttataagcacattctgtaatagtggtaaacaaattgtgttttgaatttcagtttcagaatttatgttggcagagacaaaaggttttggggcatcctagcaaagtatttttttcatatatctttgggacagccacacttaagagaagtacaactgtaaaagccagccctaacatagtgacatgaactttgacaacccatagaactcaaactgtacatgtgaatgaagttggcccgcccttctgagttaccaccatgagaatgacgtcattgccattgttcaaagcacttttgaatggtcatttatgagctatgtaataaaacctatttttttgccgggtgtggtcgttcaggcctttaccaaaaaaaattttaaaaattagccacgtgtggtgtcatgcactatagtcccagctacttgggaggctgaggtgggaggatttcttgaactgaggagttcaagtatgcagtgagctgtaactgtggcactgcagcctgggtgagagtgagagagagagagagaaagagagagaaaaaaaaaagaaagagacagggctgggccctgtggttcacgcctgtaatcccagcactttggggggccgaggtgggcagatcacctgaggtcaggagtttgagaccagcttggccaacctggtgaaaccccgtctctactaaaaatacaaaagtagccaggtgtggtggtgcatgcctgtaatcgcagctacttgggaggctgaggcagagagaatcacttgaacttgggaggcggaggttgcagtgagcctagatcacgccattgcactccagcctgggcaacaagagtgaaactctgtctcaaaagagagaaagaagggaagaagagggaaggagggagggccttattttttattttttaactccttagtgcccagtgtgatcattcctattactcaccagactttgtattacatccctctcaggtgtttccagaagttacattgtgcctcaaaggcggaacaattagccccactaaagatatgcagtatccagcaggtccctttttcctggaataagtataagaactgctctgaaggaggcacactctcttgggtcttttgagctctgataatgtttgttacaaattcatttatagcactttatggtcatacgttacattatagaaagtaaaacataggctacattgtagaaagcccagaagagagcttaaaaattctatcctaaatccatttgttaacttcacagagagatctagagaggttaaattacttccaaagtctcatagctagtttttagctgagttggtgccagaatccaagttagatctgatccagtgcagatctaaccttattagatcccagtctaataaggtttttcttaccaaacagtggtgggaataattctttaagagtctggacgtgaccagatagttttctttctgggacttttcaagaaagtctgcttgtaggtggaaggttactgtactaacttcattataagaaatttagaagaattcagccgggcgcggtggctaacgcccgtaatcccagcactttggaaggctgaggtggagggatcacctgaggtcagaagtccgagaccagcctggccaacatggtgaaaccctgtctctactaaaaataaaaaattagccgagtgtggtggcaggcacctgtaatctcagctacttgggaggctgaggcaggagaactgcttgaacctgggaggccgaggttgcagtgagccgagatcacaccattgcactacagcctggggcacatctcaaaaaagaaaaaaaaaaagaaaaagaaatttagaataattcacccaaagtacccccacaccctaacacagtaattatttttgtctctgggtttcctttcagtctgttcaaatgcattgtttctttgtttgtttgtttttcttgagatggagtctcactctgtcgcccaggctggagtgcagtggcataatctcggctcactgtaacctccttctgcctcccagtttcaagcgattctcctgcctcaacctcctgagtagctgggattataggtacacactaccatgcccggccaactgttttatttttagtagggacagggtttcaccatgttggccaggctggtcttgaactcctggcctcaagtgacccaccttgacctcccaaagtgctgggattataggcatgagccaccacaccgggcctcaaacacattgtttttatgtggttataattatggggcaaatatacaatttgtgttctgttatttttccacttgttttacaaatcctttttcttgataagcatatttgttatattttggtggcagtattataatcccatgtagccggattactcactgtgtgtcataactgtatggagacttcctccagaagtgtgtacaggggagagttcctccttccacccactagaaccgctgtggtcagtaatgggctgcttaatctttggctcctgagataagaagccccctctttgggtgagcttgggatgcatactccacattcccaggttctagcccaaaggtacctaccattggtgctccccctggattctggcgttgacactcaaatatgtgacaccagtgggtactcagacctctaggtcttccttggcaaatatgagtggtcttaccagagaacgggagtggatggagatggagagctttgaacctcaaagtggagagaagacattgccatggcaaaggaggttagcatacaggcttggtgaattagagctgggcatggtggctcaggcctgttatcccagcactttgggaggccgaggagggcagatcacttgaggtcaggagttcgagaccagcctggccaacatgtcaaaacccccgtctctactaaaaatacaaaaaaattagctgggtggggtggcgggcacctgtaatcccagctactcgggaggctgaggcaggagaatcgcttgaaatgggaggcagaggttgtggtgaaccaagatcttgccactgcactccagtctgggcgacagagcaagattccgtctccaaaaagatgaattagtctctctgcctctgcttatgagaagctccccatatagtggagaaatgataacaaaaggcttccatatacatgatttcatttcattctagcaccagtgttggtttttattgccattttacaggtaagaaaatcaaagtgtagtgaggggaggggaattacttagggccacacaatttgtatgtgaccagccagatctgctaagtccatgctctttgaaaagtggttcaataaattatttctaaatttgacaatgccgagtccacgtatttgtatactttttcattatttcacatactcctgagggaaggtaaggctgatagaaaatcaccaattttggttgattttattcagtaataccagaggggataatttagacttaagaacattgtctgttatgaatagtagtgttctgagttttaatttccttgctttgggactttgccaaagagactagaagatgtcatagtgagagcaagcataaaagtaaaagaaagtaatactggccgggcatggtggctcacgcctgtaatcccagcaccttgggaggccgaggcgggtggatcacgaggtcaggagatcgagaccatcctggctaacatggtgaaaccccgtctctactaacaatgcaaaaaaaattagccaggcatggtggtgggcaccagtagtcccagctactcaggaggctgaggtgggagaatggcgtgaacctgggaggcggagcttgcagtgagccgagatcgtgccactgcattccagcctgggtgacacagcgagactccgtctcaaaaaaaaaaaaaaaaaaagaaagtcatactagaaggctctctaatcttaactaggattaaaaaaaatagaaaataggaaaatgtgagaacaacagagatttagttgtttaattcttaaatacattacagaatacaacaacaaaattagaatatcacattgttagtctcctaataatttcttcggtgtgaccaccatttgatgttgacagcaatttaggataacattacatggtcacagaatattttggacagtattatctgattctaagaaattttcaatgaaaaaataatagggctgtttttggtgtcctaggaagatgcagaccttatagaaaattttagatttaaatgcagaagaatctaataagctattttaagaatgtaagtaaagatagcttccttcaaggcttgggaatgctgtaatgcagaaatatgcatcaatgcaaaatgatgacagtgccctttctccacatcagattatcagagattcctaacatttggatgggagaatgtcctgagtcctctgagaatatgttggaagctactgaccttttccctgacagtgtttataataacaaataaacattccgcagatcacgagaacaaacaaaacaggaacaatctaaatgttcattggaagagaaatacatgtggcttgtttgataatatggtatcaatatgcataggtgtcacaagggtagtgtttggtaaagaagcaagttgtagaaagacgcatatctgaaaccatgtaagaaaaatgtcaaaaacacaaaataagactgttatttgggggtctatacatttatttgtgtatgtgtacatatatgtatttgtgtggatattattttaaaaaatataggctgggcgtggtggctcatgcttgtaatcctagcactttggaaggccgaggcgggtggatcacctgaggtcaggagttcgagaccagcctagccaacatagcgaaaccccatctctactaaaaatacaaaaattagcctggcgtggtggtagacgcccgtaatcccagctactcgggaggctgaggcaggagaatcgtttgaacccaggaggaggaggttgcagtaagctgagatcattccactgtactccagcctgggcgatacagcgagactccatctcaaaaaataaataaattaattaataaattaattaaaaaaatccacagactagaaagatccacaccaagttcaaaatactgaagggggaaagaggaaagggagacgactgagtcagtaatgttttatttgctttacatatagaaaaatccaaagcaaatatgatgagatattattaattctaggcagttgtacatatatatttctttgttatcctctgtagttttaacatcttttctcagttcagatgaaaaaatacatataattcttcatttaacttcaggaggtttataaacccctgaagcccatacagtagcattccaagaattacaactaacattgtcttgaaatgagtattagggagtatggtcaattttggatctatgtcaggttatttcaatgacagttgacatacagtcgcatcaatagtgagtcccactgactattgtgtaaagagccattaggggatatgtctcccaatgttcaatacatcttagctctgcttagccaccttttcttgtgttagcttttggtgtgaccaatcacccaaactcagtaacttaaataataaatgtttatactttcttatgattttgtgcactggcgtggcagttctggtctcagctggttcattcaatcactgtggtcagctagtggcttggctgggaatggatgatctagggtggcctcactcacatgtctggtagttggtccagtctcagctggggccatgggatggcttggccatgtgtctcttgtcacaacagtctagctctggcttgtttacatagtagtggtcacaccacagggttcccaagaaaagcaagggtacaagctccagggcacacacatttttcaacccttgcttgcgtcatgcttgctattatccccattggctgaagcaagtcacactgtcaagtccagagtcactgtggaagaggactgcccaaaggctcagattcagttccctaccctcaaccttttctgtcaactttcctacattgcgggaatacttggaggcaggaatagattgagtggtagctccagttttctctggctgatcccctgaacccctttgtttgacagaagccagcatggctcctgctctgtctgctgctgctttcccaagcaaggcatgaggaatcggagctgaagtccttttgtagtgatgaggctcagtctcattctaaaactgctgtcttttgttgggggaaaaaaagggcaaaaacagaagctaacaacaagaaggaaaatcattttctatctgctaaagggtgctttacaagaataacaaacattttacattaagtccaaagttagagagcaatgaatcatgccaaaccatgctgggctcgatggcctgctggacagaaaggggaatgcaggccttccaaggtggggacaatacttcttgctgcccaattctgcattttcgcccacctctgagctgtccatgtgaagaaagacattccacacacagacaaaaattcttttttttttccccttggttgaaagtcatgtcttttggactgtaagatggttctcaaaataaccctgtgtcaattccatattctgtgagccacagattttgctatctgtgggctcgtcaagacgtgaatcgagtaggattagtttagcttcgtgcccaggacttgtacaggacgtgaaaaattccttgacctcctgatctttcactttgactttctgttctgtctttcaatcaaaaatgtaaaaataagtaagttggagagaaaacaaatccctcaacttcagccgttgacaactcatgaccaatcttgatttcactgttcttatcttcccctggtttctttagaagcaaatcctagatagcataccatttcatccataaatatctccatattatattggctttcacatagagcaaagctagacactaactgctcattggactgaaagaagagatatactcagagaaccaaagcaaatagcttccctttaagttttaataggagtggctttgttttatagaacgctgtaggcatctccagccactgaggggacttcttcaagcttggcccagcctcatccacagaaggatctggcagtgatatcttggcattcatagtttcagtgtgcaggacagcattggttccccaccctacagtcccagctctacctaggcagtatcatatgtatcatggtaatggctatggaaaataatatccctccctccctgcctcccttcccctcttcctctttttagagatgaggtcttgctgtgttgcccaggctggtctcaaactcctggcctcaagtgatcctcctatctcagcctcccaaagtgctgggattacaggtgtgagccaccgcatgcagcctctttcttttttgacagggtcttgctctgccatccaggctgaagtgcagtggtgtgatcttgtctcactgtagcctcaacctcctaggctcaagagagcctcccatctcagcctcttgagtatctgggactacaggcatgaactgccatgcctagctaattaaaaaaaaaaaaatatatatatattatatatatatacacatacatatatatatatgtatgtaaaatatatatattttttacagggtctcactttgttgctcaggctagtctagaactcctggtctccagcgattctcctgccttggtggcccaaaatgctgggattataggtgacagctactgtgcccaaccttgtttctttcagtgaccaaatagctttaaatatagaatgtcaagatgagaagtatcctggagaccacttccagggtagtctatgaaattgtttgtgtccatattcattcttaagtgaattttttcctgggaaaaagattcataaatccccaatgtggttcatggtctccccaagtgaccctttaaggtccagggaactgtggtagcctgacctaggtctctcagttacttggcaagttaatagcagagttgtccctagaatacaagtctcttaacccacagttcaggaattatggtcgtaaacctgcttttactggaaatgtttgaaaatcaaacataatggtgtattagaagagaggttcaaagtggtaaatttttctgtgatcacaaagagaaatgcattcaatacagactccaaataaatatgtcagggacataaagtttttactttatataaataattgaaaacccattttcctggtgaggatacattgatattaattagaaaattagtatttaatagttgacataagaaattgctgggccttaatatctggactctggagcagatttctgtgctttgtttctatgatctagaactagggcttggggtgtagaaaaactgggatggccttttccttctagctctttctctcacacaccctcacaccccaaacccatcttccaactagtgtccttttctttccccacaaggcctcttgtccatcctctccttgaagcattcatctggacttggaaaggatgaggagagctggagaaggcaggagacatagtttgcacctgctgagaagtgaggaaacataagtaaggccagtaaaccaaagggagctctctcctcctcctcatcctcctcttcctcctcatcctcctcttcctctttctcctttttgtcctcctcctcctcttccctaaggctctcttgatactccttggtccagccctgcttagcaactctccaagcaagcatggaggacaatgtggcaagcattgtctgctctatggagacaaggagacatcatcctctttgtttggggctatgagtcaagagtcttcagttttttgcagcagttgtatttaagtgtcagttgacaaaagtgaattttatatgctccaattaagatgtagtgaattgtgacattctaccacttgccaagtcctgtgattccacctctgcagtgtggctacactcacctatatcagctgaccaaattcatccacttggtgtttccctttcaggcttagatgttctccatcttcagcttgtgtctggctggaatcaattcctccccctctccatcccgtcagtctaattcttcttttaaaccagccttaactctgccttcttgagcctcatcattgaaaattacctccttggcaaggtatggtggctcacgcctgtaatcccagcactttgggaggccaaggtaggtggatcacctgaggtcaggagtttcagaccatcctggccaacatggtgaaaccctgtctctactaaaaatacaaaacaacaacaacaacaacaaaaatagccaggcgtggtggtaggcacctgtaatcctagctactcgggaggctgagacaagagaactgcttgaacccgggaggcggaggttgcagtgagccaagattgcaccactgctctccagcctgggcgacagagtgagactcgtctcaaaaaaaaaaaaaaaaagttatctccttcttcaaaatctcatgagcactttatctataaagatcttataattgctaatgtgcattttgtctttccttctgatcagttacttttcaggtagaatcctttctcgttcagctttgtatcccagcctctcctctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaacagggcgaaacctcatctctactgaaaatacaagaattagctgggtgtggtggtgggcgcctgtaatcccagctacttgagaggctgaggcaggagaattgcttgaacccgggaggtggaggttgcagtgagccgagatcgtgccattgcactccagcctaggcagcaagagtgaaactccatctcaaaaaaaaaaaccaaaaacaaacaaacaaacaaacaaaaaaacttaacaggaggcagggcacagtggtgcaacgcctgtaatcccagcactttaagaggccaagggaggcagatcccttgagcttaggagttcaggaccagtctgggcaacatggcaaagacctgccaatacagaaaatagccggttgtggtgttacacacttgtagtcccagctacttgggaggcttatgtgggaggattgctggagcccgggaggcagagggtgcagtgagccgagattgcagagagagaccctgtttcaggaaaaacaacaacaaaaaaccccaaaaaacttaatgggaaaaatgtttgtatttctttttgttatgcatcagtatacaatctttaaaactacccccaggtcttttccttgagggacaaaagtaggatgcagaactgcctacaaggtggagcattcttaaaatctactccaaaaaactgctgctcgtgggtactcagctgatagaatgaacaggagtgaatgaataggtgaaagcaccctgtgatttgaatgtcgcaagcctttcattttcgttggaaccttgtctgatgtgtgtcactccccactccgttgtgcttgcccttcggaaagatggaatggtgaggacagagaggagacaggtgataaaaagacacttaaaagggcacctgaaagccaggtggcttgtccctggaaggcagtagaaagcaatctgcagtcatgatgcctttcttcactcagcagcagctataatgttgaaaatggggcaaacgccttccccgtgcaactgtttaacaaaaggtagttctcctagaaaacagaatctgttgtatatgttgccagtgattttcacaagtgtagatgcctaagaaataggcaaatatgctgagcgtggtggctcacacttataatcccagcactttgggaggcctaggcaggtggattgcttgagcccaggcattcgaaaccagcctgggcaacattgtgagaccccgtctctacaaaaaaataaacgaaaattagccagacatcgtggtgtgtgcctgtagttccagctacttgggaggctgaggtgggaagattgcttgatcctggcaggttgaggctgccgtgagccctgatcatgccactgtactccagcctgggtgacagagtcagagcctgtctcaaaaaaaaagaaataggcaaatacaagagatggaaaaaggaatcgaaagaattgccatgggattgcgcattagacaatttgctttttaaaattgcatgtggttttgaaggacaggttgaatttggatgtttaaaatgcttagtgaaactaagactggcagggtcaaactgtgcgcataaaatctttgttctggaactcaagtgaaaaattggcagatttgcactttttgagctttttagagtccatttccagctccaggtggctgggtgaagtatcctaagctctacagaagggtaaaagaaatagcctcccacgtgagtggcaggagtaggtaacctgtagtatctggaaagatatgtagatcaccaccagttagaacatttggaaggaggaattgccagtggcttgtagacaaggaatggaggagttgagacaggcaaggtaaattggggccctcctgccaattggaagtttttgagtgatatttttaatatttattattccatcctccttggttggaaagtcacgacggagagggacactgtcatgctcatggtttgtgtttgtatttctggcatggggtagaattggcaactttgctgaattgaacaactgttccccactagaccaaaagtgcccagaggactgaaaaccctccaattcaacttggtggcagcaaggcagccgccagtgaatgagtgattgatgagagccagcggattaaaggagacaactaattgtaaactggaaatagttttcaaagataaaagtagccccctcagataaaaccactagggcttccttttgagttttcttttcacagaacaggatattagtggttcggtggggctcctgcaggagggggtagctgtggagggaagctggtaggctgggaaggtttctacctgtttctcactcctttcctactaacgccccttcagttgagaggctaggtaattataattacctgagatcacacaaccagtcctgacctgtccccacaaggggtggagctactctttccaggtcaaaatggaaaccaaattcaccactatccgttcaaaagctcccaactccgaacaaagagccattgcaatggtgcccacctgggcaccattttggagcctgatatttattatcacatttaggttcacatgccaggtgcccacctggcatggaggcagcagtctgttcgagttctgccacctgaggacacccaggcctgtgaccccaagcgagggcttttctgacgtttgtgggggagtggttaggctgcttttgctgatatgaaagatcactgctagattcatggccaggataagaaggttttccttgttaggtgatacggactttcagaatgtaaaatttcctgaccaaggttgtgtctgttctggtttaaagacgaggatttgctgcctttgtttttccttaagccaacgtgccatccacctgtgctagaggaatctggtattgctctcctccaaaggccaggacggtctcaaaggagacaggctaatggcttaattgttttgtttattctgctccccacaaattccagtagcttcatttacattcagagaacttttttcaactgtattgtcatttcccttggttttgaatggctcttaatgtttgcccttcatgttgttttgaaaggttgatcgagccgttagtgaagggtgtggctttctccaaatgggggtttttcttagtgtgtggtagagaaagtgagagtaattttaaaaataaaatatgcacattttttctatctgtacacacaaactctagattattttggagcctatttatgttcacatgctttaggttttgggagttaaaagattaatgtgtacaagggaatggtgatatttaacaggacaaaaatttcgcttttacagagctgtggtttgcttttcaaaatgtagaggtttctttacctttgcgtttttttctttctttcttttttttttttttgagacggagttttgctcttgttgctcaagctggggtgcaatggcatgatttcagctcactgcatcctccacctcctgggttcaagtgattcttctgcctcagccttccgagtagctgggattacaggcgtgcgccaccacacccggctatttttttgtatttttagtagaaacggggtttctccatgttagccagatggtcttgaactcctgacctcaggtaatccacccgcctcagcctcccaaagtgctgagattacaggtgtgagccaccgcacctggcctgtttcttcacctttgacaaagaatccagtataagactattctggttcgtgttgtaaatggatttttttttcttttttttcttttcttttcttttcttttctttttttttttttttttgagacagggtctctatctgtcacccaggctggagtacagtggtgccatcacagctcactgcagccttaaactcctggggtcaagcaatcctcttacctcagcctcccaagtagctgggactacaggcgcgcaccactacacctggcttaaatgcatttttataattttagtataaacaagacattttagattgaataactttgtaatgtgctaggacagtagtttttaatgcaggtgggatccaacttttgagaaagggaaatgtgaaggttgaagaaacttaaaaatcaactgctgttggctagatctaggtgtgctgacttccttagaaaagaaatgcttcctttccctgcaaaccggagtttgggaaatttagagctaggaaatcatgtggtcgatcttaacgttataaatcactcagacaaatacaggataatgctgttttcggaagtgcttgtgattgtacaggattacatggtgataaagagttttcaatggctcctccagtttctgagggagttctgtgctttgctttcttggtaattccttctgcagaccttagagcctttgaggggggctgggtatgcttccgtgaatttaacagtttaacacactgttgaatagaagagaatctgctattggaactagtgattactaagaaaccacttctatatcatccagcatttgtatctactttaaagtacatattagtattttccttggtttacagatgaggaaaatgagttaggtaccgtgtttaaggtcacccatctgaaaagtggcagagaggggatttaaactcctggtcatctgaatctaaggtctgcttagaagaggagctgtttgcttctagacacatgcgtatttaggttgtgggtccacggactaatagcgtgggcatccctgggatattattagaaatgcagaacttcaggtcccacccacacctgattgcagatctgtgttttaacaaggtctctagatgattgcaaagcactacggcacagggacacttccccagaggaagtgtgatggccgccctccaggatatcatcttccaaggttagggacgtgccaaatatcccaagctttcagatatgcgactcaatcatctctaattatcctgctcaaccaaaaattaaagagcgattcttccaagtggaatcgagggaaacttttctcctggacaattctggagggagtccagctatccttaaggagatgcacagaataggctgttgccgacagcatgcttggaaaacctatcaacccggggtgcctcttccacggctgctgtccatgctatactttctcccattactgatccctctgaactagtctatcaaaccttctcctaaagagggtgagaacagattttgtcaggccagagaggaagaaagagatccagaatggggacgatcaatagcatgaaaatagagaagggcattgaaaagagcccagccttcagaacactccagtcctggcgctggagaactgcaccttaccttttactcctacctggttttccttttagaattcccccaggcatctatgctggagacagtagtgtctttgtctgttgttcccatccctgccttgctcctgccatttccaacgtcctgtgagtatatcttcacaggactcccccttccttttcacagtggccaccctagtttggatgtgcattgtcttacactgggaacattataagcgtttcttaagtggtcttcactcttatcccccggtaattcacagaaatagcatcagcgcaatcatcttctagtaacacggctttgcatctgtcactcttcctcaaaaactctcagttcctactgggaacagtctaaagaccaaaatgcattacggtctaaattaaaccaattactggttgcatttatccaactctattttccagtagtccttctcaaataaattccgtgagggcagcctacatgccttgttcctgctattagctcctagcacagtgcttgtacacagtggattttcactaaatattgattgaatgaacgaatgaacttattctcaggtttatgttttatagtctgcctagaatacactccttggtcaggccatttcctgtgactagatttcccttcccttttttcctgttcatctgaatccttaaaaaaccaagtaaggccgggtgcggtggctcacacctgtaatcccagcactttgggaggccgaggtgggccgatcacgaggtcgggagatcgagaccatcctggctaacacggtgaaaccctgtgtctactaaaaatacacaaaaaaattagctgggcgtggtggtggacgcctgtagtcccagctactctggaggctgaggctggagaatggcgtgaacctgggaggcggagcttgcattgagccgagatcgcgccactgcacgccagcctgggtgacagagcgagactccgtctcaaaaaagacaaaaaacaaaaaaccaaccaaccaaacaaacaacaacaacaacaaataaagactcatttcctggaagcctctgatttaactcgtggagatcattcccttctccaaattgtggcccttaccatagagttatttatttgtgactaaactatgtcatcttgcattgttatctgttttcacacagtctcttacagcccaagtagactgtaagcctcttgagatcagagataatttacatttctttatatttttcagaattcaccatctttccctttggccttcccacattcctgtacactctcgacattccctggttatctggcagttcatattggggaattatggttagctgtggatcaggcctcctctccccactttcctctcagtaatgcatgtagtctctgagggcagacactacattctcctgtgtcttttctggtttattcaatgatagaggctgtaccctttatccttttcaatttcatctacattcttttccttctcctgctcagttcttggaactcccatttctgagtgtctacgactacagtcatggtgaatagaaggtaatgaaactgtgagtcagtgtatcctctagctggagtgtgaaggtgagtcagcagacagcagcagtggatctcttccaccctgaggaaaggcaggagcctgcctggtgatcagggaaggaggccctcctccccacattgtttcctggaactgagtagaacaaattacttaactgtacttcagtttcatttgttaaaaaatgaagtaagaatagcttccattctcttttcattcaagtggtgatgtattgacaattaataagaaaattataaaatgccttagataccaccattgggactatgtaacgcaccacaacctggttgtggctgaggctctgttctagccacccctcctttctgactaccacatcgccctaaagttagaggcaataatagagttaccgcattagtgtttttctaacaaacctgttcaagtcctggctcactaaattttagggaaatgatatcatttctctccagtcttttaatagattgtctttgaaagagttgcatgttgcctgttaaggaaatgcttcagttggaaataattgagtaaggttagaaatggttcaagaaaacagacacatccctgcttgacctgctcagcctcaaactttcatatctcctagtttggggagggatggatggcagatgtagagtgcctcagtttttgttttgcagaaagttatatcatcatcatgtagaacagacatcacagaacgaaattaattagtaatgcattcactgaatttgggcaggatagtttgcttatttgaaaaaattcttggcaaggatgaggatgatttctcatcatcctcctccctaactcgctgggtaatttaaagaaggtttgtgagttgaaattttctgaatagagtgggttcagtttacccttttttatatggtagattgctaatagtgcattactgggagtggaggaaagacacccttttctgccttaaccctgagctagaggaatcacagccttgtctagaagctaaagacataattatatccatttcatatgcagtatgacaaaatcattagaaaattataattgcaaatagaaaaaatataggaggcatatgcatatatacctaagatgtttatatgggaagttatgggaggaaaatgaaataattactaattaataattactattaataaggtttcaaatgatccccttttttccccttgcctgggtgtccttccatcatgtccaagtcttagatcagtttctagatctaggctcaacaaaattccctcccctggacccccaagccttcccagatagtcaccttcctcttccatatgtccatggcacctagtttgaaatgttcttacctcatgcatcatgttctgccttgtgttagaccctttaagcttttgtgtctcattaagatattgaactcggctgcgtgcggtggctcacgcctataatcccagcactttgggaggcctaggtgggcggatcacctgaggtcaggagtttgaaaccagcctgaccaacatggtgaaaccccatctctactaaaaatacaaaattggccgggcatggtggcgcatgcctgtaatcccagctgctcgagaggctgaggcaggagaatcacttgaacctgggagccggaggttgcagtgaactgtgatcgtgccattgccctccagcttgggcaacagagtgagactccatctcaaaaaaaaaaaaaatgatattgaactccaaggagcagaagttgtttctgacatatagccaatggtctttatccagctaaaattcacccgtagtgctttttaaaaatgacaacccttgggcaccatcctagaccaaaaggattcagacacaactgtattacttttcaaagcttcctggatggttcctaaaagcagcctaggttgagagccactgttgatggatgtttaagcattgtgggctatgccataatttgatgcaacaccaaatgcaaactgatcaggatgtatttttgccatgctgcaacacaccatgtaacttaggaagttttgtggttttggcgtttttggttagggagggtattatttaatacagctgacttgaataaataggaaactagttcccaggggactttacaaaaggtaagcctttgtgtgactagcacctggggggtttcatcgctgtcaaggctatggtagttttaccacctgcattctcttacctcctccccactgtggcattgaccctagaccagaggcctccaaaacatggcgaggcatcaaaaccacctgaggaggtgattcagcaggtttgggatgaggcttcaaaatctgtttttcaccagggttccaggtgattccagtggaaaaactgataggagagccgctgctttacagctgtgtggaattgaaaatgacgtgggtcttggatcataagcagcagggtgtttttcttttcctagattgtcttccttaaccccaaattatgtaattacatacatattttctctagaacttttttgtatttttaaattttagctccttatgtcacccgaaatttacttttctggtgtgaggggtataattttttccaaatgcatggttagtggtcttaaaaataatttattcactggtgcattctttgtctcctgttgtgaagtgccacctttatcttatgttaaattcatatctatcatatgtttctagcctcttctgtttccttgatccttttctttattcctaaaccagttgctagtaccacattctataattactctagtttcggaatatgttttaatttttatttttggcaagactttactaattaaattcctttttaagtgagttcttggcaatttatactcatttactcttccagataaaatttagaatcaatgtgtcaaagttccataagaaaatctctttggaactttggttggagtagcatgaaccctctagagcagcagtccccaacctttttggcaccagggaccggtttcgtggaagacagcttttctgcagcctggggtgtggagtggggatggttttgggagaaaactgttccacctcagataatcggtattagattctcattagaagcgcgcagcctggatcctgcgtatattcggttcacaatgggctttgtgcttctatgggaatctagtgctgctttgatcttacaggaggcggagctcaggcggtaatgcttgctcaccagccactcacctgctgctgtgcagcccggttcctgacaggccactgccagcacgggtccatggccccggggttgggaacccgtgctctagagcactttgagaaggtgaacgtctttgtaactgatgccttatacccacagacatggtgtccttccccatcagcccttctttcaggggcctccattcatctttatgcttttctttacacaattctttcacttttttttttttttctttttgggagacaaggtctcgctctgtcacccaggctggaatgcagtggcatgatcagggctcactgcaacctccacctcctgggatcaatcaatcctcccatctcagcctcctgagtagctggaactacagctgtgtgccttcatgcccagctaattttatttgtttattttgtagagataaggttttgccatgttacccaggctggtcttgaactcctgggctctagtgatcctccaaaagtgctgggattacagtcgtgagacaccatgcccagccatcttccccatttcttaagtttattactggcattttataacccttgttactgatttgaatgggatatttcctaaaacattgtcttttgaaaatattaataattttatccatagttcttataatttaatggatatcatgtcataacccacagaattacaagaatctccctcacctgaatatagagggattgtagcattttgaggcattccattttttactcttgcttcaaaaacatgagacaaaacaggttctcctcaagtgtcccagtgcactcttcttcattaatagagtggcctgggctatggggccgtcattcgtaggctctttggcagggttgcagaaggagctgagtctgggctgaatgtgatccatggtgggacacagcctgcagttcgtgcttctgaataggtccctggtcgggggctggatgttcagtgatgcacctcgtcatcctgaggtcaagaaagcacaagtggaagaaggggaaagatgtgttaattctgcctagctgaatgagggattcagaagtgggagccagacctttgcttacaatctcagaaggaaaaaatgttgattccaggaatcaagtaattctaagaaccaattatataaaaagtgttttgcaaactataaagtgatattcactcacatgcattcggaagtactacctccacgtgttttagctgcatttgaaagtcttttagaaagaaagcaatgcaactgctggataaaacctcatccctctaccccagaattgttgtcacagctttaaggaagttttatgtgaaagcagaggaaagtaacagtaactctttaatccagacatgtgtctaaaccatggataactcacagaaggccttagagactctgagaattggtaaatattctatacatccttagcatccacaggctaaatacccctccattccctgagtcagggcatgccagctgttaacaatgttctattcctggtacctctctctttgcatttccctgtctttcctcaatcatcttgtatcacaggaagtataaaagtagttaggcagttctattttttgacagcagatgaaaagccaaagttaaaggtcaatgcttaacccactggcttctaataagctggtaaagctgggcaatatagtaagacccctatttctaaaaacatttttttaattagctgagtgtggtggcacatgtgcctgtagtcccagctaatcaggaggcagaggcaggagaatcccttgagcacaggattttgaggctccccaagagaaagctgaggctcagagagggtaatgtgtggtaagagttaaactctcagtcctgatacctttgcttttttatgctgtatttcttctgcaatattctgcactttgcttaggttttttttttttctccctctctcatttaaatacttcaactgcctgtctgatctgttagccattctgtgtaccattatctgattgcttttagaaaagagcttccagtgggctcagtgtgtttaatctgctgtggcttctgaagtccctcatcttcagggagaagtggctcttctgtctacccgattggtcaagcctctttctttcttgatgttttttcttcataaaaagttaggcatttaaaattttttctgtttgtctttctaaataaagtacttcaagttattttgaaagctctggtcatatcctatcaatatgcaaacagatgagttgatttttaaaaaatgacatgctggtttgagttcttggtcttttagtacctattgattctagtgcctattgactggctaatggctgcttgtatttattgaatctaaatattatgctctttgattggtggtgccctggcagcactccccgtgggcctgtggggtggagaacacgggaagagatacctgcttggggaaaggtgggaggtaagagtgggaaggactttggtggttttggtgccagcttagccacagtagaataaagtactcagtagatttctaacatttctgactccagaccctggttccctgatagcatctctggacctacctgggcccagggctgtcctgaaggaaaggacacaagcctagctggcttcactacttgatgattgtagagccctagggccttgagggaacataggccagataattatacaggccttgggcaagacccagtgttgtgctggcttcaggtcagacctgcagtccccagtggtggtggccataggggtgcttttgtcacccttcccctagctccacacatctcagcacagagagcaaaactctgtttgggaaaaagtaaaggaaaagaacaagagtctctgcctggtaatccagagagttcttttggatcttacacaagaccaccaaggcagtacctctacgagtccgcaagaactacagtgttactgggcttggggtaccccataatgcagatacggctgtggtgtccacaaacttagatcataacaaccaagtccctttgaatacttggaaagccttcccaagaaggatgggtacaaacaactccagattgtgaagcctacaataaattcttaactcttcagtgcctagacacccatgaatatccacaagcatcaaaaccatctgggaaaacatggccttaccaaatgaaataaattgaccaggggtcaatcccagagagacagagatatgggacctttcagaaagagagcttaaaatagctgttttgaggaaactcaaattcaaggtaacacagaggaggaactcagaatattatcagatacatttaacaaaggaattgaagtaagttaagagaatcaggcagaaattctcgagctgctgaatgcaattgacgtactgaagaatgcgtcacagtctgttagtagcagaactgatcaagcagaagaaagaattagtgagcttgaagacagactatttgaaaatacacagtcagaggagacaaaagaaaaaagaataaaaaagaatgaagcccacctacaagatctagaaaatagcttcagaagggcaaatccaagaattattggccttaaaggaggtagagagagagagataatggtggaaagtttattcaaagggataataagataacttcccaaacaaaagatatcaaagtttaagtacaagaaggttatagaacaccaagcagatttaactaaaaggaaattacctcaaggcatgtaataacaaaactcccaaaggtcaaggataaagaaaggatcctaaaagcagtaacagaaaataaacaaataacatatgatggagctccaacacgtctggcagcagacttttcagtggaaactgtacaggccaggagagagtggcataaagtgctgaagcattaaaaaaaaaaaaagagttcactctagaatggtatatctggcaaaaatatcctccaaacatgaaggaaaaattaagaccttcccagacaaacaaaagctgagggatttatcaaccccaggcctatcctacaagaaatgctaaagggagttcttcaatctgaaagaaaaggatgttaacaagcaatgagaaatcatctgaaggtacaaaactcactggtaatagtaagtacacagaaaaacacagaatattataacagtataatagtagtgtgtaaactatacatatctcaaatagaaagatgaaaggatgaacccataaaaaataataacttttcaaggcatagacagtacagtaagataaatagaaacaacaaaatgttaaaaagtggggagacaaaattatagagtttttattggttgtctttttgctttttgtttatgcaatcgatgttaagttgtgatcagtttaaaataatgggttataagatgttatttgcaagcctcatggtaacctcaaatctaaaaaacatacaacaggtacacagaaaataaaaaggaagaatttaaaatgtgccaactgagaaaatcaccttaaaggaagataggaaagaaggacagaaggaagagaagaccacaaaacaaccagacaacaaataacaaagtggcaggagtaaggcctcacttatcagtaataacattgaatgtaaatagactaaactctgcaatcaaaagacatagaatagctgaatggataaaaagcaagacccaaggatctgttgcctacaagcaacacacttcaccaaatcaaatgaaaatggattaatgacctaaatctaagacttcaaactatgaaactactaaaagaaaacattgggaagactccaggacattggtctaagcaaagattttttggacaaatgggatcacatcaagttaaaaagcttccttccacacagcaaaagaaaaaatcaacaaaatgaagagacaacccacagagtgggagaaaatatttgcaaactttccatctcacaagggtttaatcaccagaatacagaaggaactcaaataactctgtaggaaaaaatctaatctgattttaaaatgggcaaaagatatcaatagacatttctcaaaagaagacatacaaatggcaaacaggtgtatgaaaaggtgctcaacaccactgaaaatcagagacatgccaatgaaaactacaatgaggtatcatctcacccaagtaaaaatggcttttatccagaagacgggcaataatgaatgctggcaaggatgtgaagaaaaggggaaaagggaactctcatacaccgttggtggaaatataaatgagtatagccactgtggagaacagaagggcggttccttaaaaactaaaaacagagctagctaccttatgatccagcaattccattggtaggtgtataccttaaagaaaggatataagcatatggaagagatagctgcactcccatgtttatcctagcactattcacaatagcaaatatttggaatcaacctaagtgtccatcaaatgatgaatgaaatcattcatcacataaagaagatgtggtacagatacacaacagagtactaatcagcaataaaaaagaatgaaaccctgtcatttgtcatttgcaagaatatgaatggaactggaggtcattatgttaagtgaaataagctaggcacagaaagacagatttcatattttcttacttatttgtgggagctaaaaattaaaagtattgaactcatagagatagggaatagaatgatggttaccagaggctgggaaggagaactggggagacaggggttatggttaatgggtacaaagaaatagttagaaataatagaatgaataagagctagcatttgcatgctcacagtaacacgtatactaaaattggaatgacacagagaagattagcatggctcctgagcaaggatgtcatgcaaattcatgaagtgtattttaaatgttattgaaaaaaaaaatctagtatttgctagcacaacagaacgactatagtcaataataatttgtgcatttaaaaataactaaaagagtattactggattttttgaaacacaaaggataaatccttgagggtgtggataccccattttcgatcatgtgattattacacattgcatgcctgtatcaaaatatccatatacacctacttatatatgcccaaaaattaaaaattaaaatgaattttatgttctttgaagatttttctttttttcttttttttcttttttttttttttttttgagatggagtctcgctctgtcccaggctggagtgctgtggcgggatctcagctcactgcaacctctgcctcccctgttcaagcttttctacctcagcctcccgagtagctgggattacaggtgtgtgccaccacgcccagctgatttttgtatttttagtagagatggggtttcaccatgttggccaggctggtcttgaactgctgacctcgtgatcctcccgcctcagcctcccaaagtgctgggattacaggcatgagccaccatgcctggctgaagatttttcttaaatccttcctgattttattcctgaataaaaaccaaatattataaagttagttttactttggacattaaatgtccaagcaaattagaaataaaaaatagtaagaggagtaatgaacttagaaacggcagttatttgcaaaggcaattgtaaacatgtcatttgatgctactgttatttgatactacacatggtaaaaacacagtgagtgacgtcatagaaaaccaactcaagtattactttttcctgacaattttcctcctccttccaatagtccatagaaattagactgtctagagaaagtaaaacaaaaacacagcacatcacggaaatagaacctcaaaaaaaaaaaggttaatgtgaaaagtttgccttatttaatttaacgatccggctgggtttaaaaaattgctattttttttgagacaaggtgtcgcttgtcatcctggctggagttcagtggcacgatcatggctcactgcagcctcgatctcctgggttcaagcgatcctcatgcttctcgattataggttgcacaccaccatgcccagccaatttaaaaaatattttgtagaggtcagatgcagtggctcatgcctgtaatcccagcactttgggaggccgagacaggcagatcacctgaggtcaggagtttgagactagcctggccaacatggcaaaattctgtctctactaaaaatacaacaacaaaaaaattagccagatgtggtagcggacacctgtaatcccagctactagggaggctgagacaggagaattgcttgaacccagaaggcagaggttgcagtaagccgggattgtgccaccgcattccaggctaggcgacagagcaagactctgtcaaaaaaaaaaaaaacaaaaaaaagtatgtatatataaaattttgtagagaaggtatctcgctatattgtctaggctggtctttaactcctgggctcaagcagtcttcaggccttggccgcaaaactgctgggattacaggctggagccaccatacatggactgaatttttaaaattcttagtagggagaccttttaattggaagttgactataggaacgagaaggaaactgggtgactgaacaaccctattaggagagaaacacagatgaatcaacatgaagaatgtctgggatgggagcctaacatgcccagagctgcccttttgtgtctcttgggaggggctgtgttctggatgaaggcagtcaataggaggctggactactgtgaatatcggggtagtgaagttgagaaataccaattctacagtatggagtcagttaggtcaaaggttttgtacgtcaaataaccaagctatcttacatttctgtctccatttggaaaccagaaggtcagtcaaatatttggttagaaaaccaggaacaggaaaacatctcttgttacacataaaatctgtatccaagcactgtgtatcattccacaccatccattagaaccagtggagaggaaggctctgaaaggtttctgtctattgaggtttgataaaatggaagagtttagtacccattattactacttcaagttgaataaaatgtgtcattgacattttctttttttgagacagagtcttgctctgccacccaggctggagtgcagtggcacaatcttggctcactgcaacctctgtatcccaggttcaagcaattctcatgcctcagcctccccagtagcagggattacaggcatgtgccaccacgcctggctaatttttgtatttttaatagagatgaggtctcgccatgttggccaggctggttttgaactcctggcctcaggtgatccacctgcctcggcctccaaaaatgctgggattacaggcatgagccacagcgcccagcctgatgttttatttatagggtgcactcttcattgtttaaatgtctatttttagatgttgatagacctttgtaggtagtttcacccctgtctttggttctcttgcactgtttgccccatatcattctaaatttttacccaaatgggttttcaaggaccttgctcctcctgcctgtgggaagtggttacaggttagcaatagttgaaactcccctactgtttttcccagcttagcagggtggttggagaccagccccaatactcctgagagcccatagagacagtcctggctcagcactgaggacatcttgcaggcagggttggctgagtgttttatggagcgagcttaagaggagatgttctaaaaccagagaggaaacatttttctctgttctctgcaattcagcaggtgatatcccttcatggatttataataaacacagtcctctcattgaccaaggttgaaaaactcagaaagtttgctcagcacagatctgggagtcaggaacgtactatgtgctgtggaagacatttcaactcctctttcaagcaaaaaaaaaaaaaaaaaaaagtcaatactgatctagtttatatagctattataaaaaattatattaatgaaaatagaaattcatttgtaagtagagacagctaccaaattcctaagcaatctattcatttttgttttttttttagacttgaacactttttcttgccttgcctcacaatgcagttgtcaatatagggccactttagttacacctattacctgactctgcaaagaccacagagcttatttcctttagaaggattttgtttgattaatttacactcttcgctgacatttctcagttgagtaggaggaaaaaaaggagtttaatttaaccatattagccacatcatggacagggaaatgtatggaggatgtttaagtgatttgccttattgagtaaagatatatctaagcttagattttactttgtcctataagaactctgtgagcgagatttttttttcttttttgagatggagtcttgctctgttgcctaggctggagtgcagtggcacgatcccagctcactgcaacctccacctcctgggttcaagcgattctcctgcctcagcctcccgagtagctgggattacaggagcaaaccaccacgcccggctaattttttatacttttagtagagacggggtttctccatgttggtcaggctggtttcgaactcttgacctcaagtgatttgtctgccttggctgcccaaagtgctgggattacaggcgtgagccactgtgcccagccgagcgaaatatttttgactatagtagtctgaatgttcttttaagtttcataatgtaggctaaagctctattttctgccaaatgcgaaattgtagaacagaataaaaccatgtgctttatattatacgaattatatctgatgaatgttcatgtttagaaaaatcacaatcaagctcagcagttgtagatatggataacacaactccattcctgagcagagcaggtttcatcataattgcctgccttatgttttgttttcatacctgtagtaaacttaggaaacttaaaaattattcaatagaaatttagagtgtggagccctggtttgaatcctggctcttgtcatcttaatcagttccctccatttttacatctgtaaaacggaaatattcataataataaaacacctccataagaatcaaatgaaataaagtagaagtgctttgtaaaagataaacaattcaataactgtacaattcagtaactgcaaggaggtattatataagcatagatttttttttaaaactaggagttgtcaacccaaatgtccatcaatgatagacaggataaagaaaacgtggcacatatatactgtggaatactatgcagccataaaaaaggatgagttcatgtcctttgcagggacatggatgaagctggaaaccgtcattctcagcaaaccagcctaggagcagaaaaccaaacaccgcatgttctcactgacaagtgggagctgaacaatgagaacacgtggaccagggaggggaacatcacacactggggcctgtcagggggtggggggctaggggaggggtaggagaattatctgatgtagatgatgggttgatggatgcagcaaaccatcatggcacgtgtatacctatgtaacaaacccgcacgttctgcaaatgtatcccagaacttaaagtataattaaaaaacaaaacaaaacaaaaaaagaccaggggtgtactatgtgaattactggaggtatcagagaattctcagatgatccaacacatgtccaaaattcaagtactattaaaaacacataattttaaaaataaaagatacttatgaaagcctgactgctagttttaaagggacataaataaaccttatttaccttatttatgtatgtccctttgaatctagggttttttcttttcttttttttgagacagcgtttcactcccatcaccgagactggagtgcagtggcatgatctcggctcactgcaacctccatctcctgggctcaagcaattctcctgcctcagcctctgagtagctgggactacagggccacgccatcgcacccagctaatttttgtattttttttagacatggcgttttggcatgttgtccaggctggtctcaaactcctagcctcaagtgatctgcccgcttcagcctcccaaaatgttgggattacaggcctgagctactgcactcggcctagtttttttttaattccagaaaaagtttcaagatttttttttttttttgcttttgtgttaatattttgggtgtagtgggagagggggtagcacacttgagttgctgcaggacttgtttttttgtgtgaccagagagagcccacagcacacagccgggttctcattggaaaggcatcagaacaagtgtgtgcagacagcaccgcttatagtccgtgacactcattcctccgcatgaatcagggccacacatggcttcagatgatacaggttctttcctgacatctcaaggggagtcatttgaatgcgtccgtgtctctcccactacctctcaaaatgccggactaagttaattggtaaataaatgctcaggctgcttagcagtggcctatctctgaggcatgaggtctaatatagtttaaatgtaagtccatcgtggcctccaagtagctaggaaaacaggtgggggacttcaaagagatctgagagcaagcctggccgggtctcttgtacttttccagccctggcttatgtgtgggacaatggtgaaaagcagcccttgaggtagaaccaagtgggttttttttttattcatattcggcacagatttattgatgcagaaaacatgctctcctgatgtggccacagaatcatcacttgcttctttcaaaatccgtaaaatcttgcattctgtggtatttggcagattacatctcatactgtagcagcctgcgcttgccagctgaagtgtctgaaagtagcttggagtcgttttcacactctttgatgctagtccaccttttactacataccaaggatagtacatatatccaccaagtggtgccaaatcttgttctttattcttcttaaatttgaacgtcaaaattgcactttaataataaaaatataaagccatgagctatgcaaataatgaataaagattattctgagtaggcttagatgccacaagaatgcccttgtttttctctttcacggtttgacccagtgtggtgtgaatgttctctttgagacaatctttgtgttaaatctttacactaataaatgtgttagaacttcttcagggatattcttagcgaggaggagttggtggatgtgttttttgcaaataggcttcctttgtctgcttggcaattctctatgaggtttctgaaagtgtgacctgtacgtgagacatctaagtggatggagcaaaatgagggagacatatatgccagtctgataagtaaatcattcttgtagtcagtgtggaagagttggcaaatttctctctgatttccttctgtttttgaccctgccaggctgaacccaaagacccagcattgtgactggaagggcctgcgaaagaaagcccttgccaagtgatctctgtataatcgtctttcagagacttaataagctttggagaatatttggatgaagttggcagttttattgataccatctgattctactttggtcctgtagcagtttctgccactttgtcaccagtggggggaatatgctgttaccataatggaaaaggaggacatttggtagcatttttctgtgtttatgtcaggagtcgtctaaaatggtcattttttttttttttaagaaaaacaacatatgcgtacaaagtaggtgtatatatttatggggtacatgcaatattttgatacagtcctacaatgcataataatcacatcaggataaatggggtatccatcaccttaagcctttataatttctttgtgttacaaacattccaattatacttttagttatttttacttatttatttattttgagacagggtctcatttggttacccaggctggagtgcagtgatgcaataatcatggttcactgcagccttgacctcctgggctcaggtgaccctcctgcttcagcttcctgagtcgctggaactacaggcgtgtgccaccatgccaggctaatttttaaagtttttgtacagatggagtgtcactatgttgcccagccgggtctcaagcgatccttccactttggtctcccaaaacattgctattacaggtgtgagtcattgtgccccactgacgagaggttcttcatatttcttttatatccactgccacaaaactgagtgcaattggtctattcagtcaggaagtcgcttacctttcatgtgcttccctattacctgggcatatttccagggggtttcagaggaagaagtagctctttcctatgaggatatatgctggttctgaagtgtttacttagatgcatagtggaagctcaaaaaatatttactgaactcactcttgtggtttagctttcaactataaacataggaataaagggagaaaaaagcatgaaaaactagaagctgaaagccaggcaggaagagaatggatctagaaagaagtaggaagtccatttgctcagaggaaggatacccactcaccaatgggaaataggtccagtgttgtgtggtagggttgtgggtagtagtagtaatttcacaatgggtgtgggaggttggtgagtagatggactagattcaaaagtagatacctcgctctcacctatagcctagcagtttgggaggccgagacaggaggatcgcttgagcccagaagtttgagattagcctggccaacatggcaaaactccatctctacaaaaaatacaaaaattacccaggcgcggtggtggagtgcctgtaatcccagctactccgggggttgctgtggtggaggatcacttgagcctgggagttcaaggctgcagccagccaagattgcaccactgcactccagcctgggtaacagagcgaggccctgtctccaaaaaagaaaaagaaaaagaaagaaagtagatagtgatgaagctggatagttaaaacagaaacttgaaaagcaagatgtggaactgggatataggatttcagagtttaaaagaaatgtgacatttcttagtggattgtccttcagttgtgtttactaagcaactgtcagctagtgagattactgtgtatggccaatccagataaataagacgatcaagtctttatgaaaaggaaagaaaaatttggaatgcacatctctgtccagctcaattcctcactccttttttaagatggagagctgttaggtttgtctacacagtaggaaacacctgattaaataacagcatggagccaatcttgacaaagaaattggctgcatccaatagaatcccagggccggtcgtggtggctcatgcctgtaatcccaacactttgggcggccgaggtgggaggatcacttgagctttggtctcagggctttgagaccagcctggacagcatagtgagacctcgtctctaaaaaattaaattaaaaaaaaaaatagagcgccagcaaagtcaattcctgaactctcttctgttcagtagtagcaaaaatgcctgatctaagtgatggggaaagttagtttatgtggctgtagcatcagacacatcactgacaatcctgctgtggatttatagcacaggggacactacatctagaaacacctgtctgtggactgctgctgctgtcaggttagtaatctgtgtattctaatgagaatggacgtggcctccctagtgtcagccacataatggaaatcctagatcagcatgcttacttcttcccatctaattgcaagttgtaatttgtaaataatgggtttactttttaattttgagaaggtaaatgtgttgctgtacaaaagcccaggattccttcccgttaaatcggcagcattcttggacacagtaaatcctatcacacacttttgtctcacaaaagaagtagcggcagttagaagactttgaattctcccttacccgtgactttgagcaagtgatttaacctctcagacaacacagttcctcatttgcaaaatggaaataatgtctacattatctatttctactcacagagttgttttaggacacaaaatggtaaaggaaggaaaagctaagttactgcaacatggtaggatacttttgcttttaaatttaatttatacgcatcccaatttttatctagaacctagatttcaggctaaagaagagagccgttgggcttcattccacttgtagtagcctcacgttacccttactgtgaaattagtctttgtttcctttcatctcttttgaatatcacccttgccctgcaataataaaagagagctgcatgcagtgaaatcaaaccatgaaattatagaattgtagagccagaactagctacatataaacagaaaagaaaatttgattgaaacattaataattttcatcaaggtgaaaatgactgacaggtattactttaacagagttatttatactttttaaagatgtgctactgacctgttaacctaatgaaatttagatggtggaagggatataagttgttgaaaatttgggattcatttctttccatcttagtatttttggagtggtagagtgctgtgtctacatacctttgtaataaaaaacaatttggggctggtgttgataatcaagttgattgcgatctctaggagaggagagtctatctgatctttttcttgccgtttgtatatattgttctacctctcccatctcatctgaaatatggggcagtttcttggttctcagttgtttcttttctgatatgttgctgacctctgatttctcatatcagtgctcttcccttagttcaaagatgtttccccagttgtagatgggggttggaaaaggaaggtgcttgtgatttaaaagccctgtcacttactgtgtccataatatagtgagtccacctgtggactgagcaaggctgctgtcacatctttcaaggttttcctcattgatcctacatcggtttagcaaaattcttctgtaaaaggctagatagtaaatattttaggctttgtggaccatacagtctctgtcacagctactcaactctgccattgtagcatgaaatcacgtggctgtcttctaataaaacttggtttacaaaaacaatcagactgggcgtcgtggctcacacctgtaatctcagcactgtgggaggacgacacaggaggattgcttgagcccaggagttcgagagcagcatgggcaacgtagggagactccatctccgcagatttttaaaaagttagctgggcgtgatggtgcatgcctgtggtcccagctacctgcaggggctgaggcaggaggatcgtctgaggttgggaggtcaaagttgcagtgagccatgattgcaccactgcacttcagcctaggtgacagagcaagactcggtctcaaaaaaccaacacaaataaataaaaattaaaaataatcattgagccagatttggctcacgggctgtagtttgctgactcctgttctacatgattttcataaaggtgggacaggtgcacttataatattaaatggaatggagggtgctattgtaaatacctgcaagttgaatcaaggatagctttttaaagcagtttgcttagaaatttacctacaaaagactattattacagtacctccctgtgccatgtacctatagattgacttaggcaaaaacctgacaacagaccttgggaatatttggggatatttactttttcaagtaattgagttatacgtactttgcctgccactttttacattgcattgccaatttaagttaacatcaccgacctaatgtcagcaatgttccactcttaaagctggaaactggattcgagggtgagcaaggaaggatgaggagagggaagtttaccttaaatgatccttgaagtcaacattaggtaccttgagaatgccttgctgcttgattttaagatcttcaattacagcactttgattcttaaccttaaaaaaattctccttcagccatttcaagccatgtggaatatctcttactgcttaggaatttgctgtggtttttcattgaccgtggccccagactctggaatatgtattaatttatctgggcagagaatacagaaatccacatgcagaataaagtgaactttatgctgaagcagaatattgaagctgggaatggttaattcttaaaaaataaagcatcagcgttaataaatattgaattctaagaaggtattttgcagtttgcttcttaaagtactgagataatctgactgggttcccatttaaaagagagaagttttttccctccatgaataatattcgtttacagtcattggtaaattattaatctgcattccagtgtttcatgtttgaaataccagtccgccctgtccatggggatttgatctcacgctgtaatcagcaaagggttctgggaagtgagaatagctgtggtttgctcttttaaagaccttaggagagaatcaaaaagtggtggttattcaggaagttggcctgtccagcatttgacggctggcagttttcatatggagtcatatgagaccatgaacttggaaggcacactagactgtgggaaagtttgggtgggctgctcaccaccctgtgattttcagaggtcctagaatgttctttagagtattcctgcagtttttgaatggatgtcaaatctcttttggtttggggctacccgaaatgtttacattctgagtcgttggtccattttcctccaacaatgcacatttaggattgctattgggtacctaatgaactggattgatcataagattctcaggatctctggccccagctcgacaccactttctagctatggcacgttaggtaagtcctttaaccactctgactctcacactgaatataggttagaacagtatctacgtcatagtgttgcttgaggattaagaggaataattcatgggacttggcatgagtctttactagattgtaagctccatggaggagctgtcttcccagtgcctccagcagtgtctggcatatagtgaggagctcaacacacatttgttaaattaacagtaagcattcagtcaatgttaattgttactgttgtcatgaataatattctcattattacttacattacccattttgagtcctccgtaccttctgttgataacagtcatcttcgtgaagcagctatggtgtcattgataggatgctgagttcaaattctaaccctgtcctgattagctgtgggcaaagtttcttaacctctctgaactagtttccttgtctgtaaattgtgatgataatgccctcccacagagtctaagagggtaacacacccctgccttagttttctcaaacgtatgggtagaagtagccctgggacctactcacttaccagtgtcttagatttttcacatgccctaaatgcttaactctataggccttgcatgctccacaccagagtcttctacagattgcccaatatattgagggctgatgaggtcccctccacacagaacagctatgtgtagcaggttgatcaaaacatctgtattctgatcagggtcatctctgcacagctggagttgtgtatgtcctttaagtttctataactggtcattataaaatactaagtatagtaatactaatttatgaatttatgtctcatgaaatgaagagataccaacaacacaactggggtttcatagaggttgtaaaaatgaactttttggcccctctcccagtaccaagcgtgtattgggagaggggccagaaagttcattgtctggtcaatttgccaccccaatgaaggtgggttccttttcagaagtcttgaaggtttgagcctggcaatggatcaagttctctttcctcctgcagaatctctcttctggtccacactctgggaggtagacgggactaagcagaaggtcacttccccagtgcaagaaaatgtactactccactctcacattctacctttggtttgagcaaaggccacattttgcaagcccgtttgctgcccagttaatctgtcagggtgaactttctctcaccctctgctgacacctctgccacccagccccatctcctttgagagggggaacccccccaccatggagctttgtgttttcctccacttcctccttttagcagggtaagcctccacacttctgcccaggctgttgggcccaccatctcctcttttaacacagcttccgaagtgctggggatggagagggtgtcaatgtggcaaacgttcctttgcccactgatgagaagtttcagcccttcccaagacatgtctggaaatggcagtccaccctggcctttccttaacttcactccatccctcagccccttcatgtacaagttgtcagcacatcttgttatttctgcttataaaaatacatcgaatctgacagctttgccccactctatagctgccctcctaattcagcgagctggagaggcaattctcggtcaggatgatttaggatattcctaactggtctctctgccatcccactataccctcctgcactgtccacttaacagtgatgtttaaaaagtaaataaatggctgggcgtgctggctcatacctgcaatcccaatacttttggaggcagaggaaggagaattgcttaaggccaggagtttgagacaagcctgggaaacatagggagaccccatgtctataaataataataataataaaaatagccagatgtggtgatgcacacttgtggtcccagctactcaggaggctgaagtgagaggattgcttgagcctgggaggtcgaggctggcactgcactccagcctgggtgatagagtgagaccccatctctgaaataaaaaaaaaaaaagaaaaatgtacaaagtgccttttaaaaagcaggtatatggagatgtaagcaggcatcaaggctagcagtgcccagcggtgagccacggctgcactggtgggtccatgggaatagaaagcaaagtcttgggtccacacaaggtggaggattacatgggagactcctgcatggaggtgtgcactctgtggaagagtcaagtgagaaaacgccttacccataaagggagatggtatcattacctcttcagttctctttccctactgcaaccccacccgaaaagccccacctaggttccagttcctctgggtgcaggtgcctgattgcctgaagcctggtgctcaggattgtcctacattctccccactgttccctgagtggttccctgacttgctgttttataaaacctttttacatacagtagagtcgggggcagggggcaggtcttggtcactcagcccataagaggtagactctgaacaggtcgctttcgagttgtgtttccaatgtcctttttaccatattgacaaagggaagaatttatgtaggaatacatcatctttaattaaagcatagctataaattatgcaagtagcagtacatattttaacacaaaagcaaggttcatagacaaaaatggaatggtaaaatcatgaaaatgtaaatctcttggttaggagacatttaggctcaaaataataattaaaaaatcaacagttatcacgtgtcgatacgacattgaaaaacatcttgtgattttaaattgaaaaatgggttcagactgaccacccaaataatcctttttttgagatggagtcttgctctgtcgccaggctggagtgcagtggcgcagtctcggctcactgcagcctccacctcccaggttcaagcaattcccgtgcctcagcctcctgagtagctgggattataggcatgctccaccacacctggctaatttttttttttgtattttagtacagatggggtttcaccatgttggccaggatggtctcgatctcctgacctcgtcttctgcctgcctcggcctcccaaagtgctggaattacgggcgtgagccaccatgcccgtcccacccaattctactgtgcgcttttccagagaagtgtgaattatttgtgtcttcagggaaatacatagctgtctgggttttttttttttctgttttgtttttcctttaagcatctgataatacaaatgtactcaaatggaagaggaactgaacctttgagtttaatgagagttttggtgtttaaagaattcaggatcatgaagaatgtgtggtgacttccctcttcctattcccattactttaaatgtcgtagctgttgctttttgtgctttgggaagattcttgatgcctccacattctgattcactggacagccctgattataggccatgggggttagagctggaagggtctgtgggagtcaatccatgtcccgcatttgacaggtcagacactgaaaaacagatattgagagctcaaggacttgcgtgggctgacattgagcactacagatgccatggaaatggacacctgctcctgtgctcaccaagcacagcagtattcccccagcctgggccagtggatggaggaattaatggtttaatcttaactaatttaattttaaaaagataatgaagaaatgctaaattaatttttaaaaatcttagtattccttcatggaaaaaagctaacaaaatgattggacatgtatacattttagtgtttattgtttaaaagatgtgttattggattgcactatcaaactccataaaatctggagttgaaataaataaataatctcaacctgtggtgcagttaggtgctggtcagctgatgtcacagcctactgactgggactcattgtgcacgaatttaagtcctttagtcaagctgtgatcacttccacgaaatccctggttatgtcatttggagatcttttatcccctaactaaaaaggacaattggccgggcactgtggctcacacctgtaatcacagcactttgggaggccaaggtaggtggatcaacgagttcaagagatggagaccatcctggccaacatggtgaaaccctctctctactaaaaatacaacaattagctgggcatggtgacgggcgcctgtagtcacagctcctcggaagggctgaggcaggagaatcgcttgaacccaggaggtggaggttgcagtgagctgagattgtgccactgcactccagcctggcgatagagcgagattctgtcccagaaataaaaaaaaaaaagaaaaggaaattgaattcatttaaattgttaaaccctactgaagggaagatagttcttcagtcaaaaggcttttttttttttttttctaaaaagccttagagtgctaaaagtaaaaacaaatccagctattacttgaagttttgtaaatgggaaatgtacttgtagttgagactatctggatttttctttgtgtcttaattactccctgatagaagcaaggcctttaggagtcttttaatgtctttaggacataaggctcaattttactcctcaggtcccctcagtctgaaagaagcaggtgcagcacttgagcattcatccaaccaataattctcaggctctgctgtatgctgccctctgtgggggggggcttgggatggggataaatacggcgagacacagctctttctcccacctgggtttcagggagaagaatgtcaccttgaacttgaggagctctatctggcagcatctctgaggtgtgcttcttctctaccttttcctccccttgaaccaacccagatactctagcatccccgatgctccccagaacatgcccaactccaaagacagcctgatttttttcttttaaaacccagacccagaagcaggtcattttggggtggtttagcacaaggctctccacagacttgtgttgctcataggcgaggggtggccccctttccgatagtgtcattgattttcttttggatattctccctttttttttaatttgaaaacatattctctcttaacggatgtgactgatgcttgcacttttggatgcttgcagacctaggacactgcagaatagaattaattggagtctgggttttctaacagtttagatgtcattcactgcctcactgcccacacggatatatgtacttgtctcacgttctgtcggctgagccttcttttcttacttatgatttgtggccaaagtgggtcctgttcttgagaactgagggcacaagggaggatccctcactttgcccagattagatcttgaatctcagctctctcgaggattccgtttttgtttttttttttcctgcctttggtggctttctcaccatggagctggagaagtcactgtgggctcatgaagggtctttgctgcttcaaactcagaacacacatcccgcaagctctagtaataatataaggtgacagccccccaggggctcttatgggcagccagacccctctctggctgcaccctttgtcccaagcctgctattttcccttaacttccaggtcctcctcccctccagtgtgctggggccctgtagcacacagcaacatcagtgcagtcatcagacaaatgcacacagccgttctccaaatcacccttaattttttttttttcttttttgaggcggagtctcattctgtcacccaggctggagtgcagtggtgcgatctcggcttcttgtaagctccacctcccggggtcatgccattctcctgcctcagcctcccgagtagctgggactgcaagcgcccaccaccgtgcctggctatttttttgtgtgtatttttagtagagacggggtttcaccatgttaaccaggatggtctcgatctcctgaccttgccatctcccacctcggcctcccaaagtgctaggattacaggtgtgagccactgtgcctggcccatatcacccttaattttaaatctgaatgtcaattcccttgttgaaattgtttatgtttcatgttcagaaattaccatatttcatcaaaaccattggtttagtttggttttaggaacagatgtttcttttctgtcaatcttatttccatttttggttgccattgatatttcaaaaggcaccttttttttttttttttttttttgtgatggggtcttgctctgtcgcccaggctggagtgcagtggtgcgatctcggctcactgcaagctctgcctcctgggttcacaccattctcctgcctcagcctcctgagtagctgggactacaggtgcccaccaccataccaggctatttttttttttttttgtatttttagtagagacggagtttcaccgtgttagccaggatggtcttgatctcctgacctcgtgatccgcccacctcgtcctcccaaagtgctggaattgtaggcgtaagccaccgtgcccggccagaaagcaccatttcttatatacctttaaaaaagaaaaatattgctaactaaattaagacatgtcttctgttgtaagacatattctggtttaagatatgttaaatggaaaaaaaacaaacaaactcaaaacccatgtacctttttctttttcccaatgtgctttttagaatcaatacaatctgtgtcaggactctattagatttcactttccctctgacagagccacttatgcttttgaaatagccaggtaagcaggacaatttcctttcagcccatctctggctctcatggcttccttcttacacatgctaggtaagcactttgaacttgaaaaacacttgactaaacactcatatgatctggattgtttaaccacaaaagatttggtcttctctagtgaaaaatgctgtgggtttcttttttacctttaattttacttttcaagttaaaaaatagcttttaaggtcaaaattttcagagcaatttgtaagtatagatacagtttcatggtgacagtttcttatgttgaaaaggtgacacaaaacacattatcttttactttagattcaaggggtacatgtgcagatttgttacttgggtatattgcgtgatgctgaggtttggggtactgtcatccaggtactgagcataatacccaatagttagtttttcttttctttctattttttttttttttaatttttgagacagagtcttactctgttgcccgggctggagtgcagtggtgtgaacttggctcactgcaacctccacctcccaggtccaaacaattatcctgcctcagccttccaagtagctgggattacaggtgcccgccaccacacccagctatttttttcgtacttttgtaaagttggggttttgccatgttggccaggctagtctccaattcctgacctcaggtggtctgcctgccttggcctccccaaagtgctgggattacaggcacctgccactgcaccctgccagtttttcttttcttttctttttttgagccagggtctcactctgtcacccaggctggagtgcagtggtgtgatctcggctcaacctcctgggctcaagagattctcccaggtcagcctcccacatagccttctggcaaatttttgtattttttgtagatatggggtataactagtttttcagttcttacccacctccctctctcctgcctctagtagtccccatgtctattggtgccatctttatgtccatgagtacccaatgtttagctcccacttttaagtgagaacatagggtatttgaatttctgttcctgcattaatttgcttatgataatagcccccagtttcatccatgttgcttcaaaggacatgatttcgctcttctttatggctgcatagtactccatggtatatatgtaccacatttcctttatccaattcactgttgatgggcacctaggttgattccatgtctttgctattgtgaatagtgctgtggtaaacatacaagtacatgtgtcgttttggtagaacaatttattttcttttcgatgtatacccagtaatgggattgctgagttgaatgatagttctgttttaggttctttgagaaatctcccagctgctttccacagtgactgaactaacttacactcccacctacagtgtgtaattgttctcttttctcctcagccttaccaccatctgttgttttttgactttctaataaccattctgactggtgtgagattgtatctcattgtggttttgatttgtatttctatgataattagtgatgttgagcattttttcatttttttaacagtttgtacgtcttgtttggagaagtatctgttcatgtcttttggccattttttaatgggattgtttgtttttttgcttgttcaattgttaaaagttccttaaggattctggatattagacttctgtcagatgcatagtttgtgaatattttctcctattctgtaggttgtctttttactttgttaatagtttcttctgctgtacagaagctctttagtttaatcaggttccacctgtcaatttttgtttttgttgcagttgttttgaggacttaatcatagattcttttccaagattgatatccagagtggtgtttcctaggttgtcttctattattcttatagtttgaggtcttacatttaaatctttaatccatcttgggttaatttttgtatgtggtgaaaggtagggtcaagttttattcttctgcatatggctagccaagcaccctagcaccatttattgaataggaagttctttccacattgcttatttttgtcaactttgttgaagatcagatggttataggtgtacagctttatttctgggttctctgttgaacagaacagagaacagaatattggtcaatgtgtctatttttgtactagtaccatgctgttttggttattgtacccttatactatagtttaaagtcagttaatgtgatgtctctggctttattcttttttgcttaggattgcttttgtatttgggcccttttttggtttcataggaattttggaatagttttttttagttatgtgaaaaatgacgttggttgtttgatagaaatagcatagaatctgtagattgctttgggcagtatggccattttaacgatattgattcttccaatggatgagcatggaatgttttttccattcgtttgtgtcatctgtgatttctttcaacagtgttttgtagttcttatagttgtctttcacctccttggttagatgtattcctaagtattttagtttttttgctattgtcaatgggattgcattcttgatttggctcacaacttgaatgtcattggtgtatagaaatgctactgatttctgtatgctgatattgtatcgtgaacttcactgaagtcacttgtcagttcgaggtggaggagtctctagggtgtttctttctttgtttgtttgtttgctttgagacggagttttgctcttgttgcccaggctggagtgcaatggcatggtctcggctcactgcaacctctgcctctgtgttcaagtgattctcctgcctcaacctcctgagtagctgggattacaggcatatgccaccatgcccggctaattttttatttttagtagagatagggtttatccatattggtcaggctggtctcaaactcctgacctcaggtgatccgcatgcctcggcctctcaaagtgctgggatcacaggcatgaacccccgtgcctggctgtctctggggttttctaggtgcagaatcataacatcagccaaaaaaaaaaaaaaaaaaaaaaaaaaaaaaaaaggtagtttgacttcttttcctatcttggtgccttttctttctttctcttgcctgatagctctggctaaaacttccaagcctgcttatttttgagcagctaaacttactagaaatgtcagggcaattgcattattttataataattataaaatatgcatttattttcttttcaaggtagaatacagaaaagttattacagaaacttcatgtttgaactaaattttctttttttcgttttttcagatggagacttgctctgttgcccaggctagagtgcagtggcacgatctcagctcactgcaacctccggcttctgggttcaagcagttctcctgcctcagcctcccaagtagctgggattacaggtgcctgtcaccatgccaggcttttttttgtatttttggtaaagatggggtttcaccatgttggccaggctggtttcaaactcctgacctcaagtgatccacctgccttgacctcccaaagtgctaggattacaggcatgagccaccacacccagccactaaaatatattttaaaatgacacttacccattcatactggttctgcttctctagcatgagccagtcatgcaagtcttcttaacccactgtcatgtcttctctgaggcttaaaatgcccagtttctataagacaggaagtcagatagacctgggttcaagtccagctttgcaatttactcttcgtgtaatcttgagtgactttctcattttcctcatctttaaaatggggataataacaacatctgtctcaaagagttttgtgaggattaaattaattggtgcacgtgaagtccttagtacactgcctggcaaacagtaagtactcaataaatgttagtatttttagtcaacattctggtaggcttctactactctctacccccaaactgcagtaaaacaaaaacatcttcctcttttgtaacttccaaatgtctatgactggcaatgcaagtcttctagactaataattttgaaatcttttttgttttttggttttaatctcttgtatgattttcatgtctgatcagttatcaagtctaccatcctttagtcctccagttctcatgaccacttgctttgacaattataaaaaccactacctagtttgttgtgtctagcatttccaggacagtgtggtgggaaaagcaggggctttcatggtagtctccgttgggctcaattctattgcatacaggagtgtatgggcaagacattgaagcatttcgagacttagttccagcactaggaagatgggacctccatgtctgcctcttctagagtgattgttgggtaatgaggtaggattgtaagataatggctggagaggcctgggtataccagaggcattcattaaatgccatttatcttccatttcccctctggttcgtcctacatgtggtgaccacatgcactcatgaaatcgcaattgtaattacacagtgtcttgattaaatatcctcagtgactccccatttactgtttaggcagatctaaactcttctgccccactgaactagagaaccaggctgaatgcgtttgaattctggctctatgacttactagctaccttgaaacaaatttcataaccttctacctcagtttccacatctgtagaatggaagtgacaataattgtgcctgccttatgaggttatgtagctcaattgtaaatattgaattagcccacatgaaggacttagaaaagttcctgactgtttcacgccctcgctctgtcacaccagcattctctccatctcttcttccattgctcatctttagcacccctaggccctgacaagccagaaaatttgttctcctaaatctgtcccccagttctgcctccctttcttacacagggtttactgttccgaagaacagaaattccacctgtacccagactttcacactaatatggggcagtcctgaaactgaaactatcagcactgcccctctgataacagtttgtatagtcatcctaggtttggcctgagtggtcatcttgcatatgctaccacaagagccttctttatggaggtctcttgttgctgctgtcttcccaaatcactttctctgttgcgttgcccttagtgattgtgagtttagagtttaccctaagcatcctacatgttatcatgactcatgccagattaaattctacttagttaccagcttttggcaccttgttccaggtttctttagggaggagggagaaaagggtatgtcttagcatacacagctcttatcagactgttagcattgcttgtttacttctgtgtttgccttattggactgtaagctctatgagggcaggtaatgtgtgtgccttgttcatctctatctgccaacttatagcaaagtatctggaccattaattggcattcaatatttatcgagtagatggatggatgatagatagacggataaagattggaatgtacatgccccttttggcatatacaaacatcaggtgaacttttttctctgcctagggaggaagctattcctagcaagaagacaacttaatactctagattattcctgggctactgaggttactaaataagagcatcttatttagctctgctgctgataagaccatgggaagttatttacatttaggagtggtatcttactaataccaactttcacaggtacttgggtggattccagatttatttccctgctatagttgcattatttgctttgtatgatatcttccttacaaagcacagtgttttcatagaaatattttgaaagacttgctaacggatcctgtagacctcacataaatcctctgtgaagttcgctatggaaagcaagaggattgatgtctaatccgtacatgacaagataaattttataattgaaagaccagtttatatgggcaagaagtgatcagacttccgaaaaataaaaaataaataatgtaggaaagacaaatgtaaaaaagcgtatgcagttatttggtcttaatatcagaattctttctggcttttattcatttccattcgttttctttctttctcttctctctataatactgctataatagtgactgctgggaagaaagagtgctgcccacaaatttttttggcagacttgggtatgagttaattagcattttggcctccagtctggagagcagaccctattctctttgtaatgggtgccggcaaggaagcttttcaaagccaagggaaaaatggcatccactctgctgtcaaggacttttatgagggtcaagtggtattggcaagaattcaggccagaatgatttggcttcagcaaagaaagccacagcccttgtgacaggttagattagccataaacctggatacactaaattcttcagatggtgagagattgttgcactctggcccaagaatttcttgtatgctttttcggtttttgcaagtggaggtttgatggtttgacagctgccctttccttacttgctctgtctcctgctgctcaggctccttctcagaatcaccacgagccaaaccactctggtacttgttggcccacgggtgcctcagtgcaaaagtattcctcagtgtctacaaaatgttacaaaaacgtgtctgagtaagctgatggatcgcagcttatttgtcactgagaaagttcaagttagtgctctaattccacctttgcaagtttttatgctaagcctcagacaaatataaacaccaatcttaatctaagtgtgcttattttaatatttttattaacagcaacagcagcagcattggggcattatttccaaaggcaaagaattcaaggaagaggttaatgtgatcattttaactaatcattgcacatacaagagctcattcaatcttcctcacagtctgatgaagtgatataagtatcatgtctgttttacaaatgaggaaactgaggcacagagaggttaagtaacttacccagtgttatttcttggcagatcagaactagactttttttttttttttttaatttttagttctagggtacatgtgcaagatgtacaggtttgttacataggtaaacgtgtgccatagtggtttgcttcacctatcaacccatcacctaggtattaagcccagcatgcattagctatttttcctaatactctcccccgcccaccctaactagtagacctttcgtaagaccccttccagttctgagattaaaatgttttatgtggatggggatggcaatcaggtcaaaacatgtagccaaagaagtgagtgggagagaaacaggtaggagttgtgtactagttaaggcttttgggggcacatgtaatggaagctattgtttaggcaacacagagaacttacttaaaaaaatcatggtctgttgcctcacaacatccaaggaaggggagaagccagatagcttcaaaaagctcaagtaaaggagactttgggtctcctctccccatcagaagctgtaagctggtggcccccaggctccatgaggcctggagatgtatttatttggcccatacgtttattaaaaattgagctggtgcttaaaaatcaaaaggttactcatggaaatccagatttccagcttctctagaaaaatcagaccaggcaaccttgaggcctcattccccctgccaccccgcctgtggtaacaattggctggagctagatggaagctgcctcctcctcagcccctctacctccagcagtcacctaagccagggttttacaacattgacactactgacattttaggccagagagttatttgttgtggaggtttgtcctgtgcacaggaggatgtttagctacatccctggtatccactcactagataccagtagtaccccctcctcagtctgaccaccaagaatgaatccatattctgccaaatgtcctctggggagcagagctgccccggagtgaaaatcactgggttgtataatgagcctaagccactgaccactcagtccctaaatctttccattataccatttctgggagtgagatcacttggtctggcttgggtcagaggccttctcctgtgaccaggtggcagggtggcattaaccatcatggctgctacctcctgcagagagggaatcagggcaggcaactcaataggtatccctcacagtatgtgggaaggagggatgcaaaagacactgtgtgaaaacaagagagtccaggaataactatcaatagtataacaatcttcacttcccagaagttctttgaatctgttttctcaagtttattctctccagcattgtgtgaaatagttaaggcacagagttgtcattcatattcaggggatggggaaactagggtgcacagaatggtttaagtggctgcctaagtgcacatagcgaggtagagaaaggattctggagcccacctctgcccctctggctacccctaaaatgacagtcctctgtaacatactctgccctgtctagtccagggagattgaggaagaaaagcaacaccggccatcatcagactcagcccaggcctgaaagcatgaatgatgcagtcacttgtgtttgcagagcaggtttagctggcaggaggccacgctgtctaactcctgttccagtcagtctgggcgtaacccagccattatggtctctctcaggtttcgaatgcacaggagcaattaagtcattctcataatttcatgtggtacagaaagtcccaagccaaaaataccatccttggttcctacttttagacttccagggaacttccccctccctctctccctataattcactttgattccttctatttttctcttcgtgaatgcattggccagacacagagtcctagtttacttaacaaggggctacagagccaacacaaatcaaaataaatccagccttcatttggcaggaatggtggaagttgggaattgctggaggttctcagaaacaagagcttgaaataaaagagcatgtaccctcatctctaggatgtgagcataggagataggagaacatgccacagaatgatcactgaaagatgatggagtgttggaggtggggcgggggtggggtagttgcatctgtactcccattattatttcagggtcctagataaccacaattaagtcactttatcgttagtacagaagatttcttgtcccatagaaccatgacatcagacctgtgttgcttccttaaataatgaatttttccaaatatccttcagatgcgtattaacagttgcttcctggcagtcaggtggctgatttggtctgtgtgtgtgttgggggatacatatgtccatatactgactctcccttcatgtggacccccatttgggttatatcaagagctaaatgaaatctagttggagatgatttcaatgtttcttctgtaggaatagataattacaaacttatttataagtcttctcactaaagcagtggttctcaaaagccttagccagcaccagaatctacgggaggacttgttaaagcacagattgctgggccccacccccatgcccagagcatctcatttagcaggtttagggtggggcccaagatgttgcagtgcaatggcgtgatctccgcctcccgggttcaagcgactctcctgcctcagcttcctgattagctgtgactacaggtggcatgccaccatgcccggctaattttttgtattattattattattattattatttttagtagagtcggggtttcattgtgttagccagatggtctcgatctccagacctcatgatctacctgcctcggcttcccaaagtgctgggattacaaggcatgagccactgcgcccagccaagactttgtatttctaacaagtttcctggtgttgctgatgctgctggtttgggggccccattttgtgaactagcatgatcaaggatggtgttctcgcctaatcccagcactttgggaggctgaggcaggaggatcgcttgagcccaggagtttgaagctgcagggagctatgatgccattgtaacagccagggtgacggagcaagattctgtctcttaaaaaacaaagaatggtgctctaaacgcaaggtttttcacagcagtagtgacagctgctcctttatgcttctgtttcttcatttgtgttgtccctggaaagtccccctcgtcccagtggctgagtcctctgcttcctccaggctcggcccaagttcctgttcctccacggaacctttcctgactagtgcacacgatcttttctcttctctgaactctttcagttgtaaaaatgaaaccctaaaatttcttttgttgccttgtagtatgctcagattgatgcatgataattgttttcccaactagactgaactgatttgatttgtgaacacgatcatcccttagatgctcttatgtgtgttcttgaacttagcacagagccaagcacaggactcaattatttattttgtgatgaaagttcaaagtgaattaagagagaaaatatattgctgagtgttgtagtccatttggtttgctatagctgaataccacagactgggtaatttataatgaaaaggaattttatttctcctggtcctggaggctgggaagttcatgatcgaggggctgcatctagtgagggccttcttgctgcttcaacacggcagaaagcaacatatggcaagtgcgtgcacgagaaagagtgagaaagtgtgtgagagatagcaagacagggccacactcacttttaaaacaaacccactcccacaataacagcatccatttatttatgagggcagagtcctcatgacctagtcacttcttaaaggttccccctttttctaccttcagcactgtcgcattggggattgagttttcagcacatgaactttggaagacacgtttaaatcataacgttgcctataacaccaactgggcttgcctgatatatagtgccagagatacccaccaaattaagctttatggttcttatatggtaaactcatgtgatttctgtgcccaaagctgcaggtccttctgcctgcttcagaactgcccaaacttctggtcttctagagcaggggtccccaacccctgggcaatacggtccgtggcctgttaggaactgggatgcacagcaggaagtaagcatgcatgagtgagcattactgtctgagctctgcctcctgtcagatcagtggcggcattagattctcataggagcccgaaccctgttatgaactgcgcatgtgagggacctaggtgacgtgttccttattagaatctaatgcctgatgatgtgaggtggaacggtttcaacnnnnnnnnnnnnnnnnnnnnnnnnnnnnnnnnnnnnnnnnnnnnnnnnnnnnnnnnnnnnnnnnnnnnnnnnnnnnnnagtaagactctgtctcaataattaaaaaaaaaaaacatagaaaggttcccactccctatgactgtcatggaaaaattgtcttccacaaaacctgtccctggtgtcaaaaacgttggagactgctgttctagagtaaggaccttgtggttttgctcgttatgatggacatccagggccaccctggatggttgccttgaccatgcctgttgtctactgtgcatgagaatcagttgctggactccagggcagagtgatggctggaggtcagcatgcaggcagggaagtggagggggaagatgatcatgagtacatgagtacgtgggacaggcaggttggggccagacttgagagggcttacatggcacactaagggcttgcttggaatttgtcctacagaaagtggaggtttttaacaaaatcacatttgttctttagaaccataattctgagaccactagcttcttacagagtatatatacgaaactaccaaaggcaacttggtgaagcagaggaatttgggcacgaaggcttgtttcatcttggtggtcagcccttcccacctttctttagatactataattcatttcctagggctgccttaacaaattgctatgaactggtggcttaaaacaacagaaatgtgttctcacaattccgaaggctaggattcaaaatcagcatgggcatcaggaccatgctccttccgaaggttggggagattctgttccatgcttttgctcagcttctagtgttgctggccagccttggcattccttggcttgtggctgtgtcgccccaatctctgcctccatcatcacatgaccttctccctgtgtctgtttctgtgtctcttctcttctttaaggacgtgagttatcttggattaaggcccgctttgctgacttcgtcttaacttgattctatccgcaaagactatttccaaattaggtcacattcacagatactgtggcctaggacttcaacatgtcttttttggaggcaacacagtgcaacccacaacagatacacacttcgctgcaccttatcattttaggactcaagggggcagtgggtttgctgccacactcaagctggtcaacttggcagtgtcatgtgttcttggtgagcgctaggaagctgcctggacctagagtaagtaatactagcagctcacttaagtaattatgaagggaaggtgcacaggacctaagcagcaggctgtggagaactgaccaaaaagacgagttagggcgctattgcaggtgagaaataaggggaccttaagtaaggcagtggctgtgagaacagagaggaaaggggagtagtcgaggggtgggtctgaaggagaaccactaagatctgatgtagtgggaggaaggatcaagggtgattcttagcctatttacaaatgtggtgggtggggtatataatccctatcagtatatacgaaggcctatccagacaagcttctctttgactctacccacttaagttatgctttatgtgctgccaagaagggtaaaaaggtgaaaatgatatggaagaaaccgaagggcaaccttagaaatgcatgtgaataaagatattttaaaggcagaaagacacacatttggcctttttgggaagatttctctaaacggagtgtagatgtctcagggaatggcagctactgccatactgagtggacttctcacaaggcggttctagggccgtcgtccagcctgagaatacacagctggctgacctccagggagactcaaaaattcttagtgaacctgtgttgcaggtcatggcatcaccatcatgatgtcctgttattcttcagtagcatttagtaaacagtttttgcatctgtttagtttacacagcaatcttggaacaatggaaaatcctttgacaagtcagaaaattcaagtcctgtttgttgttgttgttgttttagttgcttttttgggggttgtagtattgtgaggagacacttaacttatggaagcttcattttgttttcagtaaatggagcagcaacaccattcttatagcattactctgaggatagacatcagttaatgtatgtaaggtgccgggctcagagctagtgcatagtacacagtcatcccttttctccctccccatcaatcttccttctcttctttcttccaggtttttttcttttaatttatttttagagacaaggtctcactctgtcacccaggctggagtgcagtggtgtgatcatggcttactgtagcttccgaactcccaggctcaagctatcctcccacctcagcctcccaagtagctgggaccacaggcatgcgtcaccaagcccagctaatcgaacaggttttctgactctctgaggcccagagctctttctgcaattctgcctctctggggctaaaatataaatatataataaataaataataaacaaatccctctagaggattttttttttttttgagatggagttttgctcttgtcaccaggttgaagtgcaatggcacaattaccgctcactgtgacctccgtctcctgggttcaagcaattctgcctcagcctcccgagtagctgggattaggggcacctgccaccatgcccagctaatttttttttttttttgagatggtgtcttgctctgtcacccaggctggagagcagtggtgcaatgtcggctcactgcaacctccacctcccgggttcaagtgattctcctgcctcagcctcccatgtagctgggattacaggtgtgagcccccacacctggctaatttttgtatttttagtagagacggggttttgctatgttggccaggctggtttcgaactgctgacctcaggtgatccacccgccttggcctcccaaagtgctgggattacaggcgtgagccattgtgcccagcctaatgtttgtatttttagtagagatgaggtttcaccatgttggccatgctggtctcgaactcctgacctcaggcgatctgcccccctcagcctcccaaagtgctgggattacaggtgtgagccaccatgcccagcctattttttttttttttttttttttttttgagacagagtctcactctgtcacccaagctggagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgccgttgcactccagcctgggcaacaagtagcgaaactccgtcttaaaaaaaccaaaaccaaaaacaaaaactaaactcattggaatcatttacaaataatatactcacccaaatagctagattaggggtcttagagtctatgaagcaaaccctgagagtgaaggtgggaaggaaatgtcagaattataagcaggattaacgtagattaaagttgacagaatctggttcttgctctgtccctttcccatggtggccagccccagctgcccagctgctgttgtctgtaagccaaagctcctgcgtgttctccttccaatagaaaacgactgtgcggaacctcatcctccccgggcccagggtgttggtgcagctgctgagggatctggtgaggtagcctatgctcatgtgccactggagatgcccggagagttccaatgcccaggccataccagcagctccctgggtgatgtccccttggacttagtttcactctgaagctgggaagcaatagcctacattttcagttaaataaaagctggaaatgatgatctcgttaggcctgcctcctgtacttcatgctttggtgctctccttcattttcctgccaggaagactttcccagtgcctctttctatatgcttgcatcccgttctcaagtctctgaccagcggttccactttgaagtccatcccacagaagtattagctcaaggctgcaaagatacaggaatgagaacgcttgctgcaacgctgctcataacagggagaccaggaaaataacccaaagggccattcacacaccaggtttttgagatgaatgacatcatgagcaactcatgagcatgagcaccaggcgtgcctcaccatcttggctccttgttgataacgtgtcagtccctaatatccagcctgactccaaggactgagatgatgagtgtgaaagtactttgtaaattgcaaatggttttgcaaacctaagggatatgatgaatcaacaatgagcaaagtcctttgagacctttcacaaataaaggcattttatatatttaaatccttggcactcacaaatttagcatttgaggttttgccaacctgtggagcaaccccatggcaatttgccatttagctgaggcatatattttcctccatccacaacctgagtatctcagacgaggatgaggagtgagtgaatgaaggagaaatgttaaaatatgattacattatagagtctttaaatgctcattaaaacatatattcgttcagtatcttttatgctttcattaatgtgccctaggctattgagaaagaaagagtaagacaaaaaggtgaaaactagaaatattctatgtaatggaaaagaccataaatatactcataaaacaattagtgagcacagaaatatacaatcaggtaatctataataatgtacatgtaataatctacaacagattttttcccttattttggattctgagaagtgagcactaacatattgcaaagggatttaattgcaaatgatttgtgtaaacctggtgccatagaaaaacttctggggttgaatttaattttatcgcatttaaatagaaaaatgcccacctgagaatatgcagctgtaattacgagggagttttattggttgttactgtggcatgtgtttatttctctcccacttaacattctggatggagggagttcaaggctgctgtgtagctctgcagttgtctggttttcctgctctgccatccttagggtatggccttggtctgtcctcatccttatgggcccccagtgaagctctgatcaagacctcctaattttgaatgtcctagaacttgaatacaccccttccacttatgtcacacggccacatctaaactacatggtaggctgggaatgaattttttattctgggtaactgtgtgtccaataaaaagcccgagattttataactcaaggaaaggaagcacagctcacaattgctgccacaggtcagcctctgtctgtccatgagccagttgttcagatgggaggaaatctgaatagaggaagagacaagtcaggcaagaaagttgtgactcagggtttatctcatctgctggggagttcaaggggcagtttaatactggctgtatttttcgtttctctaagtagaagtttcatttaagttactgtggagtaggctgggcgtggtggctcatggctgtaatcctagcactttgggaggctgaggtgggcggatcacttgagctcaggagttcgagaccagcctgggcaacatggcaaaactccatctctactaaaaatacaaaaaattagccgggcatggtggtgtgtgcttgtagtcccaactactcagaaggccgaggtgggaggattgcttgatcccgggaggcagaggttgcagtgagctgagatcatgccactgcactccaacctgggcgacagagtgaaaccccatctcgatagataaataaataataaataaattgtggaatgatcttctttgacattctgctagatatgaaggctgcttagaggcagttgtttgagaaagaaaaaagcaagccctgacctccaggaactggtgacagtggacgctatacaccactcgttcacagtgttgctcgacgctggtcaggtgctcacagctcggccatgttgtcttcctgttggccataagccgactcacagagcactgaccttggacaaggtcatggtgaaaccatggtaaatagagacaaagcaaagccacttcatatttttttctgagcacagacacaaaaaagtttcctgtaggacccataattttgattatgacagggtaaagacaagttccattttctaggatttgatttgagccaaggtcaatgaatagcttattttgtagcttaattgacaacagtaaatacttttgcagtcttaggtcccgcttgatctgtactagggagggtaatttgaaccaagagcctgattcccgggcatttctgccctaaccagatcacgggctaaggatgcaacagagcatagtttcagcagagcccccttgaaaaaaaagttatgctgaatccatgatgcaacatccatttgaaatgaggaaaaagaaggcaaagatgacatgatttattttgtgtcatacctaaataattagaagaaagcccctttttctagtagcacctataaaaatttcactgggctttggaggtctaaagggaaattctagcacatatttcagctccagttaatccaaggttaccatcatctcagttttgtgaagagatggaaagaagccaactgaaacagtagcgtaggaacccagccctgccttttgctttatatgtgaccttggccacgtacctgaccttcacctttctcatatagaaaaagaaaataggcgggccgcagtggctcacgcctgtaatcgcagcactgtgggaggccaaggcagatgactcacctgaggtcaggagtttgagaccagcttgaccaacatggtgaaacctcatctctactaaaaatacaaaaattagctaggcgtggcggtgtgtgcctgtaatcccagctactagagagactaacgcaggagaatcgcttgaacccaggaggcagaggttgcagtgagccaagattgcgccgttgcactccagcctgggtgacaagagcgaaactccctctaaaaaaaaaaaaaaaaaagaaagaaaagaaaatgaaaatagagacgcctgcctgatactcctccaggcatcactttaatgtgtatggaaactcttaactgtgaaaggccatatatccaggaaacgggccattatattcctgctgttgttgttaattttatcagaagagagtcctacactgccgactcagtagaacaagtagcttttgagcaatggttttgtgtgcagtcactgtgcctggtgttttgtgccaccgcctttccctgtcacatttgtgagccagggagaggggcaaatgcgagatgatcacacttcagtgccactactcgcagataccatctcgctgtgggattatgctgcttactccgaggagagatctggaaggcactgttgcctcttgcttttgcattttatgtatctatttatttatcttttttaatttcttcctttttatttatttctttctttatttttagacagagtctcactttattacccaggctggagtgcagtggtacggtctcggctcactgcaacttctgcccctcgggttcaagcaattctcctgcctcagcctcctcagtagctaggaaagggtctcactgtgttgcccaggctgaaggactatggcacaatcccgtctcactgcagcctcgacctcctggctcaggtgattctcccatctcaggctcccaagtagctagaactacaggcacatgccaccaccacacccggccaatttttgtatttttggtagagacagggtttcgccacgttgctcaggctggcttttgcattttagatgatggattttatcaagctgacatctaattctaacaatcaaatttagacttgatgagggtctgaagctgaagactttatttgcagcatggaactcacctgccaagctggcttctcaaaataccagccaggcattacattttcttctgtgtgggaaccagttaatatgtaggtggcttggagtgattctgaggggtattctcaccagacaacaactgaaagtttcctttctccactctagagatgccttggcctaagagattgtattcataggtgccctggtcaaaatgtccttctcccctgggcaggactggagacagctttaccagtccttaacttccaatgccatttttagcttctaaattggcaagtgtcttttatttactttcaataatttttaacatatttgtataatttatatagtgtccagagtttataatgtattactttacacctcatttttcagttgtaaatggaataaaattgatcaagccccaaggtgtgtcaggcactgtgttagatggactctggagattcagagaaaaagagacagatttctttgctcaggtggcatgcagcgcctagtcaaaaaatcagttgtgttatgtctaattaaggtcaagacgacatgtgaaatccaataatacagatgagtcctagacacagaacttttcctcctggcctcatgagttagattgtggcacccttgtcatggatgaggaaagtgagactaagcggccttaagtgactgcagtggtcacccagctaaggtgttctgacttctaaatactggccttgtctacccagcacactgccccgcgtctcaccttgtcagcattcttttgcagtatgttgccatttcaagatggcatgttaatgtctgtgatcatatagaaggtctattttggggtgccttttttctcaagacatttaggacagtgccttcgttaattggacatgtccctaaatcttacttgagtcacaaactgatcccctcattggcacgctggtttctgttagcctcaaggtgtactcttttctaacttttcctgcctttttttctccccacatctgatgctcatggtgcctgggactttcctgagaattggccagaccccatgttcttattacctccaacagaggctttagttctgccaggcaggggacgaacctacctttacgtaggtgttctgtttgcattagtttgaaaatgggtttgagggcaggggaaggtaagttatttgagtgcatagcaattaggatgagggtatgtattaggaaaaacgaatcagtagtatcacagatgatctcttgatgttatcaaaataactcattgatatgacatcttcaggttagctttcccgttctctatcttggaagtcaaccctgtgaggttggaaacaaaagagttaaagagaatcccctgggccacccagccagtagtaagtcgcagaagaggaatttggagtccgctcttcaggctccagcaggctccagtgctaagcctcttctctctgccaggtcatggcagaatatggacttagccacaataaagctgcctcaaggaccgaggagagtggttgttactgactgactttattcctctcagcatccaagaagatctcttcaattaaacattatagccttcgggcattagcccaggagacacagttgagggtcctaggtgctttcacttaaggcagggctgttgagtcggtgaggggatgagggcatctcaaaagaaggctggctttcaggattgcacagagatgttcctgctcccagcagactggggtaaaatttcctgggaatgagggcatttctgaggaaaagagaagggaaattttgttgactacaagttgctatagtataaatgggagaattaatctatttttaaatgctcagatgtaaagatacattcttattgttgaatccatattttcctcaaaagagagtggagacattaattaggaagacatttttaatacatcttgaggattcagaggctgccactgataaaatttaaaaaggaaaacaaatgtgccaggtgcggtggctcacacctagcactttaggaggtcgaggcagacgtatcacctgaagtcaggatttcaagaccagcctggccaacatggtgaagcaccatgtctactaaaagtacaaaaattagccaggtatggtggcatgtgcctgtaatcccagctactccagaggctgaggcaggagaatctcttgaacatgggaggcagaggttgcaatgagctggcatggtgccagtgcactctagcctgggcaacagagcaatactctgtctcaaaaaaaaaaaaaaaaaaagaaaaaaaaggaaaaaaagaaagatatacaataagctccctcctccaagagtttgttatgattgtgattttatcgtttggctagcttcttagagctagcctgtgagaccttcaagaaagcctgtcaggatttttcataatcatagctccaacaaaagaggggcagtttgggaatttcttttttaatgggaaccccggaagatttatagctagaaggcgatcacaggtttctagatcagtgcaccagcgttcagcttccttttacaacatgtggcccacttccaggtttcaaaaagtgtgaccgcatcatgggtagactcacttcctcttgtgcttaggtctgagaatgagcgggcagagtggggaaatagcagtgggtggggagggtggtgtctgaagatgtttgtgggagtgtccagtggttctaagcctctagaagtatctttgccaataaagactcagaaatgggaatgggggtgtgtgtgcacaccagaaatggccgtgtgtgtgtgcctgtgtgcaccagaaatgaccgtgcgtgtgtgtgtgtgtctgtgtgtgtgtgtgtgtgcgcgtgctgggcaggcagagccatgggaacaggaaaacccagcacccccttcagccttttcctagggactggcattcattgccaggcatgctggttgggaagaactgcccaagattttcatctagaagagattcaagaggacccaaagcccaggctcttaggatttcaccagatgataaattataaagtagctgactggtttgtggtgaacagttgctcaaatgcccttttagcttctcagtggtgacaaagtatatctcacggagatcttacattacattaaagatttaggggttccagttaggatatttaaaacctttgccagataggagatggtatcacatacctcacaccaaatttgtgcgtctcacagctgggcattgagatttttaaaatagcaacttctgagtggaaaattgttagggaaaatctaatcaacttaatttaaatggcataaatgatgattagagctaattatcgtcagaatttgggctggtgtttctaaaatgaaactacagagtttctttaaatggggtcatcaggttaggattcagttgtcaagaaagatcaatgatttgtgtgaactcacagtcttctcagcttacctggtagccaggggtaatatttcacacttcggagtgaattgcatttatattctttttcttcatagctcactcaggatttttagaagatgaaagaattgaatcttatggcaacaaagcccatttcttcacagtggaactataaatgcagacttaagtaattaatttgtaaacctttgtatctttttaaaacatcatcctatccccaaggcctaacataagttttgttgactaggtgaaatgattgaatcagtgaatgattgaataaatgaaaaatataggatgcagttcaggaaagaaaaccacaagagtgcggcggctatttaaaaaatgccatccctgtaattactgttattgccaattcctgtttgtgtttatgaagcctgaggaattttggagggcactaccagtaatttgtatctcattactcaagctaagggagggataaatgaatcctaaatgtaaaccttttaccgtcaaaatggaaaacctgtgtttttccagtgatgtgtcagcagtagctattaatattaaaatcacgaacctacacacatacctttaagaaatggactccaggcttgtaaaacatgtggccgtaatattggcagagcaagaatctttggcctctgaataagctcactggccttcatgtctgtgataatttgccatagagaccaggctttttttctgaggatctatcccagtcactgtagttgtggaagtggtggttcttgtataacaaagtcatctgaggtaatatttccacacaataatttttagcaaaaagaaaatgtttaatggttatcccaggtggcagcagattcccttgtggaaacaagaatggcgggaatcaaaggttgggcatagagaagaactttcctctttgtgattcaaggacagatgttggcaacctctttgaactgaatgattggactccatccttttcactcatgttgtcctttacccccagtcctcacctggatttaagcgatctggtctgaaagaactccttccatttctaccctttaaataggttcttatttaatgccactgtagtcaaggaagagagggggaacaggattggagcaggggtgaggttcacaggcaccccgagggaggaaaccagacgtgaacatcccacacatagcagctttgcatatggacagacctgatttccttctatgcctcttcccacagtgctgtctgggccattaagaatcaccttgactcatagttctggttttcagttcagcttctaggaatgcatgatttcacaccttgtggaggtagaacgcagtatcactgatcagggcacagctatcgggcaacctcagcctctctggaactcagcgggctgtgaggaagtcatgtatctaagaagcccaaacacatactccatggcccttgactgtctgaaaaactcagtttcggagtttaatacattcccccagggtaccaaataactagatttgtaaatgtaaattttttcagtcagttcttaaggtttgatgaggaacaggatatttacatagtcgcaaagtatctcaccacaaatcactttgcatttgtaataggaaaaattacgcagtggggaagttggaaaatacttaaccaaatgatgaaagtgaatatcacctacaaatatcatgtacctctggacatcatgccctcagaaggacacaaaattatttgcctagaattctagtcaaaaatgtaaaagatgaatctaagtatgacaaatatcaggcaaactcaaatggagggaaattctataaaataacttgcctgaactgtttaaaatgtcaccatcataaaagacaaaggaaaactcatgcctgtaatcccagcactttcaaagcccacggtgggaggatcactcgagcttaggagttcaagaccaacccgggcaacatagtgagacctcatctgtactaaaattcaaaaaaattagccaagcatggtagtgcacacctgtagtcccagctactccagggctgaggtgggaggatcacttgagcccaggaggtcgaggtggcagtgagccctcatcgcaccactgtactccagcccaggccacaagagcacgaccctgtctcaaaaaattataaaaattttaaaagccagacatggtggctttttatcccagcactttgggaggctgaggcaggcagatcacctgaggtcaggagtttgagactggcctggccaacatggcaaaaaccccatccctactaaaaaaaaaaaaaaaaaaaaaaaaaaaaaaaaaaaaattagctgggtgtggtggtgcgtacctgaaatcccagctactcaggaggctgaggcaggagaatcatttgaaccaggagacggaggttgcagtgagctgaaatcgtgccactgcattccagcctgggtgacagagtaagaccctgtctctaaaaaaaaaaaaattctgacaaatgtggtacatgatcctgcaccaggggaaaaaataagtaataaaggacatgattgggataataaaattagaatattgacttgtataaaaagtattctattgatgttaaatttcctggccgggtgcggtggctcgcgcccgtaatcccaacactttgggaggccgaggcgagtggatcatgaggtcaggagattgagaccatcctcgctaacatggtgaaaccccatctctactgaaaatacaaaaaaaattagctgggcatggtggcaggcgcctgtagtcccacctactcgggaggctgaggcagaagaatggcgtgaacccgggaggcggagcttgcagtgagccgacatcatgccactgcacttcagcctgggcgacagagcgagattccatctcaaaaaaaaaaaaaaaaagaaaaaagtatgtgaattctttgtatatttgtgtaactgttgtgttgaatttaaaaatagatggtttaaacagccctaccttcattgtcctgcactcaaacacaaaacaaacagaaaacccagttgtctgctttactctgggatggatcagcaatcactaaaaggactggaagaggtctccatcccctctgcccctcacccttcctccaaaatcaagtcactccagttgatgtggacagtgcctgcagagagacacctaccagcacgtcccgactgtgtttcaagggcaattaagcccagggaactgctgggcaaatgagctgttctccctaggccttcatgctggcctgtgttggtaggagcccccgctctgccatgcagagccaagaattttctcagcaacagtaatggtggccgcaaattgaggtcagtaggaaaacagatctgttttggtttgtaatgttgcacacaatttggtgagtgaacagaaaagaatgtaccccagtgaagggacagcctgtgaaccctgtgtttggttctgaatatccttatgatgcccagcatagaaaacaggaagcatcagttaaaatgggaaattgctgtgggctggattactgtaattcctcgtcttacttagaagttggcatagagcagggtcctttatccacagcgtgatgtctcttgcttttctatgccttgataattttgccctttctttagggtggtgcattgctaagctgacaggcttttaggctggaattgctaccttttagtatgcttagaaattgtgtttttaaagagctgtttgttttttctctgtctctaggttaaaagcagtctagctccactgctggttctggttccctcctcctgccccctctttaggtctaagtaggcgagattgagcacacagagggactcacagctcagcttaataataaccccgcagtaagtgacatagccattgttacactagacagatacacagaggtaagttctccaaagcagatgagctggaccggaaatttgcacatcagtccttccccgtctcttccactcctttggggtcctccaaagcaggaggggaattttgccagcctttccacgctgtaacaccgagataattatacctgctctccgccctcctggcagagttgttttaggactctcctgggatgattaacggctaagttgtgaaacactgggagcaaatgcgaggtggcattattttctctcgctggatggggatctgactacagtagttggtccctttccctctggaaagaagacagtttttctgcatgacctgggctgcaccctctgatggagattccatcttggctgcctgtttcctgtctgtagtgccaagtactcagccttgccttcctggccctccttcggtcagctctattttcctacttaaccgaggctaccgtttcctcaacacaaatccgcctttctagtccagttggtctttttagggggttttcacgtggtgaaaagctcagtgcaaacacaagcgatgttgttaccctcgtccatgcctttactctccttgtttccctctcaggaatgccttttttttcctcctctctcccaattcagtgcttaagcttttttcagtcctaactcaaatctgatctccctgaagcctcctaggatgactcaacttttagtgattttgtctcattcattacttcattgaacaggcatttataaagccacttatgtgcatggctctttattaggacaaggagagttcagagatgaggcatgccccatcctcaggtcacttacagttgagaaagggagggagaggagatataaataagccaacagtgggggtcagaggacagacaagattaccgataatctgggaacttgcaggctttaaagaggtagcatttgcatggggtcttcaaggatggactagattgaacatgcaggatatttggtccaggtggtgagaacatcatggactaagatgcagaggtcagatgttccatgcaaagagccccaggcagactggtggcaggagcatgaggcattgtgggaaatagcactggcaaggagagtgggctatgagctaggctaaggaatttgaacctcactgactggtagggaggagctcccctgagggcaagagaaaccctggctgttaggaagagtcaaacccccgtcctgtgggggctgaaacgacaggggcaagggagccaagaaggcctgtgttctcccttgagttcctgtggctgccattgacaattgaaagcgggagggcaaagatactggcatttccaggacattttgtggtatatggcatgacgtgaccaagcacagctatctctcactatccaaagctgtttatttccaagttcaatggggtttgggtaggacatttgggaataaggaatgctcctttgtccaaatctatttggaataggaagtagtgagattccagataagaggtgatttatcaaaaattttatacagatctatttagttcctgattttggacctcagagaatgagggatatctgcctttgaagcagctggcccaggaaaatccgagagacctctaaggggcacgatcatgagatagaactcacaccaaaccatctcagactgttacagtttgtctagttggttaacataagcaggggtgatataaaatgtttaaatagttagcaacatgaataccgaacaatcagggtggaagccagccagacgctctttccagtgggaactgagtatcagttctgtatatatgtcagggtttctgttgttattttgttttgtttgagacagggtcttgctctgttgcccaggctggaatgcagtggtacaatcatggctcactgcagctttgacttctcaggctcaagcatttctccacctcagcttcccaagtagcagggaccacaggcatgcgccaccatgcctggctaacttttgcatttttagtagagacagggtttcaccatgtttcccaggctagtctcaaactcctaggctcaagtgatccacccacttcaacctctcaaagtgctgggattacaggcgtgagccaccacagctggcccatatatcagggttttttgttttgttttgtttttgctacatcagatgaaaaaacttttgagggcttcatttaccttttctgaattcactgtgatgcctaaaacaacactgtacatatgttaggggcttaatattttagattcagctgaatttcattagctttatacatattttttaatttcacaaaaattatttattttattttgtttttttttttagagggagtctcactctgtcacccaggctggagtgcagtggtgtgatcttggctcactgcaacctccacctcccaggttcaagcgattctcctgccttggtctcccaagtagctgggattacaggtgcctgccaccacgcctggctaatttttgtatttttagtagagatggggtttcaccatgttggccaggctggtctcaaactcctgacctcaagttaataatcatgccagcattatggactgttgggacaattgaatgagttagtataagtaaagtgcttagaatgttgcttggcagatagggaaccctcaataaacttaactgggagggggtttcattctaagccagtgtgccttccatctggtagatgggggtgattgtccgttgcccttcttttcctagcagaataaaaagggtgccttgctgaattctaaactgttttctcccactcagtgcagacttattccttacctgtggtgtttggaccaatggtacccccatgcctccctgtgcaactccagaaaagtggcttccccagcccagcacacaggacagcttaaacagtttatgagccgaggcctcccctttgtctacaaactcccatttgcctgccacctcaaatcctatgggatagatccccctgagactttatacaacaaggtcacctctcaagctctggcttgtagaaatttagtcccttctttggcaatgtggatgcctgaagtagtagatagtgggctatgttcagataagaaagaccccctaaatgggtagacccacgctcatttcgcggtcttgtttgtagctgtagtactgtcgcagttcagttgagattttcatcacactggtcaggaaattcatagtgaaggttactacagcaaccttaactctgctctggaaagcatagcccttacaatggggcctttcagaggctggccctgaagctgggcagtgattcagtctattcagaacacaatggggcaaaccagaatagaaaggaactgcacattgttttaggcctcccattgccatctgtagcatttcgtattgttgtccatccttgcggccaacatgagttttagtttctctagtaacgcactttaaatttcagaactcatatgcctgccagtcgtagtacatttcatgggagttgaaatagtaataataattctgtagtggtgtacaaactcacagccagaagatgctgtagaaacacatgtaggaaaaggtggattaaggcttttcatttggagacaagggaaacacccattgggtgtgtttgaaacaaaactgatgaatttgccttgaaatcctgtaaaactatcatagatttttttctttaaaaagaatgtaatctttaaatgaccagtaaaataaaatcaccccttgcctttatccacagccactcaaaacaaatccactcaccaaacaaaatttacttaacaataggatctgaacggtttacttacatttttaaatctagagagtgttgggtagattttaaaaagctgaatttagctatttagcatgtgaactatagttatactaagcaaaagagctgtggtttccttagaatgagagttggaaggaaactttttaaaatttttttttcctttagagcatttatggtatttgatttattcatactgcttgccctgtgatcaaacaacttttctttgttgtctatttagatccctagggttgttttatttccttcccttctttaatgtttccctcatgtttaatttaaatcatttgctttttatcttcctcggcatctcaagctatttctctttttgttaatctttgttttctctctctctctctctttttttttttttttttttttttttttttttagtatttttagtagagacgggatttcaccatgttggccaggctaatctcaaactcctgatctcaggtgatccgcacgccttgacctcccaaagtgctgggattacaggtgtgagccaccacgcctggccacctttgttctctttttgctgcactaaatttaaaaaataaataaaaaataattgaaatgtgcttttgtttgtttgttttagtgcaaagctagcagctacttctgtatcttaaacacaccagcctccaacaaacaccaacaaacaatcggtgaaaccttttccttttaactccggtgaacttgaattgacatgtagtcacacccaggtatctttgggtgttggttatttgattaggaggtaatactgtgtttttggtccaactccaaggaaaggaaggggtcacagaccagcaaagaatatcaggagtactggtgctgcttttcttcatattttgggtcgctgggctcaggtagaaagagacttttgtgcacttgggaacagagtatcgtacaaatcctttcagcatttttgcaaccagaaaccatgcaaatgtttttgcagatatgcttgtggtcttgctggcagtttgtgagcacaacgctctgtttgaggtggtgatgttgacttctgttttctattcactgtcctgccccaaatcgagcatgccgtcttgtactttaattgtgtgagcacactcttttctacctaatgcggagagtgggtatcagttggtctccattccttgcataaaatgatttttactattactgctttgagataatttgtgtgtttatctcagcacctttgactctcattcctgtcagtacagcaagggaacccagcatttactaccagctctgactttgcagggttgagagtggcatgctgtttgactttggaaactatgttaaaaattcctccagtggatccctagctgggactgttttggcaattgatgtctatcttgcctactttttctgaggatttctgcaaggttattttaaacatattcaagttgtctgattgtgctgaggcaccgttgtcacaaaagaaagtcacagtctattacctctgcaaaatttttgaatgagaagcccgctgttactgaacaccaggcatggggagtctgactttgaagctggctacgaggcatgctttcaaggagacaaggcagaggcccaaagatgtcgcagggtggctccaaagctctgatctcagctttgctgaggcatctcctgtgcccatgatctttctaagagtcagtcattcaaggtacccaaaatgtccctctgtttagaaagggtagctctgttccgtagccaaggtaacacttcatccagtttaccactgtgggatctaaaggcagcttcaagggttgcatatgaaacctggctctcagaggacatctcccgtgagatattttcaccgagtggggaatccatttcttctgtcttctaccgtagccttaatagaagctgccaggtttctaaagccaccaaaccagtacaaatctggattccatggacacacacactctgtcaccaagtttttcatctgttaaatggggatcacagtacctccctgtttctagaattcttttgaaaccaaatgaaacaatgtacgcaaagcacctaacgtagcattgggaacatggttggtgctcaagaaaagtgatgcccgttccccgatccccaaacattgtggggcacacttcttgatgtgggttgcccttttgatgccatattatatttcacagatacaatgagaagtaagtattcttggagaaggaaatccaaaaatttccttggattttctagggagttgtgagttttaaactggtgtgacccaaccatgtccataatcacatcagacatggtcagtttgtgttttgctttcagttttagtgattctggcaggagagagttactggcagaaggaacaccttgaaatgctacagccagagatctctaactagatgacagctttctaatttctgctggcattgcccctcatcttctggagattgcctttttcctttctgtctgtcttgtttctagatttcaagccaatgccttaactcttactttcttcccataagcagagacctgtgtcttgggtggatgacaaggggttctgggaaagagatctccaaagtggggtctatgcacttttatgtgcaaggaaactcactggaaagaaaatattaaaacctaatttgtatttatctttacattaaaaactaagatgaaattgagctgctcccatatataatatttggatggaccccagtctcctcatgcagtttgattgccagagggtcagggctcacaaatggtattacttattatttgagaaattcaaattatataaatgcctggattcagctgattattttatggtaagcatccaaaatagtgccttatttttcttcccagaaacaaaaaacttttggtacagatttgctcaggagggactggaagcagagagctgcacagtgctgggctgggagtcagaggacccgagttctagtcctggttccagtccaggatggccccgtggacacatcctttcacctctctggccctcaggtccctcatctgtaaagtaaaagttttgcactgcttaatcgataggccaggccccttccagctacaatattttagggttctgaatgtaaatatgtaagtattctgccccttccttatccctgccactttgttgtttgtttaaacaccttaattttttgcctacaaggcatcagtctgttgctcaaatggtctttgtcactggcttccattttggttagcctgctgaactccctatgtatcttctctgcagctactgtctgtcgtcttcttttctgtggcggatccctattctcagaatcccatattcaaattgactcacatttatagtgtccagttatacatcacttgagcatcatgaaactttaaaagttctatattttttatttgaatcctgtccctcctattatcttattagccagatgagatgacagtacccagtctctttcttgaaatatcatacatccaatcagagctatattagtggctagtagtatcccagttcacttattaataaccaatgcaaaactttactcatctggtactgtgagcttgggtaatatgaaatctctgtgcgttatctcttttaatgtactcaaaagcactgaacggggctgggtatgacagctcacacctgtaatcccaacactttgggaggccaaggcaggaagatcgcttgaacccaggagttcgagaccatcctgggcaacatagtgagacccccatccctacaaaaactaaagaaattagccagacatggtggcacacacctgtagtcccagctactcggtaggccgaggcagaagaatcacttgagcccaggaggcccaggctgcagtgagctgtgatcacaccactgcactctagcctgggtgacagagtgagaccctgtctcaaaaaagaaaagaaaagaaagattaatttaaaaaaagtaatagaattatttgcccaatatttggtgagtcggtgagtgacagtggtagtagtagtggggtttgagttaaggaataattgtttgcaaagtgagaactgtaaggagtgcctctgtgcaccatgcagttcaaaacccatcaggaacatggcaggctcgctgagcgccttcgctgcacattgttgattgtcatgtatttgtatgactatcatctactttaaaagttttcatttgacaataacttataatcattcattcacgcattttctgatccactccttctagttgagggttgcaggtggccagagtctatcccggcagctcagggagcatggcaggaaccaggcctggacaggaggccatcctatcttagggtgctcacacaatcccccacattcactcagactgagaccatgtcaacaccccaatgtactcaatgtgcatgtctttggcatgtgggaggaaaccctcacagacatgggaaaaacatgcagactcctcactggctggaccaggaatccatttttcttcctcattatctttatcacaaaatggcgtcatccgaggacctgctctattggcttgctgttgaacctttaataaagatctaagctgatcaaaggaaggcagaatctacctatttgtggccaccctagaagcatacaacagtgagggtcctggtaagatcagtgaagccgtgctgatcttccaaattggtttttattgcaaattcattctagagcttgctgattgaacttggggctggggaggtggcagcaactgcaggtagccctcagaaagtctgtcgggaaggacacatcaatagaagataaggctcccgtctctgcatgctgcattgcttgccttctgcaaactgggcttgcgatttgggtgtgggttccgagagacaagcccctagcaggcccattagaagacagtgcctcccttcatgtctatcctagggcttttagttgaattatcaagcttgttcttaattttccccaccccttctaagttccccaagcccactcctaaagtccaaggtatggatcagaagaaacagcaagatagccctgcatcctctgtcaggtggtggaagggagtgagaggatgaacttgtttgtgatcacacattgagcggccctgagcctgcaggacccttggcgacactgatctgccatgtggattagtggctgctcttgtggcttctccctgagatgtgcccacgggactctcatctctgccacccatcaaccagctgtggtctgagatctctgtttgtaaacatgtgtcattgataccctaaaggcccctagaccaatgcccttatggttacattttgccccaagagggacatggtgccactgtgccatagatcagagcagatcaggcaagccaagggtccagaagtaaccatgccagaaacaggcattcctcacttctgcatttggttcagcgttggctagtggttgttcagggaatgctccttgcccctgagcttggcttgtttccctggactccgtatccctatagcaaacccacaacaaaggctgtgcccacatcaagacacccctgatcacatccagacccttcccccgcttagcacgtccagacacagtacccctaagtgagagatgacacaccaacaccttacctgtgtcaccgctccttaaaatccaactctttatactcttgtggagtttccacgttggcttttaaaagacagagatgagaaaataatttcatcaaccttataaaacttttaaaaattgagttcttattcagatatgccccaaacatttttcagaaaaatagggcaatctgagaaaaccataacatgtgagtagttggttaactcatgtcagcatacctccagcattttgcatgacttataaataatgcgtattttgcaagcagtataggagagattcttccaaggataggaagtcctgactttttggcaggttgatatcaactctgccacagcctgctgataactctttgcatactgttctttttctcagaatagcatttaaattagagtttctttgttccatggtacagggtgatagttcatattatgtcacaagaaattgttcagttacctccctgtctttatttatatgcacagctgctggtgtttctagctagtcttcctgcctcattaccttggctgtgtaattgaattagaaaaaggtattgagcagctactacttcagagactatcattttcaaaccacaaattaggacacagagtctggtaggatttttgacttatgaatctattaggccggtgccattaatggcaaaaaccgcaattacttttgtgccgacctgtatgattaataaaaatcttaatggacatgcacacactaatttggtatgcatttaataggctgacttaattttttcttttctttttcttaaaaatttttttcacttttatttttaaaattcatttcagctaattaattaattgattttattattttttttaaagacagtgtctggtcgggcgtggtggctcacgcctgtaatcccagcacttgaggaggccaaggtgggtggatcacttgacgtcaggagttcaagatcaggagttctctactaaaaacacacacaaaaaagaattagctgggcgtggcggtgggcaccttctgtaagcccagccactcggggggctgaggcaggagaatggcgtgaagccggggggcagaggttatagtgagccaagattgtgccactgcactccagcctgggcgacagagccagactccgtctcaaaaaaaaaaaaaaaaaaaaaaaaagagacagtgtcttgctgtgttgcccaggctgttctcaaactcctggccttacgtgatctttctgtctcagcctccactgagatgaaggacatgaaccgccacaccttgcaagattgctttaaaactgtaaataataaaattctgtgaaactggccttgcccaaggcacagaggcatgtgagaggtagagcttgtacccaagtctgttgattttaatcagtttgctagattaggaagaaaagttacattcctgaatcgtattaccgaatgtctaagagctttgcacttaaaaacaagagtggtgatgtgggagctctcttaagggactgttaagtgcttgatgtatgtgacatgctagcagagccacagctgaaaagacagggactaacatcagtgtgactctcttgtcacttgtttgattaaaatataatcagagcagaagtgaaatgagcatttgtcatattaaggaatctcaagcatttgattcatattattctgtagcttgaaatgtccttacctcactaatgatgtggtgaagattaattgcctgttattctgtttaaaaagttaatcatccaggctgggcacggtggcttacacctataatcccagcactttgggaggctgaggcaggaggattgctcaagcccaagagtttgagactagcctgggcaacacagtggaaccccgtctctacaaaaaaaaaaaaaaatttttttttttttggtagagaaacacagccaggtatggtggtgcacacctgtagccctggctactagggaagctgaggagggaggattaattgagccctggaggttgaggcctcagtgagctatgtttgcgccacagcactccagcctgggtgacaaagtgagaccctgtctcaaaaaaataaaaataaaaataaaatagtaatcatccaacctcaaatatctgttactcttaactggactacttacatggttaagagaaggagaactgtgtttaggggcaatatctcttccctttgatctcctgagttgggggcaaataggaacgccttggaaacttatttcttccttggagcagactctgggcccaggactcctatttgccccacgatagctgctgccacagtgctgccgtgtacctacagcaaacatgttgtgaggtgagtcagtgtagcctggaatttattcacccagctagtaaagattgggcactcccatgccccaggcaccaccctggtggggacatggcagggggcagacatcatcccaaggctgactccagggcacggaacttcctctgcattatgcaaggctgtgcagagccaggctgctccgtgagctcctagcttgcagggctttgtaccaggtattctgtttaccacgtggtacttctttttcttctgtaaaaaaaaggataatacaagtacttggtggtgtcattgggcagatgaaagaagttgatacgtgacacatagtaaacatgcaataaagcagttactatgaactttagaattattgctgtttccaactgctgttactttattatgagaggcagtaggtacaatgtttaagggcaaagatctgaagcagactgcctgggtttgaagcccagctgtgggagctgagcaagttacttaacttctctgtgcttcactcagtttcctgcctcgtgaagttgtaaggattagataagttatatgtaaaatgcttagagcagtgcttggtatgtaataagaattagctgttacgtgagaataataataatgtatttcattcattcaacaaatacttgggggctgcccatgccatgcatcatggcactctactaggtcttggggcagaatggtgaataagacttggtcctaggggtcagtttaatcagggagccaggcactcaggtaatgctgttagagcaggcttcttagcaagatgatgcctgacctgtgctgggtgagagtttagtaggcatagagttgggttgaggtagggaggagttcatagaagaataccctaagctgggggacagtgggaatgtaggtactgaagatcccacctcacacacacactgtggaaaaacagaaacaaagcacagcatggtatgcacagaaaatggtgtggtgggaacctcaaaacggagaaagcaggggttagagatggacaaggacaggtcagggaagcctcgctaagatttgcacttcaaatgcatgcgcagctaccttgaggggttccagaccaggcttgtgaaggcagccactgtcctctgaccgcccgtctccctgggatgagggcaaccagagccctttttgtgccctggaggatggatgccctgagcatctcaaagagcctgggctgcccaggcctttccctttcccctttcccctttcccctttcccctttcccctcccctctcccacttcctcgtgcctttacttgccttctttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgagaccagcctgggcaacatagtgaaaacccgtctcctactaaaaatacaaaaataagcttggtgtggtagtgcacgcctgtagtcccagctattcgggagactgaggcaggagaatcacttgaaccagggaggtggaggttgcagtgagccaagatcatgccattacactccagcctaggtgacagagcaagactctttctcagaaaaaaaaaaagaaagaaaagaaaaagaaaagaaaaggaaaagtcatggggaaagtcagacatcatagtaatcccagggcagacatatcgcatggagggtgggacacctttctgcttcaaatggtgttaatattgaaagaacctgtaggctgaaagagatacaaacttgaacatgtctttacaaagcgaagaggaaattacgtaaagaccttgctttgcgagctgtggtctggtgatgggtggcttctcttgggcagcttgtcatccaggacccttgtcctcatcctctagtgggttggaggtgaggatgggggagggggtggcagctacaaaaatttctgcaacaaagcctctaaaactgggtgatcatcagcctcaccagtaaagccactacacagttcctgacgtgagattagtatttggtacaatgcttccagagtaatcaaaatttttataatattttttcatctgtgatgatattaaacagtgatatttgaagagtacctggcccttagtaaatgtcatgcgccagaatatatcacacctaagatgctactggttataaaaggagcatcattattttatttacagtattgaaaaataaaaaaaaactgccagttaagctataacacatcattgattataagacatccttttttttttttttttgagatggactttcgctcttgttgcccaggctggagtgcaatggcgcgatctcagctcactgcaacctctgcctcccaggtttaagcaattctcctgactcagcctctggagtagctgggattacaggagtgcaccaccacgaggctaattttgtatttttagcagggacggggtttcacaatgttgaccaggctggtcttgaactcctgacctcaagtgatctgcccaccttggcttcccaaagtgctgggattacaggcatgagctgctgcgtccagttgattataagacatcctaatttcaaaatgtgaaaatgtgaaaaagaatgcatcttagagttgatggaatacattaactgttcatttacaacatcttatctttgaactgttcattgatatagaaaatgatccttttgagattgacatttcaggcagagaaagtaaaagaaagctgtcgtgtctcttctttctgggagcctattgttaaaaaaagtttgctatatctgcaagctggaataaacaaaaagaattggagactgagttgacatgaaataataaaaaatatggaaaacagtgtcagacatttatatatttcattctgcttagcaagactttcacatccattatcttatttgatctaacttttttcacaatgaaaacagctctgtgtgtgtatattttatatatacatactcagaaaaataaaacagtgcagaaagtacactgagataaacaaccacaacattttaacaactgtatttttgtacagagatagtgcatataaatactatcatatgttcaatcaaaacaaaattggggctccttaccatcccttgttattttcaacaaacctttttttccctcccccttctaacccactcagccaatgttgctagcttggtgtgcaccttccatgcactggatcatgtcatcatgtaaaaccagctctacccctaaaaggattgggggtggtttgatggtcagtcttatttgatcttcccagtggcccaggggggagtgtagtgttatgaacccctttttgctgaggaggggacaggctccaagaggttgactgatttgtgtgacaccctatggctaagtggcacagggtcttggctgggagggctagtctttgagagttgtccttggcttttttgagatcaagttggtcacagatgcaacctagcagcctgagacagtcccagtttatgtgccttcctccagctttatcattaacaacactctcttctgcatcaaaagtgtcccgggctgaatgatacattatatgtttgctctagtggtggaacacttctccaccgggggccagctcttctaggaaggttgattccaggcaccactgactaagagatcactggacccacagtagacctggagcctgtgtctacacttggacttaacgatgatattggaagtgagctttggtatcgcagaaagagcagagaaaaggaagtcagaaatccctgtgtcaggtctcagggatgaaaggagaccacgtgtatgtgaaaatgctacacaaataatgaatctgtggtatggtcacatatatttaaatggatgaaactttatgaataagcacatactccatattcattgagtattcccttccccgagcttcacgtgccaccccctcagtgcacttttccacccactccaagcagaggcaacatggtacattatgaccccaagcttcagtttctccatttgtaaaatagtgcagaaattataatacttgtgtcttgcaagtgttgtgagaattaaatgagataattatgtaaaaagcattggcacgtatttctggtttcagtaaatgttccaattatctaggagtgtaaggggttgagagtgggttgttggctactgactaccctgtcccccatgcactgtttcaggaacactttttcctcatattgtactctgtgcactgaagtccagcacacacatacttgcttcagagacacatcttcccatcaccaaaatattaggggtttaaatttcataaagttgaaataaagtgcaagcccaatgctggtttgtagaccagtttgcaagtccagtgccttgtatgtagcagacagacaaatatttttggttgatttttcatcatttgcagtggaagtaaatgtttcagtccagtaaaatggcagaaatgtaaaaggtggaattccagaatgtcttaaaattaaaataggtagtccctttcctgttattactcacggagacagaaaaatcccattacaaaacaagctcagtttgactgcaggccagagtgttacccattgtccattgttcaccgtaagaatatggtttatctgcttctcagggtgatctacttataacactgggggcattctagtcccaggttttctgaaatcaaatctgctgtcctgttgtgctcatgggccaactaaatggctcagacatgatactatcttactgtccacacagcgtcttccaatcacctttcaaacctggacttagcatagaatccagtcttaggacagtcctggcttttgactttgagagcctggtcagtgcccaacagcaacccagaaaatgctcaattatattgatgtttctatttattttaagattttactaacacatgcatatgattaaaaaatgtaaactgtacagaaaggtctaaaatggaaaataaaggttacatttctcctaaaactccaggtcttctccccaaaagtaccaacaaaacaattatagcaaacatgccgttttaaaaaaattacacaaattcaataattccatatgtattccacatattgactactctttcaatgaaacagtatcttcaagctctttccatatcaggacatgcaagttcctttaatgactgcaaagtactcctttgcagagcattctgtattctaatcagtcccttaatgatgcttctgtttccctattacaaactttgctacagtgaacaaccttgcacatgtatcttttgcaggtgtatcttgaggtagtttcctaaaaaatacagttgctggctcaaagaggatgaggctttgatgtttttttttgttttttttttgttttttttttttttttgtggggggatggagtcttgctctgttgccaggctggagtgcagtggcccgatctcagctcactgcaacctccgcctcctgggttcaagcaattctcctgcctcagcctcccgagtagccgggactacaagctcatgccaccatgcccagctaaattttgtatttttagtagaaacagggtttcactatgttggctgggatggtcttgatctcttgagcttgtgatccgcccaccttggcctcccaaagttctggaattacaggtatgagccaccgcgcctggcccagactttgatttttatttagttaactatgtttatatattggtctgtgtgtctaaaatttcaataccgatttctaaattgctacctaaaaatactgtgcagtttactctttgtagaagtttgtaagagtattgatggtcacctcctccccactgccctgtacggggtgggggaccttgttgtatttacacaacacacttaattgtctcccttttctgggcatttgaaggcatttgaagatagtggttaccaagtatatgggtaactcctcctttctcccagatgcatcaaagaacagtgctccctgggacactaatgaagtgtttgcagaaccgctgccgcgtggggccaggcctaccctggggctgtctcctgggcaatgaaggtggactttcaggagagaataatccttcctgtgtatgctgactcacctttgctcttcctggtccccaccctggtaaacagacaccagtcagtgaggttccacctttgaaaaaatcagtcagggaatcacccatctgaggttcccagcctcaaggccgagttcttcctgtgtgtgagggactctggtgtttgggttccacctcttaaatgttagcaacaaaccaggctattatgtggataggggcgtaccctactttccagaacttgcacatgaatcaactgctttttaataaactacgtcatccttagaaacggaatgtggatctgagagtgtctgcactcaatctctatctaatggaaatttctccgtcataatttgtaggaagtgtcagggataagagtaacttttcattattgttattattacgttcatgtcgtagctggcacgcccgccactgccctcctccctttgtacagtgtgctgcgctcaccaggagctgctgtaaaatgcaataccttgctgagtatccacctgtttaaaatggtaccatttttagtgggggaagcaaaagggaattactcaaaaatgaagctcgcctgagagtcatgaagtagtagcccaataaacaatgcctttgccctctgaagagaatggctgccctcacactgatgaggaaccatctctgctgcccctctcccagcacacatggcagccaaacctgcccctgcctctcagcaggggtagaggaagaaatgaggggcaaaacgggtgcgaagggttagttgccccagagccctattgcatattctcacaattctagggcggtagtttgtgtcttagaacaactttcagcctctgctccctagagcgtaggatagtgcgtggtaacaatgccccaccacaccgcccatgtaactcctggcattcagcggctgtgtgcagaggctgtgtgcctctggacaagtcacactagtagcaaattctgttgtcccctacccagcaacagaaaatggtttttgtttcactgtggggaacttttcagcttccctggctgggctgagggtctgcacatccatgtttggtttccagctttgctgataaccatatcaccctctgctaaagcttcccagctttcattgatccaccttgtccttgacgatctgggcaggtcaggttctcccaaaggctctgagttgctcccacctccaggttctttactctctccctttgcctcatctgggtgggtttttaggggagtggggagaataaatgcatagtgaggagtggtcactaaagacagaagttaccattagaaaaccttgggcagtttacagttttttcagcagtaaaatagagatagtaatacatagtatggggggatggttgtgaaggttgaatgagttcacatatgtaactataattgcctggcagagggagggagagacggggaagggagacagggagggagggcggaagagagagagggagagggagagagagatacagaaactgatatgtgacctattggatataaaaaacgtatcaaatcaaaaataactttggtgttttagtctctaatgctaagaggaggtggtcatgaataaaaattgtatgtctttttaatgatacattgggttttggagacagtctgtcattccattgtcatgttaaacttaacgggtagaaatatccaataagtcagtcattcatgtatgagactgtgaagaaaccacgtttggatgcgtccatagtcatcgaatcttcggttcacatcttggcttttgctacttactagtcgggagatctcagtttcctcctatatggcatgggaatgttaacccctctctcctaggattgcttgcagtagtaagtagaacaccctccacaaatcaaataactaattcctttgcatattgtaaccactgtcaccttgttatatagacagcagactggaaaatgagtcctctttgagcattagagactggggctaggaatcttcagtatcgagtgatacttggaactatgagaatcaatgaactctaccgtgagtgcttttctgctaggaaataactaccatgagaaaaaggaggaaacagcctctgaggtggggcagtcaggaatgtgtctctgtgcagtgagacagagaaagaccaatgggtttgatactgagacaaacttgggttacgctaggaaggcagtttcttcggatcaatacaaacatacgcaccatgacacagagcttctctgtttcttgtcctttatagaagttgaataagtacttattaacagcccttgtgttttattcaactctgcttccatttttagatgtctatgggggttaaaaaccaaccaaccaatctgcaggttggttactctgggaccctagttttctgtgcagagtaaccgtgggtgcccagaaagctggaaaaggtggggaggtgaggagaggaggaatcactgggaattatctggctggaagtagaccatgggcattcaatggaaatctagtgagtcatgctgtggccagtgcttttttctctttctgctttgccacaagaggaagaaggagtggtgaggtctgaggtaattttgtagaattgatgctgtatgtggttctgagaatgccagatatagagagtttccttctgcaagacagcatgggtggcaggccttccagaatccctttccagagcaggagcccatgacactgtacacttttcctgtggtagctccttcttggctgattttaaaagatggcttttcccagagcttcttagaacttgctcttagcaaaggatctgtgtttcccatcgaaaaaaaagtaaaccatttaataaatttttaaaataaaatttggaatggcttccatcttgtttcttgtcatcttctcctctcaaaaagcctccttttcccttttttcatcctagttttgatgtctgagcagttggcctttctagatacccttatttagaatttttctcttcttcattcgaagtcccccgagcagtgagcagggagggggcaggggcgagtctcacccagtgcagtgcccactgcacttacccactggcgacactcccagtagaatgcaagcatttgaaggtaagggaggatcttccaatattgtcatgtaatatttgccattacttcatatttattagcttttttgctgataagtgtagattataatgaatgtccttcctcctctggtctcctccggcatagattataatgaatgtccttcctcctctggtctcctccggcaaattctaaatatcttagacctacttcaaatggctccttttctgggaagtcatttcttctgcctctcccaggacaaagtggcctaacctccactcctggaacacccattttgtgtgtgtttatgttgactgttattgacgcatgaatcactttattccatcattatctaggtgtccttcaagggactttgaactgcccaagtgctcagctccccaagtgctcatgagtcactttgttccatcattatctaggtgtcttcataggactttaagctccccaagtgtgccataagaacttgtcacgtagctgaacacatgggggaccccactacagaaatgccaaatgaaaggaagccctgcagcccacagagtgttcagaggccgcccctggtgtgaagctgaaaaatcccagacgtagatgagggccacagcttcatctacccaagggggccatgcggggatgaggccttcccctcctgggcatgttccgtgatctcgtttcgtctgtcctgtccacatcctcgttattggagcagtgatcagtcataaaaatgtagcctatcttttgaatatggaaagccagtattacacgtatgacagtgataagtttatgaagggaaagtaatttagatgacttgagaaattatgaccgtgtgacatagcctttgtgtgatacatattctttccatttctggattctgtcatgtagtttgcaaaacgagactagaaagtttctatgtcgttgcttattttcaccgacaaattcaacacaacagtatggttgaaggatagtctcatccgagactgtcgaccgtgtgttgtgctgtattcctgacactgtttagcacttcacacatattattttatttaatccttacagcagcgttgtgaaatgggtctgtctcccattttacaaatgagaaaagagaagtcactttgtgtcacttcagggacacatgagcttaggtagcttttccccacttaacttagtctgtaggtagcaaagctggaacttgaatcctcatcttattgattgcagaatctttctctgcactgctctttctgctacattttattttaagaatatttgggaaattaacagcattttgtctttgttactacaggggaaaacaaactatcctagtaattgtatgttttatgttcccagggaagcaaaggtgtctaccagtaccactggcaaagccacaatgtcaagcacagtggtgtggacgacatggtgctactgtccaagatcacagagaactccatcgtggagaatctgaagaagagatacatggatgactacatttttgtatcctttattggctgctttggacatttctaagtgatattacagtgtccacagttaaattgtggctttatgctgggtgcagtggctcacgtgtgtaatcccagcactttggaaggctaaggcaggagttccagaccatcctggcaacacagggagaccccatctctattataaaaaataaaaataaaaactgaacttgtggctttattcctggcttgagaagagctatctgaaagtccgaacagatgctgtgtgctcacattgttttcaccgtttcagaatgaggttttgtatgtttatatcacttggttcaggctgtgcaaagggcaaagatgatgcccggttattctcctggcatttcacaaagtaaagatgcagccagtattcatctactttaatctataatatcgtccctttgacatgctctagtcatgcacgtggtatctgaaacctctgctcttcctagaggaagtcctggtttgcaaagagttctatcaataatgcatcctgactgcaaagcagagacatttgagtctgcacttaaaagacttaaaaatgttgccagtttttctgcattttaatgtttactaaaggaaatgtgagaagtgaagatggactattgaaaatgcttgacgttcttcagttgttctttatgtttcaattttagcttgccggatgccattttttatggggctttaaaaaatgcagaatggaaatttgattcaaatatgggttgacttcattatcaacagggaactgtgatatttgcttaagttctataggaattttgtttgatgcaactatgtaaagatatcctggtggaactattgtgagagttagtcatggacatgcaaaactctgtgtcaaatctatataatagtaccaaaaagtttaactttgatgccaatagtgccttctgaaagtatggtatcatggatgacttattaaaaagtggagtctttgcttctgatgtaatatacatcttagatttttacccaaaaagcttggggaagaatagttttcacatcagtggcttattatgattacttaaactggttttttgactattagctaaaagcacgggaacctttgcagtaataacttttgcagcggctgcctatcccatcactggtaagtcgtggggggtcgggttcaacttatcaggtatttaacaaacaatactgttaaataattaacagcattattccaaggcatttggaccattctgaccagtactctgctgtttcttatttactataagggaattttaccaatatctgtagttaaacctctgaacctctgttttcaaggattaacagatatagttggatttattggctacattataattgcatcatttaaaacatttattttctttttatagcactttgggaggcagaggcgggtggatcacttgaggtcaggagtttgagaccaggctggccaacatggtgaaaccctacctctactaaaaatgcaaaattagcggggtatggtggcatatgccttgtaatcccagttacaaggcataacttgtaacttgggaggttgaggcaggagaattgcttaagtttgggaggcagagattgcagcaagccaaaatcgcaccactgcacttcagcctgggtgacagagcaagactctgtctccaaaaaaaaaaagtgaatttattgtatttttaaatgacaaatagtaattgtatatagttgtgggatataatgtgatttttttttcttttttcttttctttttttttttttttttaagacagggtctccctctgtcacccaggctggagtgcagtggcacgatcccagctcactgcaacctccgcctccccggctcaggtgatcttcccacctcagcctcccaagtagctggactacaggcagacaccacgatgcctggctgattttttgtagaggtagggtttcaccatgttgcccaggctggtctcaaactcttgagctcaagcaacccacctgcctcggccttccaaagtgctaggactacacgtatgagccactgcgcctggcaatgtgatgttttaatatgtatatacattttggaataataaaatcaagctaattaacatatccatcacttcacatacttattgtgtgtggtgtaaacatttaaaatctatactccacaattttgaaatatacattacgttattatttacttatataacttctggatcagggtggtgacctatggctgacagacaaaatcttacttaccaccattttttggacagcagttttgttggaacacagccatgctcatttgtttagttattgtttagggttgttttcacactatggtggcagagctaagtagttgtaacagactctctgcaaagtctcaaatatttactttctggccctttgcagaaaaaaatttgctgacttctgctccagatacctgtgcagggcttccttttttttttttgagatggagtcttgctctctcgccaggctgaagtgcagttggcgaaatcttggctcactgcaaccttcgcctcccagattcactccttcctcagcctcccgagtagctgggactacaggcgtgcaccaccacgcccagctaatttttgtatttttagtagaggtggggtttcattcaccatgttggccgggatggtctcaatctcttcacctcatgatctgtccacctcagcctcccaaagtgctgggattacaggcgtgagccactgcgcccagcagcttcatttaattgaattgtacaaaaacagttatgttcagttgcaggtttttattttatttggtcaaaatactgaaatatgcttactttatccggacttaacaccgtcaaaaaatgttaatcacttttacgtgcagcacccacagcacatgaaaactggcagttaattgattagaaggagctgggtggcaggatgtggatctggactgtctggcttcaaaccttgctctgcatagatttggtgaccgaaacgttttgtgacctctgtgccttgctttccgtacctgtaaaatgggagtaataataaaatctcccacataaggctgttgtagggtgaaaccaaataaagaatgcagcaagtaaacagtaagtatgagtcattattaccatgcaggtgtgtaagtgcttcccatatttccgagttattttccaaaaattccactgtaaacttgtttattggaaattaaaatgcattttgccacagaaaccgttataaatggagtattgacaagcccatagaagtcttcatttccgctgaatgtagtagttgtacaaattatattttgaaatgttcttggaatgtgggctggacttactgcattataaagatggaaatacggttttttggtaagctgagtataaaaacaaacaaatgatgtccgtagtcagtccttcataactccaggcggcctcactcctcccaatcacgattgtttactcccaaaacaccagaagcagggactatgtcttatatatcttcttcaaaaagcagcatataaaaaccctttagagcaatgtaggttcatttaacatggctcataccatgcagtgaagcaaaaaaaaaaaaaaaaaaaaaaaaaaaataccaaagtcacccagaacccatcaccaaaggttagttcttattaatctcttggtgtagagctttcagtttaaccacatatggccatgcatatatgtgtgctttcttgttaattttaacaaaaatggcatcatcctgcctcatgtatttcttggttttctgcataatttttggcatggtgcattgtattaagtattcattgacaatttgttgactgttaagacttgctttttaaattcagacaacagaatttttaaatgactcacacagagagggctgtttatgcgcctttgaattaatgcctttgaatcgatgactgactaatcgtgtgttctaccaaggaaatgagttacttgaccactaatgactttatgttttagaaatctctacccactgaatatatgggaagcccagcataaatgtgctttctatcattagcacagagtagctttcagctttgagggagcttgatggatgtttgtgaaataatacaggggctctgctgcaagtcttcctctgctaagtggtaaaagcatcctttaacacttcaatgttaagggaatattataatagaatggcattactgtaagtaagagttgggttttttcctctcctatgtttaattgttaagacgagaagagacttgatttcacattgagttataaaattgctcactttatcccttctatatctaattcctgcacattgtcttgtgttgaaagtcagcatttggggcgatcgattgttaatgcattcaggctgaatgcacatttcttctacattaggaaaaaaaaatccacttagaaaatgctgacatcgtttaccaataaaactccctatttttgagttatttgtcctatgacaaggtttaatttgccatctgtttgtcatcaatgttgccacactttttacaattacattgtaagatctatgaggaaaacattacagtgttgtctattgtgcatagggagagagcacttctgaccacttggccgacgaaaagagttcctgcgcaaagcactctgtgctcattcggtccaactttctccaaacttgtttttactcaaagaccacactcaggtgtgtttggcatttttaatccttgaattaggagtccagattttcgtgccagacccactagatttcaaagcagcgtagttgttccgagtgaggtctggcccttggcatccagttcactggaggggcagcatgctatatagcaagacagatgccgggctggagccaaagcttcgagttccaggccacccactctccacgtgactctggggaagtcaactcacctccctgtgccacctcagggatgaacccaaggaagtccactcgaccagcgtaggtggttttgggaaattcactgactattcaaatagattttaaccggctgggcacagtggctcatgcctgtaatcccagcactttgggaggctgaggcaagtggatcatgaggtcaggagattgagaccatcttggccaacatggtgaaaccccgtctctactataaatacaaaaattagccgggcgtagtggcgcatgcctgtagtcccggctactcgggaggctgaggcaggagaattgcttgaacccgggaggcggaggttgcagtgagccgagattgcaccactgcactccggcctggtgacagagcaagactccacctcaaaaaaaaaaaaaaaaaaaaaaaagattttaaaagttcaactcttagcattgcctaataagactattaaaaacaaacatttgaggctgggcacggtggctcacgcctgtaatcctagcactttgggaggccaaggcgggcggatcacaaggtcaggagatcgagatcatcctggctaacaaggtgaaactccgtctctactaaaaatgtaaaaaattagccgggcgtggtggcgggtgcctgtagtcccagctactccgcaggctgaggcaggagaatggtgtgaacctgggaggcggagcttgcaatgagccaagatcacaccactgcactccatccgggtgacagactgagactccgtctcaaaaaaaaaaaaaaaaagaacagcaaaacaaaaaacaaaatttgaaagttgtactgccatcacatttcataaaagaaaatatttttacaccaaaaacgtaggaaggacataatctaagaataaaggacagtttctttattttgaataaattaagctttatgaaaaattcagtgcattgtttgtttttttgtcattcttgctgcaggtcaatgaaaactgatagatccacgggcaggcatttgggaacccatcagttaaagatatcttgggtttcttctgtctcccagagtcttttaaataattggcatttttttccttctgttttttggtatcatagcttcatatctttatgcagtttgaaaattaaccttaggccacaccttcaccaccaaggattatgtgggtaaagacaatgatccgaacggcttttcccagaggcacacctgaattatgcaacaggagtgggagtgagcattgttggaattacctggagttcccaaagcagcaggagagcacaggtgtccggaaaatagctaaggtctctgcagacatagcaaggtggaaaaggtgagaattgtttagataaacaattattccaaactctcaccggaaataactacgatatgtttattttctttaaatcaattaaattctccttagtttttctgtagaaacagccattttattttttgagacttttttttaaattttttattttattttatttgctctgtcacctaagctggagagcaatggtgtgatcacagttcgctgcagccttgccttcccaggcctaagtgatcctcccacctcagcctcccaagtagctgggactacatgtgaagaccaccatgcctggcaattttttttttttttttttttttttttaaggagatggggtctcagtatattgcccaggctggtctcgaactcctggactcaagcaatcatcccacttgtcctcccacagtgttgtgattatagcacccaaccagaaacagccattttaaaccaaactttattttttaggtgtcttcccaaatagtattatccccaagaaccctactgataaatttagggagcaggtacaaatttccctcttcatttcattctgacctgagtcattgattcacgattggcctagaatagtccaaaataaatttttgtttttgttttttttcctgaatatctccttaaccaggccctaatcagaatttatgtaatctacttggtgaaaaatcaagacttaatgagatatctctttatatagcaaattaacagtttttaaaatgttggtcactttaggagctcatatgcaactgaattcatatttattgagtaaccaagggattggtggggagttggtacctttgtctgttgtcctgagggcagccctttattctttgtgtgcagtgatcaatttgtctaggacaaggcggcagtaaccacattccctttacaactaagggaacaagtaccctcctccatggaaggagcttatttgcctgtttgtttttccctggggatagatgtagacatgaaataaacatcttcctcttctgaagtgaagatggttctagcagtgctgtgtttctttaaaattgggtttaccataagaatcattattacttcattcattaattgtttgtttgttttcttttttgggagccagggtctggctctgttgcccaggctggagtgcagtggcatgatcatggctcactgcaacctcgacctgcgtggcttaagcaatcctcccacctcagcaggaactacaggcacgtaccaaccaacatgcttggctaattttaaaaaaattttttgtagagatgaggtctcactagattgcccaggctggtttcgaactcctgagctcaaggggtccacccaccttattctcccgaagtgctaggactacaggcttgagccaccacaacctgctcgttcattcaattttgattaggtccttaccaattagaaaagatactttaaaaatccacctaagggaattaggttttcgagtatgcaaagcatcagagaatctaagttagaagaggctgccaatttagggttgccagataaaattcaggactgctggttaagtttgaatttcagataaacaacaagttactttttactataagtatgtaccaaatattactggggaacatacttatttggaacatacttaaaaaaattcttgtttgaatgactttccaatttaactagttttctgtgtttttatttgctaaatctggctaccagtaataatattaacgcaacagtacctgcttatcttagacattctagcttttgattaagagtatgggcgtgggatccagactgcctgagtttgaatcctagctctgcaacttatagtgtgtgaccttaagcaacttttaaaaatttctccgtgcctcagtttccctgtacaggctgagtatccttaatctgaaaattccaaatttgaaatgctgcaaagtttgaaatgttttgataatcgacacgatgctcttcagagcatttcgattttggatttttgggttagggatgctgaactggtggtgagtgtaatgcaaacgttccaaaatatgaaaaaaagcacaatctgcaaaaagcattttggataagggacagtcaacctgaagtcaaataggttgttatttggtgctaagatgtaaatgtatatgtgtttaattaattttatgacgccttattgagtcttggctacggcatcatggacgtcttacctgcttgataattttaacagtacatgtatgtgtcctaaattttcactaatctatcattggcctcatctgactttggcaattgggaatacattttccatggcccttcttccataactcttcagtaattttcagttatggctcaatcactgtctcatcagcattttctcttagcactatggcctgcccttagaccagaactgggcactgctgaagtggtcttaaaaccacttcatcttccctaatagcaattcatgttccaccccttcaagtatgaagatctttctggtcagtgacaaagagaagtaaaagcataatcatgtcattctgcatgcttacctttgtatatgcacaataatctaaaatattatctttaaaaaaattatatgattatatgatccatctcacattgatttgtattaagtagtaataacactgtgtctaatagaaactaacaaaccattgcctctaaaacagcacctggcatgttaagccacacttgaaacatgcatcatgatttgagatattacatgataaaacatgtgccttagaggatattaattaaggaaaagccattactatgtgctgtgctcacagtgctgagtgttctataattattttatttaagtaaaatgagactatcaggtaggtcctattttatctccatcagcaccagccaatctgactgaacacctgggctggttttcatggtacacaggtcttaatatgtaaatataaaaatgttctcctgtgggaggaaatctcatagttttaagtctttatctaaaactatatatttgtaaataactttctgtttaacaatttatttgtaaaatttctaaacaccttgaaattgatcattgaaagaaacagttttgaatgtctctgtgtgttgtttagattttttttctccatgaagtcaagaagttatatttattctctccatgaagtcaagaagttatatatattctatttattttgttcactgtcatatcccgagcatctaaaacagtgcctggcatgttaagtaagcacccaattcaaattagttgattgttgaatgaataattggaaatatttttcatgtgatcataagtcttcatttattttcgtatattaaaatgtgtaaaatttttaaggcccagcataagcatagcctctctgagaggccatcttgtattccccaagcagaaataataccttctttccctaaacctgatgtaggtgggtttataattttcttctctgaaaactaccttatttatgattattactgttattttgagacaaggtctctttctgtcacccaggctggaatgcggtgacgtgatcttggcttgctgtaacctctgatctgggctcactgcaacctccgactcctggcctcaagcaatcctcccgcctcagcctccccagtagctgggactgcaggcacacgcccccatgcctggctaatgtttttgtttttgtttttgtttttttagagatggagttttgctatgttgcccaggccggcctcaaactcctggcctaaagcgatccacccccttggccttctaacatgctgggagtacagacaggcatgagccactgcacctggccagaaaattacctcattgatgccttttaattcctctaagcttctggagaacagagctgttagttcatcttgtatccctgtatttgttaaataagtagatgaatatttttttttatttttttttttggagacaagagtctcactatgttgcccaggctggagtgcagtgacatgatcttggctcactgcaacctccgcctcatgggttcagacgattctcctgcctcagcctcctgagtacagtagcagggactacaggcgtgtgccaccacagctggctaatttttgtatttttagtagagacggagtttcaccatgtcggccaggctagtctcgagctcctgacctcaaatgatctccccacctcagcctcccaaagtgctgggattacaggcatgagccatcacgcccggctgatgaatatgtttttagtgtacctaacggatacgaaagttcaaaggaaaaaatgcatatcatttgaggggaggactgataactgcttttttcactctttggccatttttcctttgttttcttttctccttgctgtacgtgtcacccatcttgaaagaatgtgctttagttcatttaaaataatgatttcattttgtagcaccttggtaatttattactcttccttaggaggaataaagcctgtgctagttggatgattgctttcgtctttacttgtaatcttttagaaaacaagtacacaaactttccacttggacagtcattgtgaattcttgataacatctggttacttaatttgaaaaatgtgtagctatgaatattaatgatggaccttaactgagttaaattcagacatatataggatctgtattaatctcagtcaaccctttcaagcagatgccatattttggggaaaaggaaattgaaatgtaccaaggagcggtaagttacgtgtcacataaattactgccttatttagggcttttatgatgcagacatggtttttcttgaagttagcagtacttttgcacttttctattatgaattttttattggagaaacttgagtgacattgtttgatttttaatgatctgctttttatttttattttttaatttttattattttatttttattttattattattattttttttgagacagaattttgctcttgttgcccaggctgggcatgatctccgctcactgcaacctccgccttccgggttcaaacaattctcctgcctcagcctcccaagtagctgagattacaggcatgcaccaccacacctggctaattttgtatttttagtagagacggtatttcaccatgttggtcaggctagtcttgaacgcctgacctcaggtgatccacctgcctcagcctcccaaagtgctggtgagccaccacgcctggccaatgatctgctttttagagcagagctcaaaaaagcttaggactgtctaatatttgagccttatttgcatagaaaattagttaaataggatgtaggacctacagcttagggatcttcctgcttccatatatgccacaaaaatctaaggaataaaaatcagttatgggtaaaaaaatagagcaatgggtactgatttgcagaatcagaaccattgttaaactatgactatgacttcaacatgaaaaatgaatcttgtattacttcatttattaatttgaccctggttcctattcataatcagctccatagccatttcagttgtatagtaaaaatggaagctgtaattctccttaatatattttattctgtggttcatcacttccccaggcctccccatctctgcatctttttcctttccttttccttcccactgcagcagaagcacaagagtattcattaatcctgacccctaaaaagcaaacaaaagagagcccacacaaattcatcagttgaagtggaaggcaatttacccagagcaagagcccaccccattgttgccagatgaatggtgctggtagctggagccgaaggaggctgccacgcgaaagacctttgataatgctgcctttatgggagcccagcacaagggaaacactgtcagcagaggctggccctgccctagtgccctgatcagcaggcgcacagagctggcttggcgtcctcaatgacagccaaggcgctgtagatggtagtgctgtgcatgtgtgtttctctccagttttctgaaaagggttgctgtatacacatcccttttagaccatttatcttttgaagtgttctctttaaggaaatgtagaatttctaaaaaatatgctcaattttactgctaatagtaacagattattgtaaaactggtatttactgagtgccatgtactatgttatacttgcagcaataataaaacagccctggatgctggctgtgtcataacatctatctccatttcacagatgaggaaactgaggctcagagagatgaagtactaaaatctactgagtgatggagctaggagttgaagtcaggtcctaatgactttgagagtctcaggggagggaagaatcaggtaaaggaaatgcccactctatagttttgtcacagatagctgagaggttcagtaagaccacagataggaaacgagtttggaaaatatagagtgacatgcaaaggtcaagtatgacagttcagcagcgttgaagccttactgggcaatgactttcccccactgcccatagcttgcttttcactccatttccttccattttccatcttcgtgtctttcttacagtcctctactttctcattttcaaagagtcattaatgttgtttgtgcacttgagaccagaaacccaaaatgagggtaactgagaggggtgctaagggctaagttttggtgacactctcacctaagtgagaacctgacctaaagaggggaatttttaaacaaaattatgagagtccgttgttttggactgatctcatgcagtagcccctaacagaccagaccaaaccaaaccaacatggaatcactcatgttacatgtgacataatcgaaactttaaagaaacagaccaggagatgccagcaggaggaggtccgctctactctaacccttacaaaaagtaacctagagtctttgttccaatcttacaaaccctactgttctgttatttctcaatgatatttgagaacaagtaagtacatttttacaatggtgacagagtgacatcagtgcctaaagttttggtcagtgtctcaaaattgagaggacgaccaaaagagggaaattggactgggcatggtggctcatgcctataatcccagcacattgggaagccaaggtgggaggatcactggagcccaggagttcaagaccagcctgggcaacatggtgagaccctgtctctatttaaaaacaaaaacaaaaaaaaacaagagaggggaattgttaaattaagtttagcctaaagctgcctccttacatattttaagttggatctaaatgttttcttcttttttttttttcttttgaaacaaagtctcactctgtcacccatgctgaagcgcagtgctgtgatcttggctcacaggaacctccacctccaggactcaagcgatcccccgaccgcagcttcccaagcaaatagctgggactacaggcacacaccaccatgtccagctaattttgtttcttttttgtagagaggaggtctcactatgttgcccaggttgatctggaactgctgggttcaagtgatcctctggccttgcctcagaaagtgctgggattacaggcattagccatcacacccagcgctaaatgtttctctgtgcacagtgaactgtagcctaagcagatgtataaacaaactataacctacttttctgccagtcactgagttttggccaatcaaaggtggccaactattcaaactgtgttcaaataaggcaaattctaaactaatctgtaactaatctggctgtttctgtacctcacttccattttctagatatatatttttttgtttgtttgttttgttttgagacggagtctcgctcttcaccagactggagtgcaatactgcaatctcagctcactgcaacctccacctcctggattcaagcaattctcctgcctcagcctcctgagtagctgggattacaggcatctgccaacacgcctggctaatttttgtgtttttagtagatactgggttttgccacgttggccagactggtctcggactcctgacctcaagtgatcctcccacctcagcctcccaaagtgctgagattacaggcctgagccagggccagccctcacttccattttctgtatatcactttcctttttctgcccaaaaatcttatggcatatggcagcactggaggctctgtgaatctattcttgttccagggcggccttattcacgaagcattctttgctcagttaaactctgttaaattaaaataataattataataatcctgcacaatcttattgtggactagaagtccatttaaaaccatatcctgaggtcctatccaggtatccactcctgaccataaggttaaggcagagatcacatattctggttcctgcatagggttctttaggtgaccagtcctaggcatagcttgcagccctcactgggtagctccccctatgagccccctgcctacagcatgggaagaacactgggtatcggatacaaagccccctcatcctaacccctccccaccaaactctcatcttccagagcacggcagtgagcagcaacttctcagccaggcccccttttctacagtaagtcactgcacaataaaatggattaagtaaattaatccaaagatggattaagtaagttaagcttcacctttgtatatcactctgtcttttcaaattgctttcccatccgtcatttacactgtgagacttgcagcttggacgctattattcccacaattgtagctcactgcgtcctccaactcctggactcaagctgtcctcccacctcagcctcccaagtagctaggactgcaggcatgtgctaccacacccagctaattaaatttgtgtgtgtgtgtggagactagactccaagtcctagggttaaacaactcttctgcctcagcctaccaagtagcttggagtgattacaggctaggagtgttctttctccatatatactcaacaaagtatttctctttttagtaatttttgaggttgtggtaaaggtaggtgtcaagaaattgtataaagcagggctgaagtcagcctgataatttattaagcatggaaaatgtatttagtttgatatttgtgcatagctaagatatcccataagatgaaatcacaaacccaggagaatatcttagcgtggtaggatttttttttccaatagagatgaaacaaactggccaaactagcttatccctttaaagaaccacaccttcttgccctcttcttatggaaagatttaagtattttttctgatccatagataatctcacctaattccctctgaggccccagaatctacaacgtggcctcttagaaaaaattacgtaagagtttagaattctggtagaagtcagatctaggtgtttggcaggcctctccaaagacctgttgcccaagtgtctacagaaacatttagaaatggactgtcacctgcagaggcgtgtatgggtggaagggtggggtgttggagtgtctaaagacacggggcacatccggaaggctgaatcatggatatgcctatgggagactgcttccaaattccgtcttaattttgtgagggtgtaaccttgatgacctaggaagttttatgaattcttgtatcatgcaacctttaagatgtaatgataggcattggaactatagtgcacgattcgtttccaaattcaggaaaagaaattgagtgtattgcctatctgaccatgattttgtttttatttttaaatttttattattatttatgtattattattttttgcttttctaggcacagtatgaaaacccaccacatatctatgcccttgcagataatatgtacagaaacatgatcattgacagagagaaccagtgcgtcattatcaggtatgaaaaagatccttatcagtgggcgtggaagatatgagactatgctgtggttatggatttcggtcgataagcagtggttttgcaacagctactgatgtcacagcctggttaatgtgtctgagtagcaagcaggttagctgctttatcttgctttatttataactctatataatagagctccatatcataaaacttttgagcttccatgggattgcagtaagtataataaacatgttttcactgtttagtcaggtgaattccttttctgtaggtccctattttttcattcccttcataatttagtagttcatgtttgaacatttttggtgaactttgtcatttgcattgaatttgggggaagattactggtaattgccagcattaggtgtctgtagccacatttcataatccctctagtctgacatggctctgaatcctggctgggtttaagtcaagcttgtccaacctgtgggctgcaggccatgggccacatgcggcctaggacagctttcagtgtggcccaaagcaaattcgtaaactttcttaaaacattatgagatttttttgcaattttttttaagctcttcagctatcgtttgtgttagtgtattttatgtgtggcccaagacaattcttcttcttccagtgtggcccagggaagccaaaagattggatactcctgccttaagtgcttttaaaattctgcttatttacaaaaattagctgggcatggtggcgcacgcctctaatcccagatactagggagactgaggtgggagaatcgcttgagcctgggatgaggaggttgcagtgagctgagatcgtgccactgtactccagcctgagtgacagagtgagactccatcttgaaaaaaaataataaaataaaattctgcttactaactccagttggggtggctcacacctgtaagccgcagagtttgagaccagcctgggcaacatggcgaaaccccatctctacaaaaaaatataaaaattagccaggcgtctggtgtcatttgtctgtagtcccagctactgaggaggctgagtggggaggatcacttgagccagggaagtcaaggctgcattgagctgagattgtgccattgcattccagcctgggtaacagagcaagaccctgtctcaaaaaaaccaaaccaaaccaaaccaaaaaaaaaggcttataccttagtggaggctgagacaggcagatcacttgaagtcaggagttcaagaccagccttggcaacatggggaaaccctgtctctactaaaaatacaaaaattagccaggtgtggtggtacatgcctgtagtcccagatactcaggaggctgaggcaggagaatcacttgaacccaggaggcggaagctgcagtgagccaagatcacgccactgcagtccagcctgggcgacagactgagactccatatcaagaaaaaaaaaagctctgcttactattgtgaatattttcaaacactagaaagtataagcatccatattctcatcacctagaatttgacagttcacaatcttatcatacgtatttgtgttcatcttttttagttaatttttctgagacatttttgggaaaaaaaaaaccttttattgtggataattacaaatatacacaaaatgagaaagaatagtagaatgtgtccctgtatatctattatccattttgcactgttgtcagtatatggccaattctgttttatttggtcctcccattctgtcccacttgattacttaaagcaaatctggcagggcatggcagtagattcatttccaaggtcaagaaaagagtatatgtaatactagcactttgggaagccagggggcaggaggatcacttgaggccaggaattggagatcagcccggacaacatagcaaaccctgtctccataaaaaagtttttttaattagctgggtgtggtggtgcacacctgtagccctagctactagggaggctgaggcagggagatcgcttgagctcaggagtttgagattacagtgagctgtgcttgaaccactgcactctagccaggcgacagagatggtgttttgttttgttttgtttttttaataaagcaaacccaaagatcccctttattcctcaataattagtatgtgcctctaagaaatcattcttatcacaccttaaacatgaagaattcttttatagtatctaatatcagtattccaattccatgattttcctataaattcttttttatagttggtttatttttatttaggatccaaacaaggcctacacaccgcacctggttgctgtgtctcttaggtgtctcggtctttaacaattttcccttcccctttttgttttcttggctttgttaaaaaaaaaaaaaaaaaggttgtttgtcctgtagatcttactatacagtctggcattgcctaattgtatcctatgatgttgcttaagtattccattgtcccctacattttctgtaaattaatagttatatctaaaaacttcattagacgccgggagtggtggttcacacctgtgatcccagcactcttgggtgggcagattacgaggtcaggagatcaagaccatcctggccaacatggtgaaaccccatctctactaaaatacaaaaaattagccaggcatggtggcgcatgcctgtagtcccagctacttgggaggctgaggcagggaaatcgcttgaacccaggaagcagagttttcagtgagctgagattgcgccactgcactcaagcctggcgacagagtgagactctgtctcaaaaaaaaaaaaaaaaaaaactcgatcagactcagattccgtttttggcaaaggaaacttcatcagtgatgctgtgcacttcatgcctgttgctctctcttcgtgtgtccagattgtcagtgaacccggctgttataaatcatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacagtctcttcaggggccttggttcttttctttttcctttgcttttccttttcttttgagaccaagtctcattctgtcatccaggctggtagtgcagtggtgtgatctcagctcaccgcaacctccgcctcctgggttcaagcgattctcctgcctcagcctcctgagtggctggggttaaggcatgcaccaccatgcctggctaattctttcgctttttttttttttttgagacagagtctcactctgtcgcccaggctggagtgcagtggcacgatcttggctcattgcaacctccgcctcctgggttcaagcagttctcctgcctcagcctcccgagtagctgggattacaggcacacgccaccacatctggctaatttttgtattttcagtagagacggggtttccccatgttggccaggctggtctcaaactcctgacctcaggtaatccgcctgtcttagcctcccaaattgctaggattacaggcatgagccactgcacccagcctcttttgcatttttagtagacagggtttcaccatgttagccaggctggtcttgaactcctgacctcaagttatctgcctacctcagcttccgaaagtgctgggattacaggcacgaggcaccgcaccccgctaggccttggttcattttaatgggaaatggcattaagagaccactaaactagacaccaagagtgctcactgccctgtgttttcagtgcctatagttctttaaaagtacaaagctagggaatatgagctttttaagagaaaaatgaagttgaaaaattaattgttttcaattaatttttaagatttcagagtttttatttctttgattttaatttttgtatcccatttatcttatgctgaacaatcttagttcctgattacattagcaattatttgcattgcattgtatgcgttttagacagatagaataagtttgttaatgctgttaaagtaacaataccagtattattagtagcaatactgaattcattttaaaatttcttttctggtttttgtccaaatatccaatatttgcagtcaaaatactgggtttcataaaagtcacttaaaataatccttttctatgtcaacctgacctacagttgggttcatttatttcatttacaatttcagttgttttgcatttttaaatgtaattttgtttttataattatgcaaaacatttacatggttcccaagtcagtactgcaaaacatgagcactgaagcatttcaaggtaaatacatatctgaagtatttggaggtaaatatagacttcatgacattttacccctaaatatttccacatgcatctctgagaaattgaaacattttcttactgatccgaagaccattatcataactcagtaattaatagtacattttcaacatcatctaaaaacttcaaacttctctaatagtcgcaaacgtccttttctgctggtttatgcaaatcaagtaacgctgactgcatttggttatgaatcataaatttatttttatcctaccacaattgccctattactgctgttttttttcatgacactgactttttgaagagaccaaaactagttttcctacagacatcatttacatttgtctaattgcttcttcctggtctcactatacttattccttcagttggattttctacaagtttaaggttatatctaatgacttgatcagatgcaggtgcaagttaaattttatgaggaggaacacctgggtcatgttgaatttggttgcttaataggaaatgcttctgtttgatactaagcggaggtcaccgactactagagaggcaggaggtattttcctagctggaatttaatgagggtccaggatgagttttctgatagagtcctctgccctttctctttcctcacattttccctcttctgggtgtgtgccaaaacgagtgggatgggaatggtcttcttacatgagcttgccagtctggaggccccctcagtcttctgcagcccacgtgtctccctccacctgcactgcaaggtccacctgcactgaagcgggatgatgcccacttcagatccttgtttccagctgttcaggtggcagagatttcaaggacctgctcccaaggatttctgttgcagtggctgtgttttcatttaggagatgtgctttaatttaggagctacctggagttgggccaaactccaggttaagggcacaggcctcctcggtagactgcccaccctgcagacatcagctgcatgttcagggctccccaggccaccctcatcaattcaggggttcccactaccccccgcccccgccaggttcagtagttcactagaacaactcacaaaactcagaaaagccctacacttaggattacagtttcgttctggcaaaaggaggatacaaattagagccaaacaaaagaggttgagggcgaggtctgggagggtcccgaggtggagtttctggttttcctctccctgtggagtcatggacagcgctacctcctaccggtatgaggtgtgacaatactcacagtattgccgaccagaaaacatcacctgagcctctgatgtttggcctcgatcacgcaccgcctgcctggcccaccttcagtttccagctgctctcgaaggcttgtgcaaatgcctttagtttccagttggaggtcagaattgcgatggtatgtcccaaagcccccgacataaatcatatcgtcagactctcctatggtcaaagcccccaagaaaggaaaagcactcctcttaggtaggacattccaggggcatagacatcaccgcccagtcaccgagggcaaaagcctgagcccttgagttaattctcttctgcaccagggctgtggtttgtctgctttgagaaagcaaattggaaacctctggcatgccgtggttcatgctcacctgaccctgggcagcacgcctcacacctgtctgggccttggctttttcacctgtgaaggaactggttttggaactcttccttccaaataatgttggagaggaggaaaggcagggaaatcctgttctgggtggaaaggccaagtttgtagcccctgacactggatggggcaagtgctccatctgttannnnnnnnnnnnnnnnnnnnaacgaaaaaaccattttcttggaggctggaagagaagcctgctcctcatgctaagggattctggcatggctggaaagactaggaatctttagtgtcatttaattaggaaataaaaagtgagcgatgacctaatttctatggtggtgttttagacttccacctcccagtttccctggtgtgactttgtctaaatgacactttagatggcataatgcagcccataaaggcggcgtttctagtttcctgtcagtcttactcatattttccaacgcagtggatacggtgacaggatggacaggcacctgaccatttcaagactagaaatgagtgtaacaaatcggatttttttttttttttttgagacagagtcttgctctgtcaccaggctggagtgcaatggcgtgatctcagctcactgcaacctctgcctcccaggtccaagtgattttcttgcctcagccttctgagtagctgggactacaggcacctgccaccacacccagctaattttttttgtatttttagtagagactgggtttcaccatgttggccagggtggtcttgatctcttgatctcgtgatccacccgcctcagcctcccaaagtgctgggattacaggcgtgagccaccgcgcctggccacaaagtggattttgaaagaaataaatcaaggaaggagacgtgctgctttctcaagcacagggctccatggacgcctaggtccatctacaaacttgatttgtcaaaacagctggagttgagcagccttgggtagactgacttgccaagcaaactcacaaggaagtgtgaatcagaccccaattcattattgcataggcagaattctgcctgtggacagccgattatgtgccctggaacacagtccacgaagggagctagattaccacgagaacgctggatagaggggtgaattctgagcgaagggatgatcgtatttgctaaatcagctcacagcagtcacctctatctgaagatgtgaacacatgaactaagggtgttgctctagtctgcagaacagtctttttacttggagaaaaccccccatctctgctgtttactttcctgtcctgactctgctgtaagtcaaccccctttcattaacctacactctctcctgccaagccctgatgtctattaggccaacttctagtaaggaataaacacctggggttgaccttggatatttcctatgccttcctcctcagcccactggcagacaaatcaggaagagtggcttctatggatgctaacttttttttttttttttttttttttggagatggagtctcaccctgtcgttcaggctggagttcagtggtgtgatctcggctcactgcaacctccatccccccgggttcaagcaattctcctgcctcagcatcccaagtagctgggactacaggcgcccaccaccttgcctggctaatttttttgtatttttagtagagacagggtttcaccatgttggccaggctggttatgagctccagacctcaagtgatccacctgccttggccgcccaaaatgctaggattacagttatgagccaccgcacccggcctatagatgctaattttatctaccatgccttgtgttcactaatttatccttttttttttttttttttttttttttgagacggagtctcattctgtcacccaggctggagtgcagtggcacactcttggctcaccacaacctgtgcttcctgggttcaagtgattctcttgcctcagccttctgagtagctgggattacaggggtgtgccatgacacctggctaattttttgtttgtattttttagtatagaaggggtttcgccctgttggccaggctggtcttgaacccctgacctcaagtgatctgcctgcctcagcctcccaaagtgctctgattataggcgtgagctgccatgcctggcctaggttcaccaatttaactttctagggataagtatttctgattcctgaattgccttactagttcagtggctctacagatatgtaggctccacctccagagattctgtttcaactgatttgtggtggccttggagcattaataccttttttcaagctcccccagctcactctgcttaaaagccagggctaaggctcttgaaatcctgatttcaggtcacctcttgctgttagcaccatcagaccccgcaagatagacttcctgagtgcctgccctctgctggttgctttcgtataggttgtctcttaatccttaccactctgttggcattgttttttgaagctgcatctaaaaaatgaggcttaagagaattccaagatccaaaactagtagatggcagagcctctatttgaatttagccctgtctgacttcaaaccttatgcactttctttatacctattagcagtgatgtctctctaggtctcaaatttcccatattttaatggagatgtaatagttaccatataccataggacagaggtcaggacaggttcgccaggttagttacccctggacttgagctcctaggattaaagtctctcactctgtccccacaaatacaggtgcttttttattttagtttttgaaaaagagtctcgctctgtcacctaggctggagtgcagtggcacaatttcaacacactgcaacctccgcctctcaggctcaagcgatcctcccacctcagcctcgcgagtagctgggaccacagatgcgcaccatcatgcctggctaatttttaaattttttgtagcgacagggtcttcttatgttgcccaggctggactcaggtgctttttaaaactaaccctttgtcattgttggccgtgatgctctctgcatacccaggaggatgatgattgggcttgtcatcaacggaggataaatgacgcacagacttagttaacagaagaacatgaccttattgacacattagctttgatttcttaccaagaggtgaagatgcatttatacaccaaatggccatacctgggcagtttctgtattttacctgacttgttatccagtggatttgtctgggggccagagctcagtcttccccttcttttcatggttctctatggcctatttctatattatagcaggcctctgagcagagacatgatagcactgacacctggttcaaaaagataaggttactggtagaaaagagatgggatgttgagggaatatggaaatctattgcagcagtgagggcctgacctgagttagaaaggcgaggaggaagccgacgtatgactttcagtaagcctgtaaagaaataaaggaatgggcaagtgtgaaggtagactctgggcagtgccaacagaaaaatgcaacagcaatagctacattagcatcattaagaatgatagtgaagctgggcatggtggctcacgcctgtaatcccagcaggtgggcagatcacctgaggtcaggagttcgagaccagcctggccaacatggtgaaaccccatctctactaaaaatataaaaattagctgggtgtggtggcaggcacctgtaatcccagctacttggaaagctgaggcaggagaatcagttgaacccaggaggcagaggttgcagtgagccaagatggcaccactgcactccagcctggatgacagagcaagactctatctcaaaaaataaaaaaagattaaaaatttaaaaaatttaaaaaaagaatgataatgagcacctgaaggcttggtaggtacctgtgagcccagtaaatgagccacccatatctgcttagctcattaatctgttctccaaaatccagaatttggatttgtgcattaaaaccacatatgtgatacctttggatgtcaagagacatctctgcaaatctgtttaacaaaaaggtcatgatgtggtaaaggaagaactggcaagctttgttcatgatctctaccatctctccatcaccagacaagatcttgacaatgtggccagaggcatttctgaagcccttgccaactgacccatggagaatcatcgggccttggagaacatttatgtggcagttttattgctgccatcaaaagtgaattcttatcacttttggcctaaatcagctcttgcaccttaggctgtttaaaaaatatgatgtcaattggaaagcatcccatttggtgctgtttctactttttttatttgaagtatcctgacgcagttgttttctggtgagtagaccatctgtcctaaatatatccaataccagtttgcaaagtctttgtcaggtgcatcctgcatagaagctaaataaatacttttttaaataataaatagaggcgagagatattttgaaggtacatcagtgggatttgctgactgattgagtaagagagttttcatagaggaaaaggagatagtagtcatcactggagctaagatttctgacccgtgtgcttcaacatatattttagatttgaaatatgtaatttttgcagtagtaaagataaaagggaaaaattcccagtgccgctcatatttggctcgtgggtctctcgtgctctttgctgtggcaccatcaggtgtctccggattctcaagctatcttcctgcctttgatgtatttcaggaaccttttattattagcatggggacgcttttcagggctctcctgagttgctgtgggtccacccaatttcttgtttatcccagcagcaccggcctttgacctcgccatccccctggcctggctttgggaggccctgtcagcccatacctctgactatgacggggttgcatggggctgccgctggctgtaaatctgaagagcaagggcctagattgaccctgttccccaagctttctgcaaatcttacattctagtctggttgctaaaattcctttatcatcagccaaggagtgctattcaggagggctgcctaattaatatattacccataaacataacagcaactctttttcgagtacttgctttgcatccttttaattgtatcatttttcatctttacgtcagcctagcaaactaggtattgctgtcccctacttttgcagatcaagaaactgagtctcaaagaggtaatgaaactgttaaaatcttgcatttgaaatgtgacaaagttgtgctcccagccagagctgcccgcctccgatacagcagtctttatacttttctctgctgctttgagccagcaggtgttaggttaactggttaataatccattaccactttcagtcatgaggtgcagtggaaagacctctggggtgagtcatagggtagactctattctctctgtctaaggcgtgtgacccctgcaagcctcagttacttcatctataaattgggaatttataccttaaaggaatataaagaaagtgtaatgaggaaatatacatggaaaacattttttaactcttaaagagtaatgtaaaagatctgctagtaacattcaaaggaatttcagagctgggaagtagctgggctgggactcaaacttggtcttcatactcaacattgggttcctctgactgcatcaggctgggccaagatgagcattgccatggggccatccatattcttggcagagtaggtgaaaattttgtttgcttgacaacaccaattaactagatatttgtctggggttgggaagaaataacagctgttggtcttattcacactttcctcaatctgttaaggaatgaatttgtcttatttaaccagtggtttcagcatggctgtttgtttttgtcttttataccattagccatggcatgtatttgagaattagttttttagtgtaattctaaagtccgatggaggacccctctctccatgaccctggaacctcccagatgtgcttcacctccgacttgtttctgttccagatctagtagggctgccaggaagcggagtctgtgaattgagccattggagaagactgtccaggaccttctttgatgtggtttctcattctcgcagaattatttgtcttatgatcacagtgatgtaggctatttattatttgttagttccaactctgcgtgaggtaataaatgttgttggcagaaggcttgcttaaatgggtgtgtatcagtaaagactcaggagtagctaaaagtttgctgatactatgaactgtgctgttcatggggttcctttgtgaaaccttgttgatttttattgactagtcaacccatatgagggtcttaaaggtttaccgtcctctgagcagtagagctcttgcccctgacacagactctctcacctccttttctagctcttccactcactagctaagtggccttcagcaagtttcttaccttttctcacttcaaataatggagattataaaagcacctaccacacaggactcttatgtggaccaagtgattgacacatgtaaagcacttataacagtctctgacatgcatgatacacacaatgaacacatcgtacctccaattatcatagccacaatatttcagtgtgttcctttcaagcctcctttggaattgatgttatttctcatcgtctagactatgttttaatagatgaacaactgcgttcatcttttataactctagaattacaaaaattggtttttaaaaactatcactatatttttaatccttgggttataccttttgaaataagagttgtgttcaatactatatctctctatatttgaaaaaaaaaaaaaaaaaaaagcagggtctaattaaataagtccagtgggaatttccactgtcttgtttatctccctgacacattgacatggttaatcccaactccgttggcccccatgaagccacatgcatcttcctgcttctctgtgtacctctctgacttttctatcttgttctctgtgtttgccatgttttttgccctttacagctttaaagagttcaggcattaaattttgtgggatgacttcaggctgagtctacccatttcctcgtgaccaggctcaggtcatgcattctaggctggactaccatagaaacaatgcagggctcttgatcacctggttctgtaggcatctgctaggtttcttctcattaaattaattttattttcttttaggatgtgtattttgtggggatatattctcagatcatgacaacatccttctccacatccaaacctccacctaccagccttagcatccattaatgactcctggtcacctgtatgatggctgccaaatggtgatatatctgtttccatcattccttccacatttattagttggtattccactgtgaggaagagctttcctttctctcctatttactgattgactcgtttactttcgtatggcactatggaattatggcttcctattttattcaaaggatcgtaatccattattatcattacttattttgatttggccagtgggaaccccttccagctggctcttatatgcttgacacgtccacaccagtcactgtacatttccttaccttttggcacagttatatgttccacgcccagtttgaattttccccactccagccctggcattggtcatttcccaaagcagcccttgttctttttattgaagaatagtattcagagaccaacaaaaagtgtgtcaattttgaaaactaagtaaataatatatcagttgttctgtataggtaaaggcaagttcgtcggtatgctgccttgagaaaatggaagtctagagtctatataaaatgtagcacgaaatggcacaggccagaacccttggtgcatccccaaacctgaacccaaggtcactgtcttggatctctgcactgccttccagttccactccctacccctcccagcttcccacatcacagtcaaggcctattatttatttacttgtttattttattttattttattttattttttagagacaggatctcactttgttacccaggctggagtgcagtagctcaacaatagctcactgcagcctcaacctcctggactcaaacaatcctcccacctcagcctccaaagtaactaggaccacaggagcacactaccacacccagctaattatttttaattgtttttatttaaaaatttttatttttatttttatttatttatctatttatttttgagatggagtcttgctctgtcaccgaggctggagtgcagtcgtgcagtctcagctcactgcaacctctgtcccctaggttcaagtgattctcctgcctcggatctcttgagcagctgggactacaggcgcatgccaccacacctggctaatttttttgtgtttttagtagagacggggttttaccatgtcggccaggctgctcttgctgctcttgaactcctgacttaaggtgatccacccgccttggcctcccaaagtgctgggattataggcgtgagccactgcacccagccaattgtttttatttttatttgttttattattattgttgttgtttcttttgtgttttggggttttgtttttgttctttttaagaaacgagatcttgctgtttgctaaggctggttctccaactcccttggcctcccacattgctgagattacaggtgtgagccactgtctcctcaagtcctgtttaactacccatggttcccttcatgtgtaccccacagaatttttgcctcttatgtatggctcaggcttcatcctagcccctgacatgtatacacacaagtacacatacacacacgcaacacacctggctgatttgattgtccttattgagatgtaactagttgtgacttcgtttagtaatcttctgatcagggatagctgccacccccaaatccctaaagccatacccacatctccactgtgttattaatagcctttgtatactcgacttccctgtaagacagtgagtgagctcttctctgacaggagccacatctcattctggccttcggcttaacacactggggcagagggggttgttagacagtgtgtgttgcatgaacaaaagtagacatcatttttgttttaagtgtttgtcctttttaaaccacaaacaaaaagttggaaaagtgatatttcaattacgttgattcagccagttacaagggaacaccagttcctgtggtacagagccaggagagagatttttagatcagaaatgggggatgggggtgcattggtgagtcgtccaacagtggtaacagcggatcctacttattttagggaatatctcaaaaaatcaaaataaaaaagaactgaaatatttttacatttgctgaataagttgaagtgaatagaaaatactattgacttttaagtgaggaataacctttctcagaaaaataattatggtccttggattataccattgtaaatggctttttttccccagaacattctttccatttcgttgatattttaccgtatgtttccatttctatagttagtacacagaccccccccacacacagacacacactctacaatacttcctatttgaattaatatttcctataaagtctgttatgactttgatttaaaattgcttggcttgttcccagctggctatacaagaactagggagtttgttagaaattcctattcctagactctgtccctggagactgggatccagcaggtcagaagacgggcccagacatgggcaattaaaaagtactctgacgattctgatagactgccagatttgggaaccactgggatattttcctaatttctagagtatttgtgtgtgtgtgtccattttataagtcaattaaattaggacgggctgcctggaagcgtaaacaaagcaaattgctgtacaataactgctgtgagatgcaaagtaaataatttgggatatattattttgtctaagaccttcactttcttttaacttgggttttagtgccggagaagaaacaatattttctcatcccaaacaggccagcataattatggttgcatatactgtaggtttcaagtcattctgtaacattccattattgtaccatattttgaccaactcaccagcctctgatcaataaaaattcttcttaagtgtctgtaaattgaaaccaagtaatgaaaattccgatcaatgtttagtgagaactaattattttaagtctgctggaaaagatcatagttgctgagaatgcagatatcctatttttggaactggtatacttattttgatatattaaaagagctactttccattattattacttgcttttgtttccaacaaaagagacaaaatatttcatgtctgaatacagtattaaccaaagacacagtgggaggattactgggattactgtccttttataattcttttttaaatttaataaattcccctttatatatattattttataattcttatagggtttgctcacgcttgctctctctctctttcccagcttgttctagtaaagtttaaatgtgacagtgtaaacttaaggaaaatatacatacttatggtgatatgtaggaagttgaataataataatgtaatgaaattgatcagtggtgattattgtgaggtgtgatccctccctcttctctggaaaagctgttttaaaaaatctgaaatacacaaattttaaaaaataaaaaacacacatatatatatattttttgacacagtttcattcttgttgcccaggatggagtgcagtggcacaatcttggctcaatgcaacctctgcctcccgggttcaagagattctcctgcctcagcctcctgagtagctgggattacaggcacctgccatcacgcccagctagtttttgtatttttagtagagacggggattcaccatgttggccaggctggtctcgaactcctgacctcaaatgatccgtccaccttggcctcccaaagtgctaggattacaggcacgagccattgtacccggcataaaaatctaaaaaaaatagaaaattatgagaaagcacatgaaaaggaaaaagagccaggtgtcgtggctcacacctgtaatcccagcactttgggaggccaaggcaggcggatcacctggggtcaggagttgggaccagtctggctaacatggtgaaaccccgtctctactaaaaattaaaaaattagctaggcatggtggtgcacacctgtaatcccagatacttgggaggctgaggcaggagaatcatttgaacctaggaggtagagattgcagtgagccaagattgtgccactgcactccagcctgggtgacaaagtgagactccatttcaaaaaaaccattcctataccagcctcctaacaagtaaggaatatttctttttccttgtcaatttgtttttgcccatacattattttcacatagttgtaaacttgttataaatatagtatcttctattcacattaccacttaacttaggctgcattatctttatgttgctacatactctttgtaagtacttcaaatgcctgtgcagtattatattgggtggttgtgccattgtaagcttggactttccaatattcttgaatgtttacattgtttacaacttctaaaatggagtttcattgttgccaaaccgtgtaattccaatgagagagtgtgtgtgttgaccctggatctagtaaatacatcatctgagtatgtcaaccatttgaaaagataatttccccatggagttgaatttgcccgacctagttgctgcctgtgagtaagcatgtcctctggaagagtgtgacacctcgtcccaggcttgctggttttctacttgctactgtagcttacgaaatttcagtttggttttcttattcatgtgaccaggaagccaggagcatagcactaggatggtgagtgacttgcataggtgggttcagacttttgcaggtcatgagctctgaacagaggatggttcccgcctccccataatttctttaaaaccgtattattagttcaaggaaattcagcaaagttctgagtttcgctatatggccagctcaattctctgttcatttgtttcttttgttttgttttgaaatgtaaaattatttcaaatttcagtttccttttgggaataggagtgtcaccttgcttggttgttccccaagcaaatgttttctctttccttgagtaactcagcaatcgataacaattaatttgggctggatattcatagaagaacatttgctctgcgccctaaaattttttatcgcgaagcgcgaacaaaaatattgtcctatgaacttgtagcagtctgcatttttcatactaactcccaccatcattttatatgatatggggttctttaattctatcctggtaacacaaagggtaccaatagaaagatgaaaaatctgactgacttaagcatgttttgaattgaggtcattatcaattcagggggattttgtaggaagaatggggattttgaagagcagactatatattattaacaaaaggctctccccatgcaggaaggctacccagcggaaggtggcctttgttactccggatgtgattaatattgcttcaaggtttaattttagaacttctaaaataaggaagcttgcatcaattcaaggcacatggtttgaaacctcagagtgcccactttttcttttctttttttaaattacaaaaatagcatatgcattataaaatgtttgaaaactaatgaattaaaacaagtttctctagtctctggcttgaccaaagcctttgttaatattttgtggtagttccagtcttttttttaagaaaaaaaaattgtaatcatgttttgtatataacttgaatgacttatttcacttaacatgatttcatttgcttgtttcctgtgtttacagtcttcatgtcagttgtaatttatgtagaattccacccttgtgatactccataattttcctaatcatatcccccattattgggcatgtaaaatgcttaatggtcagtggtgtgcacagtggtaattatccacaccatgttaatccggctcacacgggtcacatgggcgacctaatcctgctgtaacttgcctttctctactggtattgtacttaaaaaaaaaaattcttttctgcctgttttttttgtttttttgtttgtttgtttgttttgtgtgatgggggagacaaggaagggagctggtcgcaatccacttctcaggtggattctttgtctgtctttctttagtggtgaaagtggtgctggaaaaacagtggctgccaaatatatcatgagctacatctccagagtgtctggaggagggaccaaagtccaggtgagtgggcagtggcccattatgataccttatgttatgggaaatgtaagaggctccatttgctgttagaaaagaatttttcttccacagaaaagacactggttcttctataactgtgaaacttgaaatctggaatggaaaggaatagcatatgtatgtgtgtttgtgtgtgtgtgtgtgtgtgtgtgtgtgtgtgtgtgtgtgtgtgtgtatattttttttttttttttcttttttgagacagagtcttgctctgttgcccaggctggagtagtgcagtggcgcgatctcggctcaccacaacctctgcctcccgggttcaagagattctcctgcctcagcctcctgagtagctgggattacaggtgtgccccaccatgcccagctaatttttgtatttttagtagagacgggggtttcactatgttggccagtctggtctcgaactcctgacctcaggtgatctgccctcctcggcctcccaaagtgctgggattaaggaatagcatattttaaggtagatgtgcctaatatataatgaactcctacaaatcaataaaaagatcagcagcccaaaaggaaaataaacaaaggacatgaaagacaactcatagaaaaggaaatataaattactcacaaaacatgaaagtatgttcaccatcatgataagaagaaaaatgcaaattaaaactgcattagaaaactattttttgcctatcagattggccaaaatcttaccatgttttaaacgcttgattggtaggaagtagggacacagttgttctcatacattgctggtaggagatgaactagtacattttaatgaagaacatttcagcaaaatctgttaaacttacacatgtatgccattcgactcagcagttctgctgaaaagaatttattctttagatatgctgaaatgtatacaaaataatacatgtataaagttatttctgtcaattttggtaatgcaaaagactggaaacaacttaagtgttcatcactaggcaactggtgaaataatttgtggttctttatataatagaatattatacagcaataaaaatgaggcttcatgtaccgattgtactgatagagaatggtctccaagatgtatcattaattacaaaagacaaggttcagaacattgtttgtaatatatgctgccatttgagggatcaaaagagagtgcacatttgtatttgtttgggtatgttatcacatatccctcgaagtatacacaagaaactgtcaacaatggttgtcttgagggaggggagctgggaggttgggagaagggcctacccttcctgtataccctttagaaacttgcatggtttgagctatgtgaaccacttgccaattcaagaaacttataaaaattttaaaggacgtagacagagaaaggatttaagagaaggaaaaaagagagattaaagagtgtaaaggagtgttgggaaagagaaaagatccagagaatgaggatactcaagaggtgaaaattaaaatcagcattggcaggaatgagtaaagcctgctccccagagccatggatgagggtgatggcgagctaaggtccataaggggcagcccaagcttggcgctcatcaccagtatgcaccgctggtgacagaattccttccaaagattagttttttaaatcagaattatgtaatgttattgccatggtcagctgtagactttcaaaagacacataaaattctctttattgtggttcccttttttttttttttttttttgagatggggtctcactctgtcacccaagctgaagtgcagtggcatgatctcagctcactgtagcctcctgctcctgggcttatgcattcccttccacctcaacctcccaagtagctgggaccacaggtgtgtgccaccatgcctggctaatttttgtttgtttttggtagggacagggtttcaccacattgcccaggctggtctcaaactcctgagctgaagcgatccacccacctgggcctcccaaagagctgggattacaggcatgagccaccatgtctggcccctttctattaattaaatagtgttctatcatgtactggtagatcagaaagcttaaggtagagccaaacattcctcctttgagtttgtggatcaactctttctatcttttgtttgcgggccagacgtgcctataccatttaacgacagcttctgtcagggagagaacaaaggacagaatcttctctatctcttcccttctttaattacagactttaaaactgagaatatttatggatccatccatccatccatccgtgcatccatccatccatgcacccatccatccatccatccatccatccatccatccatccatccatcagtgatcagtgatgtccaacagaattttgtggcatgtggtgagcatatcagggaaaagagaaagagcaaactaaggttgcagagtgaagggtccttaaagtggcctctttctctgaatgaaaggaagatggagagcagctctgtgcagtagaaagatgaagcaagccatatgtgtaattctaaattttctagtagccatgttaaaagaagtaaaaagagaaaaaggaaattactttttaaaacagtattatttaacccaatatgtaaaaaaagattttattatataattaatataacaaaattaatgagatttttttttttttggtactaagtctttgaaatacagtgtgtattctacagttacacctcagttggggtagcttatggcttccctattggacagtaagggcagctatagaacctaggttcatgtggttcagtccacttgcttttctctattcctgtgattgtactggatcctgagagggttgacatggagacaagaatccaggatgctgttttgctgccttttttttttttttttttttttttagacggagtctcgctctgtcgccaggctggagtgcagtggtgcgatctcagctcactgcaacctctgtcttctgggttcaagcgattctcctgcctcagcctcccgagtagctgggactacaggcgtgcaccactatgcccagctaatttttgtatttttagtagagatggggtttcaccatgctggccaggatggtcttgatctgttgacctcatgatccgcccgccttggcttcccaaagtgctgggattacaggcgtgagccaccgcgcccggccgatgggctactcttttacctcagtttgctctttctcttttccctaatatgcccgccacatgccacaaaattctgttgaacatcaccgattgttgatgaatacatatggacggacggatggatggatgaatggatacataaagattctcattttaaacactgtaatttaaaaagggaaaagatagaagaagattctggcttttgttctcttcctgagagaagctgagttttgttaagtggtatgggcatgtctggccagcaaaaaaaaagatagagttaatgaagatccacaaactcaaaatagattttacaaagaaaagcagagtttatataaatccatgagtttttaaaagagagtaggcaggttgggagtatgtttctaagctttgaaactgacccatgaaaggaccacccagaattgcccttggtgccatggctaaggatgattccctcgtcacaatgaaagcccagttctcatttctcatggcagtttctcttctgaatgttcaggagggtgcctgttacaccctttgtaacactttggctgttacatagtcagttagtagttcattaatttactcctctttgctacacccctacgacctagtagccagactgcagacagttaatgttgatttttctcttcctgttttcctatgaggacaatgatacagagcccttggcttggaattagtcagtagctaaagagcacaagccagaagacttgttatttctggaacatgtttaaccatagcatgtgaataattagaagtacaaggaatgactcacttgttgaaagacttctccaacatcaaattctatctattgagctgtctcatgtctatggtgtgttttgcacacttctgcatagaactgggatgtttgaaaaacaaatccttccccccaggccaggactcgttccacacgatccactgttgacccttgctgcttaaagtgtgtatcagtgctggcaaaaccagcaacaccagggagctggctacaaatgcagattcttgggcctaccccaacctactaagtccacatctgcattttgacaagatccccaggtgattcatgaatattaaagtttgagaaacaccaggctatatttccataaccttgtttggggaggagaagtggattaattttccttaaggtaacttgcagtgaagcaggtggagatgggatgagatgggttggtagagtagttgggaaggggtagtgagaagaaagaccctggccagaacagcaaggacacgccccttcaggtaccacttcacttttggtgaagttgcagcaatcaatttggacactgagaacgtttgtatgaatagttcctgattgacagtggggccctggctcctggggactctgcatcaagccatgggaattggaagacccaaatacacaaacaggttgaggtctgtcatggtgaaagaataaatcctccagaaaccccaccagtgacacacgggtgtggggcccctcaccttaatgcattcagaaaccaggtccttagagaaggtttggcgtacactgtgtggtaggtgttcacaccttcctaacctccggtctatttgctgggacagcacgtgaaggacattatcctgcagtccaacccgctgctggaggccttcgggaacgccaagaccgtccggaacaacaactccagccgatttgtaagtcccttccctgtttcagagagtgtcgcttgattgatgatgttgatgcttctgactgaagtctagtatcccacaggaaatgggagcctttcacatatcatcaggaggccacctcttcgatctttccttcattttctatagcagcatgccgccaagctgcagtttgcctttttttgcgccccggggatacaaacaagataattttgaaaatcattttccacatcagttgccttactaaggaaaataaatgatgaaagtggcagctttggccttggaggagttgtctttatgccctagagaaaagaccttctttcccagaccaagaaataactagagtagaggggtatcccaggtatcatttcccactggcagtggttttgcttcttagaacttggtccatagactctgaagggtgcacagagttagactgatctggcaccttggagagaaacttcctcctctccatccctcagagcgagctgcctgcccaccgcagccctctggctttgtgcatctgtcttatgccctactcatgtaacctaacgacatcccaaagtgactggacctggcctcacaggttgcctcttaactggcttacctaactggtaatgaaaatgtcaaccaagtgcattgttatgaatgctcatttagtcatgtttctgtctgggtgtctccagagggggtaaataggaaagctggcaaggctgaatatgaatatgttccccttgacaaaagccacatttacaaagaaacaaatgtttatccagtaaccttgatttatatagattttgcatcttatttcaaccatagatcatgtctggcactaaagcattcacggagccatctgtgaggctgattctggaacgttttaaaataaataagtgggaattttggagaaaaacaattttcttttccactgtctattttggaaagaagcttctatttccaagagaatttttactatgtgctcatataataactgtcaagttccctggtgggttctatctgttagacttgcccttactttctttgctttccaatattattcaaactactcatttgtttgtctctcatatttgggcccaatgcctgagttgtgttatcctgaagaagttttccagataataaaataggaaagaagaattaaacaaattttccacttgaattaattttcaatctaaatcttataaaaatggacttgaccaaatttaactctttatttaccttttcccctgtcttggattccttggagaccagaaaaaaaaaacaattaaattgatattttcattgatttttgcaatataaattattcattatatttggaggatatatcagtttctgtaaataacaaaaacactcaacatttattatttttctaattgcaaaattttatacaaccctgatagaaagattggaagagacaattcagacacacattcacctgcacacacacacacacacacacacacacacacacacactgtctctctctctctcactattcaccatcatggatgagagaaatgtaaatgaaaaccacatataattttctgtctctcaaatgggcaaacattaagttgattgataataatcgagaaaacacgctattggttgagaactgacacattcttccaggaaagtgattgggcaattgttattaaaattttaatcgttcattatctttgcccaacaatacttttagaataaattacataagcttcctgcttaaataactacttattttaaaagatattcataatatattgttaaattaaaaaaacagattacagaacaatatttacaatatgttcttgtttttttttaatgtgcacattatatgaaaggtaactaagaggtatgtaaatcaaagtttgacatctatgacagtaattatttagcaagagaatgaagaagtggcatcagggtagaattatgagtaatttcactttaaaaaatgcacaggtattatgaagcataagaatgtatatatttaacacttacaaatcttttcaagttaaagaatgtattacgaaatacttcaaacacgatttaaaaacaatgcaatgaacatctatgtatctggcacccagcttaggaaataaatcattaccaagagtcgaggtgaaacttcttttcatttcattatcaaaatgcaaatgcaaccttttattccctttataaaatttcctgtcatcccccccaggctgctatacagcagtcctaaatatgttaaccttttgttagaaattttaacttttatatgacaattatgagccatgcatatgcattttattatgttagagcagtggttctcaaccttgaccacacataaaaatcagctgggtgctttttgaaaaccacacagctccgggccctggtcctagagtctgatgtgcgtggcctgggctgacagcatgttggaaaggctccccaggtgtttctaaggggcatccaaggttgagcactgctgctaggaggacttgggagcttgcctgtccaacacctgcccttcctgggtcagatgttctgtttggtttcattttccctcaactgttgaggaatgggggacaggcactgaagtattccctctatcacatgccaaaaggaaagggtggtgaaggtggccgccaaaggaagcacgggagctctctttcagtgagcttttctcaggtgccactgacattccgcagagcgatggctggtggttctctgtgcctggtgctgctgggtgtttttgttttttgcctggaggaaaagaatcatcagattaagacacatagacagttagaggctggccgccttcggtggtctttcttgacacctagaataattacgaacaggaacacggcatgtactcacacatttgcagtgtgcacagtacttttcttgcccttaatgagtttacagctccagtcacagacataaaacccagctgaattcatccctgagatgggtggatttagtcagcatacacatttttatgttattaaatgtgaatgcgatgaggctgggcatcttctccagtttgaccatagaccacaccactccctcttttcctttatccgtatttacccttctggcctctgagggtgcttaagtttctaagcacaggagacaaattaagttctagtgagaaaaaaaaaccaatttaaatatacatatgaaatatatataataattgttataataattatatatataattttgattcattttattttggtttttggacagagtctcgctctccggcccaggctggagttcagtggcatgatctcggctcactgcatcctccacctcccaggttcaagcgattctcctgcctcgctgggactgcaggcacccgccaccatgcccagctaattttttgtatttttagcagagatggggtttcaccatgttgaccaggctggttgcgaactcctgacctccagtgatccacctgcctcagccttcaaagtgctgggattacaggcgtgagccaccgcgcctggctatatataattaatataacaacctagataccttttcaactacagtctaggtttttattctcctttgttccctattagcagtcatttaaagaggaattttcataacaatgacagtgacaaaaatccctaggcccgtcagtagctagaaagaactttacttttaataaagtgtttccgttctagataaacattttagatgctccgtaggtaagagagattgagtgtttttgctcaaagccatgagatgaagcctgacagagcaagagtgctcttcctctgaaagggtgccatgccatttttctgcctcatgatttacaccttctggttgagcagacaggcacctactgggggaaaatgagcaaggaatagagcatatccttatttagtcatgctggaatgataggtgctctctctaacagaatcgtgtggctggacaaaagcacgggttattgtctgattgaaaactaaggaagtctagactcaaattaggagtaattcagaatgtgtattttattaatgaatttccttgaattatatactgtattcaaagcctgtttgggacatcatgttttgttcaccaaccattgaaggaaatccctaactttcttgcagggaaaatactttgaaatccagttcagtccaggtggggaaccagatggtggaaagatctccaacttccttctggaaaaatctagggtggtgatgaggaacccaggagagcggagttttcacatattttaccaggttttcctgtttacttttttcctacccacttcctgtcccttctctacattaaaatatttctcagacttcaggcatagactatagtctaggaagccagggaggactgatgatgataccatgtacaagtcaatgtgcagaattgtgagaatgtcctgccctcaaggagagtgagttctaattggagtgataagacagaaattcctccaaagctaaatcatcaagaaagtattgatgtaacttcaaaacaaaacgaggagtgttggagtctttgccaaaggaattcaggtgggcaggtttggccggatagtaggagaggtgtgaaggaggtagagcccggatggaaagtggaggggattgatgagggaagacaggtgacctgcaccaaagcagtggaggtgggagagggaaagccagtcagggagcccggcctcagcctgcctgcagggcaggcgtctccagaacgtgagctaccggaggaaagatttgagataggtttgggatctttaatgccaaattgaaaagtttccacctagaccctcagaagtcatggagagtttggggccagagcagcttgcagggtgctttttgattatgttacaggcttcagcagtcatctgagtcagctacttttattttatttatttttttatttgagacagtgtcttgctctcttgcccaggctggagtgcagtggcacaatcttggctcactgcaacctctgcatcctgggctcaaatgatccccctgcctcaccctcccaagtagctgggactataggcacatgccaccacacctggctaatttttgtatttttcgtagaggtggggtttcaccatgttacccaggttggtctctaactctcggactcaagtgacccacccacctcagcctcccaaagtgctaggattacaggcgtgagccattgcacctggccctgattcaggtacttttgtaaaaggtttttaagtacttaaaaaatataatgatgttaataaccaaattttttatgttctatttacttattagtattttatattgaagatccacattagactttcttcgaagaaagacctggtcactgttttttgttttgttttgtttcgtttcgtgtttagtttgtggatcactggattagaaggacattaaactgtggaagtagctcacattcaatcttttcaattacacacacatcttaggcaatgccaaataattcttttagtttgtacctgttggttgaaaaagtatataaatgattaaaacttctgtgaattcagtcatttttaaaattgtattaaagcaacatatatagataagtgaaaaataattatatatttcacataaataatacccagtgctagatggaagtgtataatggatgtcaggacttctttaaataaatgcaagccccaaccctcccccaggagttctctgcccttaagtcagaaaccaccagaatagaggctgggaactgatgggcgcaggggttcaagattctgacatgaaagtaattcttggctgggtgcggtggctcacgcctgtaatcccagcactttgggatgccaaggtgggtgaatcacgaggtcaggagatcgagaccatcctggctaacacagtgaaaccctgtctctactaaaaatacaaaaaattagctggccgtggtggtgggcgcctgtagtcccagctactcaggaggctgaggcaggagaatggcgtgaacctgggaggcggagcttgcagggagcggagatcgcaccagtgcactccagcctgggcgacagagtgagactccgtctcaaaaaaaaaaaaaagaaaagaaaagaaagaaaaagaaattcttgaagctacgaaatacttgggagtggatgtggggagaaaatcctgccacacaggaccaggggactttctagatatgtaggatcgggaggcattgaagagccagcagggaagtagttgaaggataaggaggaaagccaggatcctgcagtgtcaccaagccagggaagcctcagggcgacatcgacaggatcaaatggtcagagctcttgggcaaaagggacgagctggggtgtgggggccaaaaaaaaggctgttggatttaggcactgaaaaatagccatgcaagggttccgccagagtggtgaggggagaagctagaatgcaggtggttatgtcatggcaaggaagtagatcctgcagcttggaggagttcacagtcaaggaaaagcttctaaagaaggcaaagagtaccagagagcaggaagctgcatggcagttttttaacatgcaccctgcagtgagaaacatggaaaagccagcttaaaaagccatagcaagttgggcaggaactaagtaattaaaatctgttttgctttccactcttccgagggtggcagtccagttcctttcagtggacaatggaaaatcctcagctcttgcaggtctttccagagttaggaatcaaaatttgcagagatgacctggggctactacaagtacatatttgggggccaggactgcctgtaattttagaaagcagagatagaaagtccttagggatggtggctgcaggatgcaggagtgacttcgggtgccttgtggtccacatcatggctcaacctgtgttctcttgctccagctcatcgagggcgcctctgcagagcagaaacacagccttggcatcaccagcatggactattattactacctgagcctctcgggctcatacaaggttgatgacattgacgacaggcgggagtttcaggaaactctggtaagtgctggcgcagggccaggcaggatctgctctcccaactggccatttcctgtggccaaaagggcagtgaaggttaataaagcaaagagctgcatgaaatgtccgcctctttctctgtgagcactctgtatgctcatacatgtttcagtatccttaaacagccatgtgccagttgcctgaggaccacttaatgatttgagatgggtaaaaagaaatgaattcatcattatcaccctgcaggagctctgataaataggcaaaaatgattcatacgttgagcatacctgtttgctgatggcctactctattcgtgagctatttccttagaaaagctaagcaaaccgcacgtctatggactgaataggtttagacattttggaacgtctttagtcttttctcttatttcttttctggttttgaagactctcttcccctctgtattgtttagggcagaggaccctttttctgtgccatgcccttcacattgcatgtatgttatggtccaagctgtgaaactaggtagattatggaggggttccatcctgggggcaataatgtagaactttctggaggtaggctgaacacccacttggcctcaaaggccttcattgccacccactgccctttgagtctgtttcaagctggggactattcctcaacccagatccagaactgagcagtagactctgaatgagcagcgtgggttcagtacatttgtggttgaaagggacagaaagttcaaacagactgtgtcctgggtgccaggaaacaaaatggtatcaacaggtcacatggcctcaaagcagctgcggggaaaagtgccaataaggagtctgcacactggtcctagagtgtagttttcttaggagatgtttctcttaagatttagacattttagcggtatttattgcatttaagggacctcagaaactggacttttaaatgatgcttttattggatttcctggagatttttcattaagatccttttgcaagtacaatatattcttatccctcctgatgaagggaaagatctcgagtccactttgagtaggtggaaaggtcagcagcgaccttcgaggggaagctggcaacaagaacacatcaaaggatgaagacaggacttggagactttgtgtacaactaccactcttccgagtctctttcctcctggagtattctcttattcctggaggatggcatgctatgcttagagacagaagtgcccttccagcatgactttgagacgtgagaagaatgtgtgcattgggcagtgaccatgttgtacaagaacgtcctgctgtcatcacaagctaagccacatgtgactgcacaacccaatcttatgttttggcttttttttttttttttctttgtaactcgtctgtacttgtcacatccttatttagagcagctgctgtgccttggcttcttcctaaggtgcttttaaagctggtgaccagcttctctggatagtttctcttttctcttccagcacgccatgaatgtgattgggatctttgcagaagagcaaacgctggtgttgcagatagtggcgggtattctccacctgggaaacatcagcttcaaagaagttggcaactacgcggctgtggagagtgaagagtgtgcgtagccctggcatgtggccattgaatgaggggtggctagctctgattagaagtaacctagcactttcctttgcttagatctcaaatgggaatattgggaagaagtgataaatctacatgtcctctgtggcaaacagaatggcttcacgagagaccagacctcttctatgcacctgtccctgtccttacccccagcctttccaagtcccacaccatcgattattaatggaatcgtttcaatttatcattaacctggggaaagctgggaggatttcacaccttggtttaaagataaagtgatctctttaatggggattagagtaatggcttaatgcaaaagatttattgtctttatcaaaaccttttcagtaactggtctttaggatctaaattcacttacaggttttaaagagcaagcaatataatatatgtaaatatgggaagctcacagcttcacagtttgttccatggattggattacattggatttctgaacacagaaaaagatggacattgactgttgtgttgacatttctgatgatcacttttaatgatcacatctgtatacctggagcctcaacacctaaatggtcgtttttactctttgagaaaaaaaatcagggttcttcctacagagaggtgctgctggttacatgtgcccaaaatctaccataaatacagcggcacatgactttagcctcttaggcatcaacagcttgcaggctgctctcagaacccacacatcctttaaccacccaggaagacattcttcctttctcagcattctttaaggatgataaatttagatgcttagtaataaatagcatcccactcattgctgacaatgcagtggggatatttccattccaaataaggttctttttttatgtttttgttttcttttctgataaaagagggaagttctgctaacttctgatgtctatctgataaagaaaaagatgaattatgtttaccagggaagggagtagaaaacaataaatatacagggtgtccataaagtctaaaaacatgacctaataatcataataaggataactatgtttctaaactttgtgtacattatccttgacatttaacaaatgcacatatatttccagtaggatcattaacacttggccttttaattgtaacagtgttggtttggtggtagtttctgttgaagtagactggattttttttgccttcttggatagtaaaataatttactgcctctttatgcttgaaaacaaaatcatgacactgaaacagcaaacacttccctagatgtttgaaacaagaagtgttttattgcacattgatgtccagagttagtagtcttctcagccagatgggtaaggccgagcactggcaactgcccatgaaattccctgactagaggcgatggaggcatggagattggaaaaggctgagatggaagccagagaggtccaggaaatgggcctccccctaccaataatttcctttgatttggggttttgttcatttggtaatacattaacgtggcttgagggggtatgcagtgaaagttctcccttctataccttttctagtccacttgttcccctcgtcagaggtaaccaagattcccagtctcttgtgttccctttaaaggatgtgtgttccaaaacaactacacacaaccactcctttttctcacttttgtgcaataatgggggcttatactgcaatgttctacagttgctttttcacttaacatgtgtcttaggccaggcatggtggctcatgcctgtaatcccagcacttcaggaggctgaggcaggtgatcacctgaggtcaggagtttgaaaccagcctggccaacatggtgaaatcctgtctctactaaaaatacaaacattagccaggtttggtggtggtgcgcacctgtaattccagctactctggaggctgaggcaggagaatcgtttgaaccctgggcaacgagcgagtctccatctcaaaaagggaaaaaaaattatgtgtgtgtatatatatataatatatatatacacaccatatatatattatatatatagatatagatacactgtgagatgatgctatatcaattcctaacgagcttcatcttatttgggcgtacttgtgtgtaagagatggggtcctgcttagttgccagggctggtctcgaatttctggccttaagtcatcctcccgccttggctccggaagtgctgggaatcgaggattgagccactgcacctggctgtcctttttgtagctgcatagcattccattcattggctacactttatttatctgttgttggacattaatatggtttctgatcttctgctgttacaagactgaatgaacactactgaaaggaatagccttggtttctatcatctttctcatattttagtatatctatggaataaatttgtagagggaagtggtagtccatgcctttataatggaaaaaagcagactttctcttgctcttgcagtgtagaaaaaaaatggaaaaaaatggtaagattttcatcagaactggcctactaaagcaaaatagccattaataacagcaagcttttttgttttattttgttttttgtttttgttttgagacagagtctttctgtgtcacccaggctggagcgcagtggcgctatctcggctcactgcaacctccacctcctgggttcaagcagttctcctgtctcagcctcccaagtagctgggattacaggtgcgcaccaccacgcctggctaacttttgtatttttagtagagatggggttttgccacgttgaccaggctagtctcaaactcctgacctcagatgatatgcctgcctgggcctcccaaagtgcagtaattagaggcgtgagccaccacacctggccaaacaagctttgttttttttacctgaccttagactaatggaaatgtagcatttccctggtcaaacctttacgttgctgtgaagctaaacaaactaagaaatcccttcttagttggatatgttggtgaatgtctcttgattctcacaacaacccgacatgggtccagtctgatttatgaatgtcatctgtccttactctgtgcacaggagtgcaactctgtgagatgaatgcacacatcgcaaagaagtttctcagaatgcttctgtttagttcttctgtgaagatatttccttttccacaacaggcctcaaagtgctccaaatatccacttgcagattctacaaaaagagtgtttcagaactgctccatcaaaagaaatgttcaactctgtgagatgaatgcacgtttagttcactggaagacatatccagattcctagacatgtgttaacagtaaaactaaactaaggataatggccattttcagatcagtgcatttgattttgtttacatgtcctttctaaaaggaagcccttctattgctcaaagcatttttgtgaaacactcatatagaggataaatgtcttgttctggcattatactttttcaaaatgtattcactgacttaatctcattggaaggtgtatactgagaaatgtcagcccgttatattctaacaccatctgtgaaattcaaacagattatcctttattgggaggcttgtgattttttagcattatcataaggcctttaacaaaattcttttatcagataattttggtaaagcattatgcagaaaaagaaaactcagccaagttcaaaattttcattgcatctataaaaatctttcattcatattggaaaaatctgagcattctttcatgtcaaagaatggtgtcatttatttatatgagaacgttctgcccagaaatcaagaaaaccccatttatatcactagccctccttggtaagtttcatggtctgaaacaagatgttgagctatggaagtctccgtttttctatccaaagaccacagactgccataccatgtgacattagggcaggatatgaacaataccatccccttcatttcactccatatgctaccctcagaggaatcttcttataatgcccctctttattagccatcaggcccccttttgcctccagcccaaatatatcataccattcaaggacccccagcattggaatctgtcctaaccttttaaatctgacctgaactttcacctgtagccagtgctagtccacacactgtagaccgtctcgtcttgatcatgtctcccacacttctgcttcctccccttggtacactcccttctcctctctgcatctgcacaaatcgtattcatcctttacacccagctcaaatctcttgactaccccagcaagtagtaatatcttcctgttctaatttctccagatcttgtctgtctgtgttacatattcagcttttccaagggttctttatttggcaaactatttttgcctcatctagattgcattcaagatttcttacatattttctatcttttcctctctctttagtaaccctacacatgctaaatactcaataaacatgggattggttgtaattattagttcagtaatatcaggtgcttcaaaaatgatgctatgaaaacattgtactaaaaaggaagaaaacaatatttggagccaaagaaatgtttcttgattgagttccttcctggctgtcgtgctggaagcttggagagatgtccattttaggcatttgactgtgatctcagtaggagggataggtttgccatccttcttgaatccctgatttgtattattggaagtctcagtcatcataggaattgactcatgtcataaaacaattgggaaaaacaaaggagatggatgtgtatgggattactgataagcagccttcactagaacgtaagctcttggggcccgtgattgtgccttctatgcacacacacgtgcatgtgcacataagtgcctccatatgtttgtgagatgacttggaagtgtcacaattctgaaagattgtcatgttttgttttatgttctacagttttagcttttcctgcatatctgctagggataaaccaggaccggttgaaagaaaagctaacaagccggcagatggatagcaagtggggaggcaaatccgaatccatccacgtgaccctcaacgtagagcaggcctgttacacccgggatgcgctcgccaaggccctgcacgcccgggtctttgatttcttggtagatgtaagtaacagaagttgatgctggtgatgcttcatatcttagctataaagagtaaaactagtaggctgggtgcggtggctcacacctgtaatcccagtactttgagaggccaaggtgggaggatcactgcagcccaggagtttgagaccagcctctgcaacatggtgagaccctgtctctacaaaaaaacacaaaaattagccaggtgtggtggcatgtgcctgtggtcccagctactcaggaggctgaggtggttaagatcacttgagcctgggaggtcaaggctgcagtgagccgagattacgccactgcactccagcctgggggttagagtgagatcctatctcccaaaaaaaaaaaaaaaaaaaaaaaaaaggtaaaacgactgagggttttgtgttcctgttctggctccttcctttcacccattaccttacttcactttctctcactctgtgattactgaatcctgcttttccttctagaactgcccaccaagataccttagctaaatctaatgtggtaacaagtttcttctggacaaaatatttagtaaagctaggactagagaccagaaaaagaggagagccacgttcatgggcctttcttgacttttggacctaaagatttaggaatatgtttttcacatatttctatgttacaaattaacccaaaacctagcggcttgaaaccataagcacttattttctcagtttctgagggtgagatatttgggatcggctgagcttggtggttctgactcaaagacgaggttgcagtcaggaagctgattggaactgtggttgtctgaaggcttgcctagggttggaggatctggctgaaagatggattgcccatgtggctgttggcaggaggtctcagccccttgctgcatggacctctccttgaatatcctcataacataatggttggttttccccagagcgagtgatctgaaagagagaatgagcaagaagccagttttttatgtcctaatcttggactcaggtattgtcactttgccacattctgtttattagaagcaagtcactaagcaaagatcacacttaaggggaggggaatgaggctccaccttttagaggaaggaatatcaaaaactttttgcatgtattttgaaactattagatatttttggttatggcataattatgtgtgtgtgtgtgtgtgtgtgtgtgtgtgtgtatgtgtatatatatatatatatatacacatacacacacacacacacactgggggcccttcgatccaaaagatagatagatagatagatagatagatacacacacacacacacataaactcttatatatgaatatatatttatatatgtatatcacatatatattctgacaattagtctttcagcagtgtagagctgccagtaacaatctctgttaatcactgtagcctctaaatggtaaaataataatagcaggcacttatatagaactaactatgttagtgcccagatactgttctgagtattttaaagagaaaaaaccctcacttaattcttacaacaaccctgtgacttaggtattattatctctgctttacagataaactaagggaggcatagattgattaaggaatttgcccaaggtcactctgttattatgtgagtgatctaggaggccctagattcctagctagtttgtttctttgacgtttatatattcaagctagaaggaccctagtcaagggacaacagtgggggccattcaatccaaaagatctgtatttgattccaggcactaacatttatacggcttaaggtatggttagtgtggttagagtagggtcaggcaggacagggtaggagaactattctaggtactttagtggctatttaaaggataacattgcttgggaaggtcagggtcatactaaacagaagtcatgcagttaggttgtccagacccctcattttactgagaagggaacttcaggcctgagcaatggtggttttgcccaaggctggtcagcaagggggtggtgcagcctgggactagaatccatatctcttttctctttgttcagagcaccttccagcgctgggcttcctacctacctttctacctgtcacctgtcagttttttttgtgaatagtaccagtacatgaatactcatataagtgatcctaatttgaggtgggatttactgggcactgactgtgtgttgtgtatgattactcattcgctcacaaaagatgatatttcattttgtttgcctggaaaacacctctggtacttcagaattcgtccaggtattcatcacctcaaagaattgttcgcttacattcctcccccactgcatcccccaccaaccgctctatccaaacctcccttgctgtcattacatctgttcccatgaattgcttggcctcttctcacggtgattaagaacacagatttaggcatcatactgcttaaatttagtcccagaccctgcttcttacatagaacaaccttaagcaagccttggtgtatccatgtggaaaattgggaaaataatggtatcactgccattttgagaaatgaaatgggaattaagtgaaacaacacattgagagcacttagcaaaccctggcaaaggtgaatgtttaatagacgtaagctgcttctattatcaattcaaaaataatgactattgttactatctgcagatagctcaccctctctataagcgcctaggaacaagggttgtcttgtccttagcatccctggcatattgtgttgggtcatcattaaatgactggtgaatggaagacactggaaatgacaattacagatcctttagtgtgggttctttgtgtgaaataggttttacttcgatcatccaagatgacatttttttctaattgttaagacttcctgaaaaagcttacttggacagaaattaatggttatcatcattaaacaaacattttttgtttctactgtactcgcttttctgaatcctggtggttttccaaagtacttgactttggactgagagattgttaaagcagcaagtctcctgccttcacttgtcctctgtttcctgcaagcagtagtgtttgccgtgtagaatccagcttccctttccccagtgcatgcccgtttttagtatgaatggaaaggagttcactgccatgctgtttactttctctagtccatcaataaagccatggagaaagaccatgaagaatacaacattggcgtcctagacatctatggctttgaaatattccaggtaaggccagttttaataactaggggttgaggagggtgacgtatttcatctggcctgcaagaaataattctaggcaatgcaaaaacaaaaaaacagaaaacaaaccacaacaacaaaaaaaacaactcaggctcatttttgcctttgtgagttcttcatgtgcctttaccaaattagtttctcctaaatataaacttatttcttttgatgcatccaacatttctattaaagcttttcacatgaagacatttcaataaatcactccagaaatgacttttaaatgattttgtgaaagaattacatgtgaataactttttttttccagaaaaatggctttgaacagttttgtatcaattttgttaatgaaaaactgcagcagatttttattgaactgacattaaaggcagaacaggtaagcagtccctcttccttcatcctattctatttataatttattttgtttaagagggtatagatttctgtcttttgttaatagatttcggttccagtcttatattaggaaatgcatctaataaagtcaggcagaaaaaccatatgccattgtggcattttaatctatgaaatataaataccgtctgcagcatttgccttcttctttaagcaaatgatgctgtgatgttggaggtaagactggctgcttttactctactgactcattgagcacgtgggaaatgggagcctagttccagccccgactgtctgtggcaaatattgtgttccaaataaaagacttggtttcctcagatctacgccattttcaatcttccctaacaatacgtgcatttttaacaaagctggtatttgaatacttacctgaggtaacatgccttggtatagtttcttctaaagttcactgcaggctgggtgctgtggctcgtgcctgtaatcctagcactttgggaggccgagtcgggagaattgcttgagcccgggagttcaagaccagcctgcgggacaaaatgagaccccatccatacaaaaaaaataaaataattagctggacgtggtggcataagcctatagtcccagctactctggaggctgaggtgaaaggattgcttgagcccaggaggtcgaggcttatatcatcacaccactgcactccatcctaggcaacagagcaagactctatctcaaaaataaataatagccaggcgcagtggctcatgcctgtaatccctgcactttgggaggccgagacgggcagatcacttgaggtcaggaattcgagaccagcctggccaacatgatgaaaccccgtctctactaaaaatacaaaaattagctgggcgtgatggtgtgtgcctgtagacccagctactcagggggctgaggcaggagaatcgcttgaacccaggaggcagaggttgcagtgagctgagatcgtgccactgcactccagccttggcgacagagcgagacttcgtctcaaaataataataataataataataataataataataataataataataaataaatagttcagtgcagtttccattgtttcctgatagcatattgtttaggattcctggggccaccataacaaagcaccacaaactgagtgacttaaaacagtagcagtttcttccctcccagttgtggagcccagagtctgaagtcaagaagtcctcagggccacactcctcctcctcctcaggatagaggggagaatccttcctcttctagtttctggtggctcctggcatttcttggcttatggcagtttgactccagtctctgcctgtgtcttcacgtagcctttttcaatgtccctctgtgtctatatccaaatctccgtctctttcatgaagacaccattttagctttgcgcaatggcaatattttagccagggctgttcatctgaggcatgattattgctaattgaaaacttttcacaataccctgccatgatgactggaaatacagtcagcattgacaatttttgacagtctctatggagagtgaactgtaaaaaaaaagaaaaagaaaagaaagacaccattgttttggatttcaagttcactctaaacccaggatgacttattgtgagatccttagtgaattacatttacaaagaccttatttccaaacctcacattctgagaggttccaggtggatgtgaaatttggggggatactattcaagccattacacacatcaaaggctgtttggggtcatttagttatggaagtgtttatgcctctgcttaggaaacaccataccagggggtttcacgtgaccttctgccctggaacctgcccttggttgttttgctgtagctactctaaggggtggggtaggctagaggttcacatgaaacccattgctcccattgccatctaagtccctaccacgtctagcccagtctcctgcagtagtctcctaactggtttggtagtttccatatgggtttcctgtgaacctctagccttccccaacccttagagtagccagagcaaaacaaccaagtaagagtgcaatagccagtgagatgggagaggggaggcaggggctagattgtatgggaacttgcagggcatggctgagactttgggtgttacagtaagtggaatgaggacccactgaagaattttgagggaggagtgacatgatgtgatttgttgtgtttttgaaagggtcactctggctctatagacttatagagtgggatgagtcaggggaaagcaaactagaatggaagtttaaaaaccagtgagggggatactgcaggagactgcgctagacatggtagagacttagacggccatggtagcagtgtaggtggggagggggagtatctggagagtgagagaatgggacttgctcaaaataattagcaatagccaagaaagaaagagcaatcacgggtgattcttagctttataccctggataacagggccgatggtgacactgtttactggagggtaagattagaagaggggttgtttggaggtcacgggaaatatggaatcagagttcctctaaacaggttaagtgggagaggcctatcatacatccaagtgaagattccaatctgtagaatggatttgagtctggaaccccgtggcgaggtatagactagagaaataaattcaggggtcattagcctgtaggtggtatttaaagccatgggattgattgaaatcacctagagaaggagggctgagaaaatgagaaagctgaaagattgagccctgagactctaccacatataaaggtctggaaataagaaagacctggcaaaggaagctgacaaagtgaaaccagtgaggaaagaggaaaaaaccaggatggtgttgtggtgttcaagttaaatgagcaactcatagactgaagaaccttcccattaagtacctggatgctaatctgtactcctgtcctatattcaatttttttttttttttttgagttggagtttcgctctgtcatccaggctgaagtgcagtggcacaatctcagctcacttcaacctccaccttctgggttcaagcaattctcctgcctcagcctcccaagtagccgggattacaggcgcgccccaccacactcagcttctttttgtatttttagtagagacagggtttcaccatgttggtcacgatggtctcgaactcctgaccttgtgatccgcccacctcggcctcccaaagtgctgggattacagatgtgagccaccgcgcccagtcctatgttaaattttaagagttttgtgatttttttgtaactggatttatcagttcggtgctactaaattgtagttttctttggccagaaacagttgtgtggcaataatttcatagggttcaaactaaacataaaaatcaccaagtcataaaatgttcctttcctgttacctcttagaaaataaaaattaaagtccctggtctttgttgcaggacattcaggtttttctcttttatgggaatttttgtccattcagggtctgtccgtgcagagctcttgctatctgggaaataatgtgagttccttgtctctgtgttacaggaagaatatgttcaagagggaataagatggacacccattgagtactttaataataaaatcgtatgtgacctcatagagaacaaagtggtaagtgttcatttagtatgtcttttcactgctcacaggtttacattaagtgagtttttattctctgtgtcattgttttagaacaggcaaagtgacaactctgatttgcagagaatttgagcaattgtactagttttctgtatgtgtgaaaagagaacagtacggctttattctggcagtaaatatgaacatgtggatatgagtaaaatgtcaatgtacaaatggaagttgttattgaattctaagagaagacaggatcacatgatgacttagcatggaaagagccataaaattggccctgtgttctagtccaacttctaggactttagccttaatgactgattcaggctggtcatggtggctcgtgcctgtaatcccagtactttgggaggctgaggcaggtggatcgcttgagcacaggggttcaagaccagccccagcaacatggtgaaaccctatttctaaacacaaaatttagctaatacaaaaattgtattagctaaatacaaaaattagccaggcatggtggcacgcacctgtagtcccagctactctggaggctgaggtgggaggatcgcttgagcctgggaggttgaggatgtggtgagctgagattgtgccactgcactctagcctgggtgacagagcaaggcaagaccatgtctcaaaaaaaaaaaaaaaaaaaaaaaaaaaaaaaaggtgattcaaaataaagtgatacagaacagatatctctgtaggatttttttatatatataaaagcccaaaaactggggatcctgctagtagtcgaacctgcagcgcgatggcacggcgtgtgtcagctggttctacatagttnnnnnnnnnnnnnnnnnnnncttatttatttatttatttacatgtttatttatttattttgagagacgtctcgctcggttgcccaggctagagtgcagtggcgccatcttggctcactgtaacctccacctcccgggttcaagcgattctcctgtctcagcctcctgagtagctgggattacaggcgcccaccaccacacctggctaatttttgtatttttagtagagagggggtttcaccatgttggccaggctggtctcgaactcctgacctcgtgatccacccccctcggcctcctaaattgctgggattacaggcatgagccaccatgcccggccagacaacttagttattaaacaaactatagcatatcagaacagagaagtatagccattaaaatagtaagtgtgaagaatgtgtaaaacatgaggaatgcttataaaatagtgctatgtgaaaaaggaaatgcattatagaatgtgtacactaaataactaccgaaatgatgcctatatgggtaacacgctgaaagagaacattaagaaatagattaggtcaaaggaaaatgtttttacttttggattcttaagcaagtcaatttggcatgactatgagtgagcagataatgatctgtgcatgactcttggataaaacttcagggagttaaacagctttttggaaagtggagtttcctccctctttagatctaagtggtgactccctatttgggactattaattgcattcttgcctgaaggggaatactgactttcaagatggtatcttaagtctggggagctgtttccttgcctaagaaaggacctgataagcattgtctgttttggagaggtcagtgactagggccttgccttcttgctcccatcagaaccctcctggcatcatgagcatcctggatgacgtgtgcgccacgatgcatgcggtgggtgagggggcagatcagacgctgctccagaaacttcagatgcagattgggagtcatgagcacttcaacagttggaaccaaggcttcatcattcatcattatgctgggaaggtatggccaatatccattttaatgtctatctgttttaagcctttgggtttgtgatctggtttctcatgaagcaaatcatatggctcgccgtattttattgattcaacaaacggaatttattaactatcaaaggaagcaaaacaaaagattgtatatactactgcatttttttgtatgtacatttatttttacattgtagaagaagctactacttttttacagcatataaatgaacataggtataaaccagcaagaatgaaagaaatagcatatatctaatgaaaagagtcggaatttctagaacacaataaatacctacatcctactttttgggaaccaaatgccaactacatatatataacatggcaagtgctgctacatcagaggtaccaaaaatacttaggaattgtaaataagtatcgtccagcacgtggatgctcaataaaagagctggaggactaaataaataggaaaatcactctacctactttcctgtttccatcttttaggaattcaagtttattcaaaatttcgttatataatcctgtatctatgatctcttcaataatttcggaatggtagttttaggcaactttaaagcttaagcttattctgaatttcccagagtgtttttgcactttttttcagatgggcctcttcttcaggggtcagctttatctttataaggttggtaataccgttctctcccaggatacaaggaatactgaggaatacttcttcatctattccatagaggcccttaattatggtggaaactggatgtattctcctaagattcttcaaaatactttctgttaaatcggccacagataggccaatggcccaagaagtataacctttcattttaataatctcataggcagttgcagtcacttctttgtggacatttttccattgctcaggatctttatcagttcctatatcagagttcagatccttcaaagggacaccagctatgttcactccactccacacaggaacacttgagtctccatgctctccgaggatccatccatggcagctttcagaatggataccaagcttttgtccaatcaagaaacgaaaacgagcagtatccagattacagccgcttccaataatacggtttttgggaaatgcactcaacttccaagctacataagttaagatatccactggattggaaacaataatcagtttgcagtgggggctgtactggacaatactggaaatcattaacttgaagatggccacatttcgctggactaaattaaggcgcgtttctcccttttcttggcgtgcacctgctgtgataatcactaggttggagtttgctgtgacaaagtaatctttgctacaaacaatatttggcattttcgtgaaagggctgccatgttgaagatccatcgtctcacccttcagtttgtcttcatcaagatccacaagggcaagttcatcactcaagccttttaataagatgctgatagcgcaggccatgcccaccgatccagttcctatgatggagaccttactgtgatgaacgggcttctcggaagtgaaacgctcaataagctcactcttcacagtcgccatcttgctcacgggtgtgaagagccaggtgccgttgagcgggatgcgcgttgcttgacgcagacacagggccatccccaggcataggaaattcgctcccaccgagctcattctctggctggcccgcacaacaggcacagtccaactcatggctgctcactgaagaagtggagagagagaatggaaaaaagctgctgatccgaacgttgagacgccaagagagccgttggcaggaccttcagcactctacggcaggtgcgcgtgccccgccccctggccctctactgcggctgcgcgggccttgccagagtctccgacacgtgctttccgtgggtgctcagactaaggcagtgaagggctgcttctctagcaagtgatttctggagttagttttgctaagagtattatcaatagttgacatgcttaagaggctaaccgagatccctggaattactagttttttatttttaatatgaatgctgaggaaacatgcttctgttaactacagatgaaaataaggttacgttttctgaaccgtgaccctgccaggaaggatagggctctatgctttgcgtactggtggctgcctgcaccatctcccagtgtcccagaattgggcgcctgctttctggtctatggcgctggaggcctattttgaaaggattccactgccttggtgccagtcctggccaggacccaccctgggacagtcggctggggcttcagcagggtaggggccggctgggagtcactccagcactaaatctcagcatactactgcatatttttggaaaatgaatcaccctgctacatgtattagctgctgaataaatggattttcgtcttgcctcttgctggaatcacagactggcattccttgtctccccatgcctactggtagtataaatcaaggcccagagtgcacttttggtgttcttataaagcccatcagtattgggtgcctactggatgccaggctgtgtggggctgctgatgataaaaaagttaagttgaggtcgtggtcttggggacttcctagtgctatggaaatcccctggtctcatccatcatcccagctgatctcttgttaaacagagtatctgagcatgagtttctggccagattggtgcaactttgataccacttctgggagaaactgcaaagcctcagatgacatggctcattgcagtgaattactgagcatgaggggcttcacttttgctctggcttagctaaaatttaggaaaagtattgagtatgtcacttagacacccctatggatccactgaagaaggggtatggggacttgagagctggagttctgattacggatcagctgggccatccaggcagccagatactcatcagcatctgcaggccttccccactaagtcagctaacaagtaagacgtgcacagccttcctgtgacagtgcacaatgaaatcccaaatgcaacatctggaaatccacatgttgtggtgagggtagccatgacagctttggttttttgtttggtgaaattagattttttgttcaataaatgattttgttcaattaattacattttgttcaatgaaattcgatttctttccattcttggccaggtatcctatgacatggatggcttttgtgaaaggaaccgggatgtgctttttatggatctcatcgagcttatgcagagcagcgagctgtaagtatgttttgccatagctgacaggggatataggtttgatgaaattttcaatatgaaaacaaacttatgagctgggtgtggtggtgtgttcctatagtcccagctactcaggaggctaaggcaggaggatcacttgatcctaggagtttgaggctgcactgagctgtgatcactcctgtcaatagccactgccctccagccaggcaacataggaacactgtgtctctaataaagaaaaaaacaaaaacaaaacaaaacacctgtgatgtttagtggttagcattttgttccttcatgctattgggtctggattatcatttaatctatttggtttctcaaaatagctttcttttctctatatcagtctctcccttttatgtccctaacacttcatgcccccaaattccaagtgccatctacaggtccttcagggcctcaggctttctacctttcaatactattatcagggagaaataagcccactggctttggattgggatggccatttctgactatttaagagtggaacagtctggttctatgatactttgcccctgagctcttcttcatggtcgttgaatttttaaagatggttaatggcttagcaagacccacattaaccagagtccctgaagtactgaagaaatggcttgagaactctgggagggacaactaaagaaggagtgactaagagatccattttaactcccaagaccctgtttcagctgtaggggtagaagagggagggtatcccccttgcacgctgctagaactctcaagaccacctctgccttcctccccttttccctgaaaaggttctcaagatcctggataacacataagatgtaatttacatgagcaagtccatcatgcttgcgaggcaaggcccatgcatgccagatcttacaatttctagagcttctttcaagtaagagctgcccttttgctctctgttagttaagctgtcacaatagcaaggccagcttctctgatcaacagcagcgagcctgataatttcctattaaagggctgactgcaatgaaagcaaagcaagagtttccttttcaggccctggtcagctgttctgctccgtttacttctctccctgtagctccctacccctcctcaccctctgctctccatccctgcgcttccttgcagccacaccaccatttctgagattttgcatttctttttattcaaaacatacataatcaatttgttcttctctgagatgtttaggtaagccacaagtcctggcttgtgggttttatggcagtcaggtgcagacttgcttccagagattgtttttaaaaaattattaaaattcctgccaagtttaagagctattattgcttccacataaactgctgtcatacggacatggcctattattttgtaaacacacttgatgtcaaaatctgtagttgtatctggtcaagttaaaagtagactgctggggagacttcctggaaaattcaagatgcccaaaaagtcattgaggaggaagtgagtttgagtttgaatgtcagattgctaatttacatggatcccgtcattcacccagtcagcaaatacatattatggaccaactgtgcaccatgctatgcttcagacaccagggacactaagatgagtaaggcattgtccctgccctgttgctagtgaggcagacgtataaacacatgcagctcaaatagcaccactaatgaaagtatcttcaggctgggtgcagtggctcatgcctgtaatcacagcactttgggaggccaaggtgggtggatcacgaggtcaagagatcgagaccactgtggccaacatgttgaaaccccgtctctactaacgatacaaaaattagctgtggtggcacgcacttgtagtcccagctactcaggaggctgaggcaggagaatcacttgaacctgggaggcagaggttgcagcgagccaagatcgcgccactgcactccagcctggtgacagagcgagactccatctcaaaaaaaaaaaaaagaaagtatattcagccggcagagcctggtgatttgttactgctccgcttaaaattgctcatactcaaaagcagtttgtcagggttttctgtgtagagctgggaacagtgtgctactggcatctggtgagcagagaccatggatgctgctaaatatcccacaatatgtagaagaggcgccctcctcggcccccaacaaagaattattcagccgcagataccaatggtgcccagactcagaaactctgctctagagcaaagcagcatctgcactgaatccagacatttcatataattccctgagctctggtctatcttgcttgtcttaacaaacacatgctggccaggcgcagtgcctcatgcctgtagtcccaacacttcaggaggctgaggcaggagcacctcttgagtccagttgtttgagaccagcctgggaaacatggcgaaaccccatctctaaagaaaatacaagaattagctggacgtggtggcgtctgcctatatatagtgccagctactcaggaggcggaggtgggaagatggcttgagtctgggaggtcgaggctgcagtgagccatgattgaacccctgcgctccaacctgggcagtagagcgagaccctgtctcaaaaacaaaacaaaaacctaaaatcccctactgacctccctctgttatgttctgtcaagatatacctcaattcctgtgactagggacgttggaaaggcaatgttttaaaatttattttgcagtctttgattccaaattgcttatatcttagaattctttcccttcatgacttttgtccgttgttcatttccccaagtcacatcttgatggcccgcgctgtgagtcagatggcttttctgtagccaaggttatgtgcctggggacggcccttcaccccatcctctagaaaggcaggctttcagccccagaggtacttacagattgttaattcattctctttctccttttccaggcctttcataaagtctttatttccggaaaatctgcaggctgacaagaaagggcgcccaactactgccggaagcaaaataaaggttagttctattttaggaagtttatagattcttataagggctagcgctttctaggagtaaggaactgcacccctgggccaggatgaggtcagtgagacgtgaggaggtggttacagaagatgcccagaagtaacatcgctgcttgttacaaggttccaggatgcaagctgaatttgacttggctgtaccgaaaccttaaatggatattaagtacctcatagcttaatagtcagcagatgataatcagctactttctaagaggaaatggctttaaacagaacctggaagaatttatgttaaactgtcagagaaatatggttcggagccatgttttggatactgttgacagtttaccaggccaggcccaaaaacctgccagttatggaacgttacttgccagaaattctacttggtcttttaggggcaatttatgcatccctcctcactgggtcctacaggcctctccttgctgtgaattgaagacacatctagccacatggtgtctcaaagtctgaaggaaatcttacagtgtttctcaggaagtaggcagggttctgtggtacctgagccattacactgaattaagagtttacacttaattacactgaattaagagtttgtgggctgggtgcggtggctcacgcctgtaatcccagcactttgggaggctgaggcgggtggatcacctgaggtcaggagttcaagaccagcctgaccaacatggagaaaccctgtctctactaaaaatacaaaattagccaggcgtggtggcacgtgagtgtaatcccagctactcaggaggctgaggcaggagaatcacttgaaccctggaggcagaggttgcagtgagccaagattgcgcgattgcactccagcctcggcaacaagagtaaaactccatctcaaaaaaaaaaaaaaaaaaatctgtgtcagccagatgtagtggctctggcctgtaatcccaacacttatggaggccgaggagggaggattacttgaccccaggagttcgagaccaacctgtgcgatataatgagaaccccatctctactaaaaataaaaatgaggtgtagtggctcacatcttatgctctcagctacttgggaggctaaggaaggaggatcgctttagtcaaggaagtcaaagctgcagtgagccatgattgctccagcctgggggacagaacgagaccctgtctccaaaaaaaaaaaaaaatagtttttgtcattgtgtcacacacaatcatgtaactgtaagaaatactcactgagctattttttaaaatcatactggttaagaataattttttttaaaattataccagctgaatacttcctcagttttacaatcaaaggaatggttgagtgacagcagggctttgagtttgctcgcctgtgttcgaatctcagctctggcttttcctcgctgtgtgcttgccaaggtgttacttacgctctcagtgccctcaccgcttccctgtaaaatggagtctatcttaagagtctatcttaagatattagtgtctatcttaagagattactgtgatgattcagcttcataattcattggaagcatgtaacgcagtgcctgaggcatactgaacacaagatgtatatgtatgctctgactacattctttcccattagcccctttcctgtatcgccgttgttggtctctgcttaattgttgtttttttcttttttgtaaagttggggtgtcacaatgtcacctaggctggtcttgaactcctgggctcaagcgatccacctcagactcccaaaatgctaggattacaggcacaagccaccgagtccagcctgggctttcagctgtagggtagagccctctgagcgtcaagaacatcatgttgaaagaactagagacatttagtagcctcaggacagtccctgggttaggctcactggggcagattgctgaaggcagaaaacaaatgaaattctcatgaggcccagatattaatgtctgcgtgaagtgtctgactcatgcctttactgcaaagtcctggataaggattaactctgggctggaaaatcgagtcataagactgtcacattcagatccaaggggcccagatcatccaggttatgatgactcattttcaagtggtctggattattgtctataaaaaggagagcaagggtagggacactttttcctccttaaagacttgtcccctttctttccttcgtatgcttgtctggttgaaggctcaaagtgccaccattgtgggatgtttccaaaatgtttaggtttacaagtctcaggcccttgtctagggaggtcaagctgaagtcagcagtttacctaaagagagtacagcatgttttcccacctccaggcacaatctccttggtggatgttgtgacctctgtctgcctggctgtctgcctccacgtaggaataaaagtctctcccagtacctcttacagatacatagccatggcccaatcgctgatacgttccatatctacagtaatttgcagacatcattgtcatcttaacgatgtccctgaggcgtaagcgtttaaaaggattctgagttccttgaaagaaaaattaaacttgtgttcaaggtcatcgtagtgttatagatttcattatattctaattatttaaaaatttaaactgatttgtaggatttaactaatagaatattcatttgatgggaactcttattatattgattataaataaaagtataaatatagtaatatttaatagcatttgattttgaggttttacttaattcgatattgtcgtgtctggaagggacaagtacaggttgagcatctcaaatcctgaaatgctccaatgagcatttcctctgagcatcgtgttggtgctcaaaaagtttcaaattttggagcattttggatttcagcttttcagattaggggtactcaactataaagtataatgcaggccgggcacagtggctcatggctgttatcctagcactttgggagaccgaggtggctggatcatttgaggtcagtctggccaacatggtgaaaccccatctctactaaaaatacaaaaattagctgggcatggtggcaggagcctgtaatgccagctactcaggaggctgaggcaggagaattggttgagcccaggaggtggaggttgcaagtgagccgagatcatgccactgaactccagcctgggcgacagagcgagactccatctcaaaaaataaagtataatgccaatattccaaaatctgaaaaaacccacaatccgaaacacctcccttcccaagcatttcggataagggatactcatcccatatttaaattagagccaaagattgatgactacggagaaacagaaccaagcctcagaggctggcaaaggcagactggctatagctttatctgagtgcagctggagctataagggacatgacagaggaagtacaggcatcatgcaggtgattggattggttgggggtttttttggtttgtttttttttggttttttttcttgagatggagccttgctgtgtcacccaggctgaagggcagtgatgcgatcttggctcactgcaacctctgcctcccagattcaagcgatcctcctgcctcatcctcccacgtggctggactacaggtggcaccaccatgctcagctaattttttggtattttttttagtagagacgaagtttcaccatgttggccaggctggtctcgaactcctgacttcaattgatccgcctgcctcagcctcccgaagtgctgagattacaggagtgagccgttgcacccagcctgattgtttgttttttaatatgtatttcaatctctagattaaattagaggtcttctagttcaacctacttagtttacagatagagaactgaggaccagagaaatctagtgattagtcatgtaacttgcaaataaaagtgccaggacccacagtcaggcctgctgtcatctctgttgaaggtagaatgaggagctttcaccctgagccgtttctcactgtgctgtctgcgtattttaacacctgcttctgttgagcaagtgctgttggtacttttctgtcctaactcaggaacccttcttggctggaatcaggattaaattcagttactgcttcacaaccacctcagcagacatcttaagttgacccaaggttgggcacagtggctcacacctgtaatctcagcactctgggaggccaaggtgggaagattgcttgaggccaggattggagacgagcctgggaaatatagtgagaccccacctctacaaaaattttttttcaaaaattagctgggtgtggtggcatgtgcttccagtcccagctacacagagggctgaggtggaaggatcactcgagcttgggaggccaaggctccagtgagctgtgatcatgccactctactccagcctggacaacagagcaagaccctgtttcaaaaattaaaaataggtaaataaagttgacccatagctattgaaatacaggataattttgatggttaagatgtatttctgtttgctgaaattaattattcacagcctggtggcttctgtctaatcctacctcaaccagttaattccttttatatcacactaaatgatcccatctctttgtcagcaaggcaggataggattgttgccaaagaacaggcttggtagcccatgggcgtgggttcaagccttacttctctttcatgcaaattgtgtcatcttgagcaatactttgtttctttaaggcccagctttctcatctaaaaaacaggaataatattaaatagtagccacctcttcaggttgttgtgaggcgtaaatgagataatacatgtatctaatctgcactgcaaactcagtaaatgttatctgtcactattttagctggagaggactatggcaagtgacttataaacttaagttacacttgcctctctatgttttcttatgctgaggtgaaaaagaaggaatgctgttaaatacttaggacaaaagagtttgcaaagttattcttggaaattaaaagttgtaggctgggcacagtggctcacgcctgtaatcccagcactttgagaggctgaggcgggtggatcacctgaggtcaggagctcgagaccagcctgaccaacatggtgaaaccccatctctactaaaattacaaaaattagttgggcctggtggcatacgcctgtagtcccagctactcgggaggcggaggcaggcgaatcgcttgaactcgggaggcagaggttgcaatgagcagagatcacgccactgcactccagcctgggcctcagagtgagactccatctcaaaaaaaaaaaaaaaaaaaaaaaaaaagtcgtaattaaatacaaaactaaaatctaaaaatgaagtttaaaaaattaagaatttggggattttaagaacaaaaaaaagctgtgctatattcaaccctgcagtccctctccggctccacctgatgtgttgcaaaaatcatcaaatttgttctcaagtgcagtctgcatcatcaaagaacataagaggcaatttactttttcatcatagggctttgctttgatcatgcaacctctgcagccctgtctgtcctcaatttcaagcatcgcaaagaatgctatttcctgcacatctaaacagagaacttaattcaccaatgaatatcttgctttgaatatactcaatagtttttctcaagggtttcagatttcccaaacccatgaaaacagaaaagtcctaattgagacagggttgtgtcttgcaagcaaatctcttctgctgactgtaatggttttctggctttggaggtcccttttggctttttttcttttagaggttttctctctttaggctgctttgcttggaagtggagttcgcatgtgtgccacatccttggacccacagggtgtgctcagctgtggggtgggaatgctgatgtgagctctactcctgtttcttcaaacaaagtttgagattctcagggtttaaaatacttcataagcaatttcagctttatgtggctttttctgcttgaatccagttctactttgagtacccagtgcacaggcattaatagaaggttttatatagaatattctagatttgcaaagaagtaagttggcagccacagataaagtgttcagactctgcaggtttttaaatggccatattgaggaagaaactgaatgaaatggaatatcaaaagtttataaattctcagatttttatgaatctcccattctttaactatgaattttcatcactttagcaaagtgattcttcattagttggattgccagaaaagagagtgtaggggatttgatgatttatccttacaaataattttgggggaaaaaaagttaatgagaacaatatatcttcaaaggcgctctatcagcataaaatgaacttagtttgttaactgacatgcttcactgtaccacctgaaaatcattttgtatgtgaagatttattgggatttttgttttttgttgttgttctattttattaactgtactgaaaatgcctagttgcttttgaagattgaatttcaaacccatttaggagtgataaaatcatcataaaagtcggcaaagctttcggaaagtttagtagacctgagttatgcttaacgagcaaattgtcatgaagattaattcctagctatgtatttctacaagagagttttacaagtctcctttgaaatttggtcttctttagagaaagttccatgattctgatactgttcttcctttctagaaacaagccaatgaccttgtgagcaccctgatgaaatgtacgccccactacattcgctgcatcaagccaaacgaaaccaagaagcccagagactgggaggaaagcaggtatcgggggaaaccggcttaggtggggccgggacctttttccctctgctcaagatgagccgtcctccatcacaggcaggagcagtgtcagttgtccgcacatgtctttgtcatgcccttgcatcttaactttttcaggacaaaagctgtatactgtttcccctccgtgtcatttgctaaaatgttagcagtgccattcatttcagcattagcagtttataatgttgatcttggctagtctgggggcagatggaaaaaaaacaaaacataacctcataccgcagagtcatgatggttttaaaatcagtttgaggttctgtgtagacattcttagtccacccagcccctgatcgggacccacaggatgtggcctagaatgcttagcttggggtggaaagtggagggcgtaagagctgatggaaatacaatccagcatttgctgtgcctcgtgaagacactggggacaagctggaggctctggcattccccctaagcaccgtattgatgagaagaacgactctgggaggaaagatgtcaaagggaaatgcagagcacaagaattcagcaaaccctttctgccctgacttccagtgaagcctgcatcactgttcctcccacagctaggatttagggaagtggcctgggcaggaagaaatggcggcattgaggaggagcctgttaaggtggtggctagagggtatgaattttgtggcccgctgggagacccagacacacattgttcagaggcctgatcccactgtccatagaagcatgggaaggagggagagacttaaactacagagaggaccctagccatcgtcacctagtatcagtcccaggatgggagcctaccagaattgctacctcttgtcttctctcttggagaaaagaaggtaggctcttttaggtgtcgagtgaagagctccaggtttagcttccacaggaagacaaggactaaaattcctagctgccgattatctcctgcgagggacaggtgtgtccattttccttcctgccagcaagatcctaaaccatggcagatagatgatgcctgatcctttacaggaggaaacagatccatagtaagaaaaacacgtaggtcaaacatttactgtctgaaagttcgttctatttaatattgaatacttcggcatgcagtctaagtctgttctctcctctgaagaagccaggctgcttggatgtaagagctgccatcttttcaggccactatgttctgaataatctcatccatagatgcatattcttaaggatttttttttttttttggagacaagagtctcgctctgtcacccaggctggagtgcagcggcatgatcttggttcactgcaacctctgcctcccggtttccagtgattctcctgcctcagcctcctgagtagttgagattacaggtgcccaccatcatgcctggctacttctatatttttagtagagatggggtttcaccatcttgaccaggctggttttgaactcctgacttcgtgatccaactgcctcggcctcccaaagtgctgggattacaggtgtgagccaccacccctgaccgcttaaggcatcttttctattgaatctctgaaatttttcaatttaatgtagtcagattccttctacaatattgtccgttaatgatattcaggcccggatgaggagctcatacttgctaaggtgaccagctcttctttggtcaattcttactttaggaggctgtacagtccttctctaggtcacttttatcctaatcccaggttttcaatctgcgataagaatcattctcattactttgccactggacaccttttctgttagttcgaggtgaccgtcgtgtttctcttgaatcttctcttctacaggttaatccctctcagttccgtcaacagtttctctaggacatgaaatataagcattccccatcttagcccttctcttggaggtacttaatttggcctctgcttttctgaaatgtatagttccgcttctcctttcagactaagagggtagcagcattgtcatctcttctcctctaaagatgtaaaatgcttacacccaggagtttgaggctgcagagagccatgattgagccactgcactccagcccagctgttagagtgagaccccaagtcaatcaatcaatcaatcatacagaaaacatcttgttttgctctcttacattggttcccatacttgagcctgcctcaggatccccaggaggccttgttaaagctgagattgctgggctccatcccgagtttctgatgcagtgggtctcaggtggggcccatgaatgtgcatcttaaaaatcttgcaggtggtgctggtgatgatggcccaggcactgcactttgagaatcactgatctagagcaaagaactagactgtgtcccggtgctgacctatcactaagttgttagagcgagactcttcatctccttagccctcagttccttcctcttaagagggtccatctagaataggatctccttcagtctgacagaatgaaggcttccagacagtggctgtcagtctgcctctgtctctgtcacttttacactcacctctcacacatacccacacttgtacacccacccacacatacatccacatgtacacacacacaacagaacagtgatattaaatcaatatcccaatatgattactccaaccaaatctttagtcaaccttagaaataaaccatgagagtcttggaagcagaggtattgccaaagggggccttagcccaccttcccccatttcaaactctatccacctgctcttcccagcaaatactcttaaatgaaaacatctcacttgccctacaaatgcattttgacagtcttggaaaaagactccctctgcaagacggagttggcatagcctagggaacaactgggcattgtctgatcaatgccccctagcacaccctcctctaccccacgtagatagttctactgaaagcccctctaaaatagaaattttgcaatagctgcttggaagttcaccaaccctgatgctacttccttgtaaaaatccaacataattcattggaatatcagaaaatggagaaattaaatgagtggtacattttattcagtaaatcctcataggatgaggatggtattttctcttttcttttttttttttttaaatgattcccctttgaattgcagcaaagaattttatgacatgcattcaaataaactggttttaagaagttcaaggtattagttggtcgagcgttgatttataattccagtaagaccgctttctgggattccacccttaatcctggtttgggtttattgtgtaacaaatggtttcactccatccatgagtcaggagtgttagggtccgtgaaagggcagtgtgcttcactggctgggattacacacccagttgaagctcctggtaaagagggttactcattccacaagtttatgaggtgtagggtttttcttttcctgttgcaaatgcgtttttgtttggcttctggcaaggttgcttgccctgcattctgaattgctgccttgcagagttgtctagccctgatcaatttgagtaaacggccagggacagtcttggaaaaagactccctctgcaagatggagttggcatagcctagggaacaactgggcattgtctgatcaacgactactgaggaggtgacagtgctccaggaatatgcaaaaatcaacttgtgtcgctttgatgacccccaaattttaaacattacaggacttgctagactcatttctaccagaaaatttcctgatggtggaagttataatgaatgaaacaatgttttaacatgaggaatattccttcctatgtgattcatgggagaggaacgtttctgcttgaattaatgggtgatgcattccctgcctcgaaagcttggcgtgaagccagtgtttatgaaaagtactttaaaatgagcagaacctttaaatgcatttttcatgcatttttctcactagagaaaaggccagtggcgagttttagatttggagggtgagagaaaggaaaattaattatttttcaatttaattacctttttaattgacatgacatttctttctctctctctctctctctctctctctctctctctctctgtctctgtctgtctgacttatatgggcaaaggtggatatttagtacagacggggtttcactgtgttggccaggctggtctcgaactcctgacctcatgatttgcccgcctcggcctcccaaagtgctgggattacaagcgtgagccactatgcccggcttaactctttgcacacagaggctttctgaaagttaataatcttagaggaatcaacatttctggctcttggctctgtaagacccatcaaactggagactcttaaacaccactcccattgtgacatccttcccatcagccaaggttgcacccccacttcgagcttcatctgtccccctcctcctgtcccacagcaccctgccactggcctttcctattcttgtacctttgctttcacagccctctgccttgtcctgtatacctcatggattcaactcgcccctccaggcccaggcacatcacagtgctcctgagaatccctgtgctgtgaaaaatccacttccttctctattctcctatcctggtttacatattgtagctgggaatggatgacgataataacagctttacatgctcgtgctacgaactaagtgctttccatagaaagtactcgtctagaaataaagaatttatgccaccattcctgtttttacagaagaggaaactgagaggcacagagaagttgcatcgtggcagggccagtggcgcagcaggaatgcagcaccagaacctggctcctaaccactgtgctgcctgtgtgggctccagcaggaatcatagcattgtccttttttggtgaccctagcatgttgcaataggcactgtgtgtgactggcccacagtagacatccgcaagtatgagacttaattggaaatggtggtttttgtgagagccttactgggaagacagctgttgggaacctgcgtgacatcggaatgaggatgcttctgattgtcttttcagctcagcagctcctgaaaggcccattttgctgagcgcattagccccgttatcagcacagatatccccaaatgtaccaaacagggagtgtgaggagttacctccctactgcagcacaatcctgacattccatcttcgaaagagagagaccttactttttatgtctaatttgcctcaaataccatgtttccaagtgtctggttcagccagctcgcgcagcacgcagcccaggcccaatttatcttcccagagtggatgatctgaagcaagttttcaggatctgtcggcatccagagcactgtgttttccagcaagtggtgggttttcacaaggcacatgtccgtgctccaccttagacccagcaggtgtactaaaatagcctccccaaggtgcaggcctactaaatcagcatccccaaggtgtggggcatggggcatcttctggtatgaaaatcctcatgtgtgagaatattaacctaatagttctttacatccattttttcaaaagacattgctagatttttactgttaagaaaccaggatgggccaggcgtggtggatcacctgaggccaggagttcgagaccagcctggccaacatggcgaaaccccgtctctacgaaaaaagacaaaaaattacccaggcatggtggcacatgcctgtaattccagctattcgagatgctgaggcaggagaatctcttgaacccacaaggcggagtttgcagagagccgagattttgccactgcactccagcctagatgacaaagcaagactctgtctcaagaaagaaagaaaagaaagaaagtttgccactgcactccagcctggatgacaaagtgagactctgactcaagaaagaaagaaagaaaagaaaaagaaaggaaagaaagtttgccactccactccagcctggatgacaaagcgagactctgtctcgaaagaaagaaaggaaagggaaagggaaagaaagaaagaaaagggaagggaaagtgaagggaaaggaaaggaagaaacacgccgagtacagtggctcatgcctataatcccagaactttgggaggctaaagcaggcagataattgagttcaggagtttgagaccagcctgggcaaagtggcgaaaccctgtctctccaaaaaatacaaaaattagccaggtgtggtggtgcatgcttgtagtcccaactgcgcaggagcctgaaataggaggatcacctgagcctggggaggtcaaggctgcagtgaactatcacatcactacaatgtagcctggatgacaaagtgagaccctgtatcaaaaaaaaattcttgtaagaaagaagaaatcaactaaaactataatttagatatattttagaccatttttaatgtacacacttgaaattaatagttttaaatgcccttttgtaacttgtattagaaaagcctagaagtgtagttccattaagtcataatcaatattaaaatttaagttcaataacaaaaccagcattagcatcatttaattcaaaagttaaaagttctttcctttagccttctgattaaccaatatttttgttcatactctaggtgatagatgggtctttgtgttactgttattctttgaaatagatatgtaatgccctgttatttaattgctgtatttttatttatttatttatttatatttattttatttctgagacggagtctcactctgtcatgcaggctggagtgcagtggtgcaatctcagctcactgcagcctctgcctccctggttcaagcgattttcctgcctcagcctcccgagtagctgggactacaggtgcgtgccaccatgcctggctaatttttttatttttaatagagacagggtttcaccatgttggccaggctggtcttgaactcctgacctcaggtgatctacccgcctcaccctcccaaagtgctggaattacaggtgtgagccactgcgcccagcctaattgctgtatttcaatatttaaaaattagcattatgtcatctgagaggtcagctcagtgtttgaacactataaattgtagtcttctgaatatgtttccctacagcttggaactgggggcttgggggttggctggtaagaacacgagtgaaaggattatccagtaatgtccaggccccattttctcctttgcacagggtaaagcatcaagtcgaatatttgggtctgaaagagaacattcgagtgagaagagctggctatgcctatcggcgcatcttccaaaaattcctacagaggtaatgaactagtgactctggccttttttaaaacaggtttattgagctataattcaaatctatacaattcacccacttcaagcgtacgagtcaatggcttttaacgtattcacagagttgtgcaactatcaccaccgttaattttaggacattttcttaccctgaaaagaaatcatgcttccctttgttgtcaacctccaattctccccttgcctctgggcccagtcagtcacttatctaccttctgtctatagatttgcctatgcttttcatagcaatggaatcatatatgtgtcctctgtgactgacttctttcactgaacataagattcatccatgttgttgcatttccatgcttccttcctgttaattgcagaataatattccattgtgtggatataccacagtttacttatgcattcatcagttgataaacgtcagttgtttccacttcttggctattatgaataatgctgctatgaaaatctgtgtacaagtttttatgtggtcatatttcatttctttcgggtatatgcttcaaagtgcaattgcttggtcatatggtaactctgcatttaacctttgagaggaactgcctgattgttttctgaagtggctgcaccacttcacattttgtaccaccagcagtatttgaggcttccaatttatctaaatccttgccaacataagttattttctaaccatcctagtgagtgtggagtggtatttcatgatggttttgatttgcatttcccagatggcaaattatattgaggattttttcatgtgcctgttagccatttgtatttcctctttggagaaatgtctgtgaggccctttgccattttttaattgggtgttttgtctttttatcattgcattgtaataataattcttttactgttatttattgtagaataaatcagtagccataagtattcattaggctgtctgtttagtgtaacacataagtgcaagaattcttgataattgtgccacaggaagagcggaggtttaacttgactgaataaattaacagtatgaagacaatttcaggaaaatgtttaacccacttaagacaataagcttaaaatatttaacctcaaaaattttgtacaatccatgtataaatttaaacttatttttatatatcccttaacatgtatttggcaggacctatacttaaattgttcttattttgtgttgtttgtaaaaggataaaatgtggtacccttaaaatgttacatcactctaacttctctaatgattctgtggcgttccactgtatttctacatctatttaatttccttgaaggaatagggaaacaaaaaagaagtaagccaaatgtagtgttttatttatttatttagagacaaagtcttgctctattactcaggagtgcagtggtgcaatcataactcactgcatctttgaactcctgggctcaagccattctctcccacctcagtctgcaagtagctagtactacaggcatgcatcaccatgcccagatgactttttacttttcgtagagacagggtctcgctatgttgccccagctactctcaagtgatcctcccacctcaacctcccaaagtgttgggattatcagcacgagcgaccacaccgcgtcaaactgagcattttaatcagaaacaattacatcttcctgatatattatgcaggggctggatataatgtttttttttttaaattcagattgtatataactgaagaagaagttaattactgtctttggaatctagtatttctaataagacagttcttatttagggctgttgtttcttctgctatgagattaggacagccgactcaccatttagaggttttaaaaaagagctaatgattttgtataataaagcgtcagaaactcagtcccccacatttgagtttcctaataaccgtggaggtgagttagactaggaacaaggtttaccctctttgttctctgaattaaagacgtcagtacgcctatagtgtaagcaggactatgtgaaagaaatatttaggaagttgagaaaaggtatttgtagagcttttgcatcacatagcaccacccatttgctgacacacaactgagatgttagttatgagacttccttaaacagatcagtaacactagctcagaaaaggttttctcaacctcagaccactgacattttaggctggaagattctttgctgcgaagtctgtcctgtgtattgtgggatgtttagcagccttcttggcctccacccactagatgccagtagtgtaccttcctctgagttgtgacatccaaaagcgtatccaggcattgactaatgttccccctacagggcacagtcagttgaggaactttggcttagataatcatttttaaattttatttatttatttattttagagataaggtctcccttggttgcccaggctggtcttgaactcttgggcttaagcagtcctcctgccttagcctcccaaactgctgggattacaggcatcagctaccatgcccgaccccaaaatacccttttttaattaagaggggccgggcacggtggctcacacctataatcccagcactttgggaggccgaggtgggcatatcacctgaggtcaggagtttgagaccagcctggccaacatggtgaaacctgtctctactaaaaatacaaaaattagccaggtgcagtggcatgcatctgtaatcccagctgcctgggaggctgaggcaggagaattgcttgaaccagggagatggaagttgcagtgagttggcatggcgccattgcactccagcctgggcgacagagtgagactccatctcaaaaaaaaaattccacacagcaaaggaaacaatccacaaaatgaagagacaacccacaaaatgggagaaaatctttgcaaaccatccgacaagggattaataaccagaatatagaaggagctcaaacaactttgtggggaaaaaatctaataatccaatcaaaaaaatgagcaaaagatctcaagagacatttctcaaaaaaaagacatgctgatggcagacaggcatatgaaaacgtgttcaatatcattgatcatcagagaaagccaaaataaaactacagtgcgatatctcacctcagttaaaatggcttttacccaaaagacaggcaataacaaatgctggcgagaatgtggagaaagggaaccatcgtatgctgttggtgggaatgtaaattagtataactactatggggaatagtttggaagttcctccaaaaactaaaaatagagctaccatatgatccagcaagcccactcctaggtatggagccaaaagaaaggaaatcaggatatcaaagagatatgttcacgcctgtgtttatggcagcactattcacaatagccaagatttggaagtaagctgcatccatcaacagacaaatggataaagaaaatgtgatacaggctgggtgcagtggctcacacctgtaatcctagcactttgggaggtcaaggtaggcagatcacttgagatcacaagttcgagatcagcctggccaacgtggtgaaaccctgtctctactaaaaatacaaaacttagccaagtgtggtgtcccatgcctgtaatgccagctacttgggaggctgaggcgggaaaattgcttgaactcgggaggcagaggctgcaatgagtgaagattttgccactgtactacatacaacctaggcaatggagcaagactgtgtctcaaaaaaaagaaaatgtgttacacatacacagtggagtactattcaggcataaaaaataatgagatccaggccaggcgcagtggctcccacctgttatcccagcactttgggaggccaaggtgtgtggatcacttgaggtcgggagtttgagaccagcctggccaacatggtgaaacctcatctctactaaaaatacaaaaattagccaggtgtggtggcgcacacctgtaattccagatactcgggaggctgaggtggaaggattgctggaacccaaggcagaggttgcagtgagccgagattacgccactgccctcaagcctgggtgacagaacgagattccgtctcagaaaaagaatgagatcctgtcatttgcaacaacacgatggaattggagatcattatgttaagtgaaacaaaccaggcacagaaagacaaacatcacatgttctcacttatttgtgggagctaaaaattaaaataatggagctcatcaagatagagaataaaatgatggttaccagaggctgggaagggtagtgggggaaggggaagggaggtgcagatggttaatgcatacaaaaaaatagaaagaatgagtaagacctagtgtttcctagcacaactgggtgactatagtcaaatataatttaactgtacattttaaaacaactaaaagagtatagttggatttcatataacacaaagaataaatgtttgaggagatggacaccccattttccatgatgtggttattccacattgcatgcctgtatcaaaacatctcatgcaaaaagtaaaaaagaaaaaaaatctcatgcaacccataaatatgtatacctactatgtatccaccccccaaaaaaaacttatcagtccaggtgcagtggctcatgcctgtaatcccagaacactgggaggctgaggcaggaggattactcgagcccaggaggtcaaggccacagtgagttagcctgggtgacagagcaagactgtgtctcaagaaaacaagaaaaaaaaaaaaacctgatcaaaccttttttaatctattctgggtttttttgtttgttttttgagaaaccagttctgaaagacctccttccttctaccttgttttaaaaaccaaccaaccaaccaaactgacttccataaacaatgctgagagtgctgccatctcaggagagcaggaagtctatgcactctttttcccgtctaaggcaggggtccccaactcgcagcaggggaccagtactggtctgtggcctgttaggaactgggccttacagtaggaggtgagcagcgggccagcgagcattaccgcctgagccccacctcctgtcagatcagcggtggcattagattctcataggagcacaaaccctattgtgaactgcacgtgcgagggatctagcttgtgcgctccttttgagaatctaatgcctgatgacctgaggtggaacagtttcatcccaaaaccatccccacaaccccgtccatagaaaaattatcttccatgaatcctggtgccaaaaagattggctggtgtaagggaccctgtgatacgtgcatgaggtgtgaactgactctgttgattatccggatctgtctcgagtgccatgccagcttcatgattccatgctgtactttacgctgtgccgcactctgagtaggcattttgtgaaatttgttattccttttatgttgaggaacttccactgaaatgcttgtatccttggatgcctcccttagctctcctgctgtaagcttttcctttcagaacagacaaatagccttgtctctattgtcaaaaagtaggctcttttattgttgtcatacttttcttggtttgagaatactggggctgggcaagatggctcaatgcctataatcgcagcactttgggaggccgcagtgggcagatcacctcagatcaggagttcaggaccagcctgaccaaaatggtgaaaccccgcctctactaaaaatacaaaaattagccaggcatggtgccgggtgcctgtagtcccagctactcagaaggctgaggcaggagaatcgcttgaacccgggaggcgcaggttgcagtgaaccaagactgcgccactgcactccagcctgggcgacaagagtggaactccatctcaaaaataaaaataaaaaaaaagaatactgggaggagaatcaaagtttggaaagaaattatttttctataaaaaggacattttcaatcccccacactatatttcaaaactgttattgaagcagtccactcaaaagtggcttgaagtcccactatatcagtgggcgggggtatttctctggagagaacacaattttccataagacgcatgagtctgggatcttggtcatgcagaattcatccagagtccaccgccaactgtctcatcctatgatgctctacaagtaattgaaccatctcataactttattttctctaaaggtgagaggaaaggctttgttcataaaattgctctctaggtgtccacagaaaggctgccaaatgagaaacacaaagtaaaagcctgaagggaaaggatatattaatacccagcacaactatccacatctgcatgtattatacaccctccctatataggaagttcacaggcctaaacagagccatggctcacagactacccagagcatagtgtttgcttaggaaatattctgtgtgtttagtgtgtgttcgtttcctctctggaaaatcctttatatttatcaaaaccatccctcttgactgaatattggagagcaaaaatcaaaagatgccttaattcccccatgggtgggccccatgctcttgaagtaagtgctgtgctacttgaagcagtagtaggaagaacccatttacaccatctccccactacaacttttatgccttcagaaagtgttaaaaaactgttacaaatagccatgttgtgtcttggaaaataagttctccagaaaacacctctctgagctaggcaatgtgtgtttctttctgtggttggcagaaataagcccaaatacagattctgatgcttaggaggaagaatgtggtagaaacataacagatttgcaaagtctatcttgtagcatgatttacacttcctcacaagcatgcttcctctgaccttagcctctcagaatgtggggatgataaagggatgcctcatcagcaaaggcgttccacttcacgggcaagagagaaggaggaataggaagcccaggaaagcacggagtggtggagagcgtcctcctggctgccaggatgtttgtgtcctccgaggtcagaaacatccttaatctcaagtgccagcagctgggagtccctggggtcccagctgcatttcctctgagaaggaaacatgggatcagtgatccaagagataacaagagcagggaacagatttccaggcagaaagaggagctggcacaaaggccttgagaggaaatattagcatatttgagtcttaaactgaaaatatgtgatgaaaggaatgtaagctattattgccatctgtccaaaattatcacaggcaccagttaggcaggggcaccattgccctgtgcaacctgttcccatgagtatatcctagagaaagagagtggcctgggtacacttggtaggagaacatgtgttgttggtttatgccctggtctccagtgcgataccaaaggatggggtgaggatgtatcaggcttcatggaagcaaaggaagccccaggcaattcccatgtattgccaagaccctcaacactggaggccttgtcaggataagggagagaaagtctctgcaaggttcgttaccattaaaaaaaaaaaaagagaaacgcagcattaattttgtaggaaaaaatgtgaattgccataaagacccatttccagttgcacgataaatatactttagtttataattttaggttagatcaagccaagcaaaactgtactctcagaagcttgtcaccttgaaagtctatagtcttttccttctcacttctaccctccatgaactttctgcctcacccaattagattcctagcacctactcattttcactaactcccccaatcacatctagacaggttctgctattagtcatttatgtgtagcttaatttgttttaattaacatccttataacatatatgaatgttattcatgctaatgtgtgacttccactaggcattttcatttttaagctttttatctctaattagggaataggaggatttacctctctaggaagtttatgatattatcaggcaagatgcagacatttgagaggagcagagaaggctcctaaaatcacctgagtcgcaaccagctggcagggccactcaaggttcccttctcccttggctgtcataaatcagtctaatcgtgacagtagtttctgggaacaaaggagggccctggcttcgctcaaggcctgggggcctattgcctgggccctggatgtgctctcacgtgggccacgccctccaacttcacacccacacatacccatgatgattctatccatatttgacaaactgtaatgtgtttgtctctccttgattatatcagcctctgacataatagtaatgtttctaacataggcatgtatagtagactggataatctttaaaagaaatatttaaatgtgaaccagtccatggcttttttacagtgccatcatgaaagagacagagagggattcaaatcccatctctgacgcttaatggctaagtagccttgggcaagtcataatttgcctctgtctcctactctgcaaaatggaaaaccaacctgatcaggttgctgtaggagtaagaggagatcgtacatcaaaagcttcaatcacagcacctcatgcagagagagcacccatccgcattagccaggaatgttcattatgactgctgtgtgccaggcacggtttaaggctctggatgtacagcaggagccacacagatgtggcatccggtctcctggagctctcaccttcatctgggaggcataaattaaccaaataaacaccaccgtgaatataactaccaattagagtacatgctctgaaggaaaaatagtacttgctatgagagaaactaacaagagagcagtttttgatttttggtccaagaaggcctgtctgggagtgtcactgaaggtgagacacccaagcgggagccagccgagtgatgagtttggggagcagcacaccagtagaggggagagcaggggcagaggcgccgaggaaggaaagggcatggtgggcatgaagaagaggccattctcgaagaaatgcagcaagccaaagtgagaatgaagaggcgaggctggagaacagccaacgaccagatcccaagggcctcgtgacccagatgcacagaatttcaaaggtgaaagttgatacacagttgtcataatagctgtttagcaggagctttataaaactctttgcattaagtgttaaatgccctgaagaagtcaggggagatgattattgagacaagaccgtttgatttttgcctaaagaccacccctggtggccttccacaatgctattttcagacagtggtagaaagagtacgcaggttttcaccagggtgttgacgtgggaatgctgggaaagggaaagaagcaggaggcagctcgggaacgagcatcccagactcgggatttttgcagtcatcgcagtccacgcctgagccttcgaacgctggtaaacagatgatcagtaactttgcagcactgggcaccttcagagcagagctcttgctgccttgcccgggtagaaaaccagtgcggtcccgcccaagtgtgattctcttctccccaatgtccccacaggtatgccattctgaccaaagccacctggccttcttggcagggagaggagaagcaaggcgtcctgcacctgctgcagtcggtcaacatggacagcgaccagttccagctggggaggagtaaagtgttcatcaaagcccccgagtctgtgagtgcttggctggctctccactctcttccctcccgcggggcccccgccagccctgctccacccctcagctggcttctttttctcattcttcgcttcatgccatcaatgttgtctcctcaaagaagccttccctcccttcctggtctaagtgggtccttccctaaacacctgctctccatagcccatcactgcccggttcatttcctgcagagcactaagcagatagaaaaaggggcatcagagagtggctccttcctcactgactgtctcgctcctctctagctgctacactcctggagggcagggactctttgttccatatgtgtttatatacccaaagcctcacacagaaaatgctcaatagttacttaatctctaagagtgtctaagctaaagagggacttcagtgtcccacccatggttagttgacaccaagtcagttacgcatagtctcaggattcctcctggaaggtgcagcagagtgccgggtgggaattcccaggattgtacctagaaggctgtgggggagcctagaaaggactgtgagggggaaaataggtgggaggagaaatctctggtttatagaacacagtacttaccagtaaggcattcataatacacatttacaattcacaaacagtctgctacagcttcatttagagacacttctttctttcctgatgagagtgtggtcagtgagccccatgaatgtccacaggaagttctgttcagttcttctgcccagtttgctccagggctgcggaataaagacattcattcctttttaagctggagaaactgctggaaccgaggctcagcatcatcgtttctcaaggctcccttaaccatcacaagacctatttcaagagtcagtgatgaacttggcagaaatcagtcatcagaccaaggggaaatcatatgggaactcacagtaaaaagggaagcatttgacttcaggcagatcccagtcttgccattagttttcttctcctctaaggtgggccccatagccactgtttctgcctgcctcgtaggatcagcctgagactcaggaatgataatggctataactgaatggctttgtgagacatcaagattattaaataaataagcggcacacagagatggaacccatttatgacacgtttgtggtagcatttttctactttgagttatttgtagcttcacaagaattttcatttccaaatataaagtgaaaatgttgtgtcattcgccattaagcaacccacagaacagttcctgttctttctaaaatgggatggagtgatttatcggtacaatgcagaactccttgtttcatacccgctgttacttttcaacttgtgaggttttcatatataattaaaacagcctcaatatttgtaatacttttttttctgcttcagttgcgttggagggggttatattcaaaatcaagatttatttttggctgtccttttccttgccttacattcaattgtgttattaccattatttgactctcctttcccccatctttgacacatgcactcacacacgcacaccatcacctccgctctctcccctgccccaaacgcatacatccccatctagccctgacatgcaaatactttcacaaaagttgactcttaaaatctggctgggcacagtggctcatgcctctaatctcaatactttgggaggctgagttgggaagatgacttgaggccaggagttcaagactgggcaagtcagttagacctcttctctacaaaaaaatttaaaattagctgggtgtggtggtacacgcctgctgtcctagctactcaggaggctgaggttggaggatcacttgagcccaggagttcaaggttacagtgagctatgattgtaccactgcagtccagcctgggcaacagatcaagaaagaccctttctctaaaaaaaagaaaaaaaaaaaaaaaggaaaaagaaaacctaccatgtggtttcaccttaatagtaaatgttctgaatatacaaaattacctatttgctttaagaacccacatcataaccgcgcgcagtggctcacgcctgtaatcccagcactttggggggctgaggccggcagatcacgaggtcaggagatcaagaccatcctggctaacacggcgaaaccccatctctactaaaaatacaaaaaaaattagccgggcatggtggcgggcgcctgtagtcccagctactcaggtggctgaggcaggagaatggcgtgaacccaggaggcagagcttgcagtgggccgagatcgcgccactgcactccagcctgggtgacagagcaagactctgcctcggaaaacaacaacaacaacaacaaaacccacatcagacaccatagggtttgtttttgttttgttaaatgtatccatgtcttttggcttttctcatttaaggttgttttgtgtgttttcctgttgttgttgtttggtttggtttggtttttattctctccttatctgtgttatcaaggttttttcttgaacctccctaatttctaaccccctgggcttttaaaaagaaatctaaaatccagcgaatctttgagatagtctctaggaagttgggaatcgtttgcctgttcatcctttctctgagtcacaagtgtattttctgtgatacgcccaaaatagttctgggaaagaagaaggaaacaagacttactcagaaacccaatacacaagataagaaatatcaatggatattcttacaacaggcaactgcagggctcagattttaaacattctgtccagttgctaatctgtgcattccacttggggtttagaaatctgtccttatgcctattgtttacagcactgaagccaggggaattacgtggcccctcccctggtgtttggagtttgagttgttgtttctgcacagatggatctgtgaggagagaagttgagtggcaggagaggataggtctgtctcccaagcatgcacccggataaacagagacaacaaatcaagcccagctgccttcaaaccacattggcttgtttacttctggaacatttttgcaatgactgttcatcatctttactttggatttttattggttgattttatttttttcctagagagtcatgtaagccactctcaaggtaaatgagaaggtttcctactattttacaagtggatcaagtgcagatttacagagaaagctttgcgtgtctaaatgaggaggagcctggcagagcctgaaagacctaggttcactttctagccccacccagtcttagttccaatgttctcatctgtaaaatagagatgacagagtatgcggctcatgtagctgtggaggcgttgaatgaaactgtgtggaaatcatctagggtgacttctgccccatagtgggcactcggctcactacagctgtttgctgtcacctttatcattccaaggcctggttgaggcgcagctgtcagcattcattggtaaaatggccggactctcaagacctgctagaggctgatgtggtccctaaacagccccagcctttctgggcaaatgcaagtcctcattaacacacctcacgtccagctccagtcactgtggttattatcctctgctccgctgctccttggtgaatcctgagattggtgaatcctgagacaggaagtctatattttcttggaactgaaagtagggcagccctccttccacagcagcacaagcccagctcctgcagaaactggaaaattctgtttagaggctgcatgcagaagtgccgcgccaaacaacagcaacagcctccacccactcacttgatctgacttcctaataatatactctttggatcaaggtggggaataagtggagaagcattgaatcgctcattcgattctcacagagactgtagcaaggcaggacaaggtctaactgaatacactcagattctcctatttcccattgttttccattaaaagaaaaaaaggtataggtcattttatagtgagaataaacaacatgccacagtaagcgtttcacatattcgttcatgaatcagagaagctgcttcccgtgtgtgtcattgtctaaactgagggtccctggaataacaagaaaagtgttgttcagggattggggcttggggcttggctcacatttgtcttctctccattcacagctatttcttttagaagagatgagagagagaaagtatgatgggtatgctcgagtgatacagaaatcatggaggaaattcgtggcccggaagaaatacgttcaaatgagagaagaaggtattttagcaattttgtttcattgattttaataaatctgaagagtaaattggagcttaagtgaagttttaagttccattttattttgcatataatgtcacgctaaaaatattgcatcatttagagtttctttgtatatttccacagtattttcctcccttttctgactgacttatccttcttccatcttgaccctcttgggaattgtagcctcagacctcttattgaacaagaaggagagaaggagaaacagtattaacaggaactttataggggattatattgggatggaagagcacccagaactccagcagttcgtgggcaagagggagaagattgatttcgcagacacagtcaccaagtatgacaggaggttcaaggtacgtgctaactgcctgcctctgagatcaccaaacagattccttatttttttaataacttgttattttgcttttgttgttaccaaatcagaatgtgttcgttgtagaaaaatttagagaaaatacagtaaaccaaaagataaacaggcacctatgcccagaaacattcactgttaacattctgtgtatatccatatctttcagaatgtttttatgaaaacatacatttgcgtatttagttttacaaaaaatgagatatacattacatgctgttttatgtcctgaagtggttttttgtttgtttgtcttttaaataatgcgagaattttcgatagtaatacagttagcaatataagttattttacatggctgcatagtattccatttgacagatgctttattatttttaaccagtttctcatgaatcaatttttagtgagtttttcttttttactatcgtaacttcagtgagcatcttttcacacatctttgtgtatctatctgtctcctaatatttttagaagaaattgataggagtgaaatcgttgaatcaaaggattcagagtatcaagtaatattgcagagtatcctcatccattttcccagagtggctgataagtaaggcttttccagccacaggaggaacagttgatttttcacctcctcctttagataccttttgataaagtcttggtcctaatagaaaaatctgaagcttcagaagctcatggacccgttaagagcttttggctttttgccaggggcggggaggtcaagaaaaaaatttaacgaaataaacaacggaagcatgttttgctaaaaccaaaccattccttgcaacctgtgcatggcaccagctgctgtgacggcagccctggatgcacacaggggtgcttagctctcgcagcggtactcattataaagtggttacccacaaattcccaagtagatttctattagattattgagaattatcattcaaatgacaatatatcagtattttagaatgaaaattttatgaactcccaagaaaatatatgcagacactgccctctgtttagaaacatgctgtagtgcatccttgctaagttcaccacaggtgttggtgactttccctttacacctgctgtcctgatatgtgaagtgactccatatgagtttgccagtttttaagtcaaaaagagtcaaatgtcatcattttttacatgtcatcctaataatcatgaacaatgccctctttcactgtcatggggcccggtcatgtgatgaatggaatggcctctcaacagtagtgaagattgactgtccaaggcagcttccccctgtcctggtaacagcagtccactgtgtgaattgttgtcatcacattgaccatgtctgtccacctttttttgagacggagtcttgctctgtcacccaggctggagtgcaatggcgcaatctcggctcactgcaacctccacctcccaggttaaagcgattctcctgcctcagcctcccaagtagctgggattgcaggcgcccaccaccacacccagctaatttttgtattttcagtagagacggggtttcaccatgttggtcaggctggtctcgaactcctgacctcaggtgattcacccgcctcggcctccgaaagtactgggattacaggtgtgagccaccatgcctggcctgtccagcttcttaaagctcctctccttacagggtgtaaagcgagacctgctccttaccccaaagtgcttgtacttaatcggacgagaaaaagtcaaacagggcccagacaagggcctggtgaaagaagtcctgaagcggaaaatcgagatagaacggatcttgtctgtgtccctcaggtgagtagtggaggtgcagaggcaggactgccccttctcgcctcagcatcacggtccgctgttccaaacagccaggaggaaggccgggctgggcttcccagctgtcaaaatcatgatcaagagaatggaatttccctttgtcccaaagggaagactccctagtctcagcaagtcttgatatgtcaggaagaaggtaccaagaaaaggttgcctccggacagctcctctaatcaagggggacccagatctcttgtaaccgaaacatgttagaaatgaacccggtatatggaacacctcagagaataatttctcttgttgcagtagagccaaggattcagagccctgtcccccagtccacctcacccaggttggaggcctcacccatttccctgagcagagggtcctgaaagggaagtttctttgggacttccttagggagtgcaagttggtctccattctctgtagccctggagtcatcgtgagatgctctcttcgctccagttctcaggcagtggggagtggtgtttgcttccacaaggcctcaggaagggcccttgctcctcccggcagcaccttggcttcctctcggcagaagggctcctctgccggccgtcagcatctcctccgtcagtgggacctaggctaggggttcttagcataggaggtcttcccatgctaagaagtcctcccatgccaagaactcccagactaggagtcctcccatgctaagtcctcccgaagtcctcccatggtaagaactcctagactaagttccgctgacacaggaaatcctcgcaatccatgaagactaagaatggaagaaaggcctccttgagccccatagcttcctccaagaatcgtgtccctgggcctctgaggctaacactactttaatcaggaaaagctttgggcctttgcattaaagatgttctgctctcacatgaacatggaattgggacgcctgtcaaactcttactccacacagaaggcaaaactggtgcgctcaggaaaaagcaggggttttatgtgctcaggcgtctgatgtaccaagctggaaatcctagttccagtctgataatccaaaacagatttctagttgcatccattcttgcctgtgtctctgtggtttctgattctatctgttcctaatttccctggataaagggccaggcagtgcagtgcagtgaagtatttaaaacgtgccaactcaggatgtggtaaagttgctaagcagatgagtccgcagtgtccattttgcagccccacctcaggtaggtttcaaggctattgttttttttgttttttttttaaagctctaggcgctgactgattttctgaaggccttcctaaacattcagctcactggctgggtcccaacctgagcggggcagtgcctgctggccacactcttcctggctagctgggccctgaggctgccgtggaaacccaacaggaagctcctgctttgtttgtcattgcatggggccctgccatgcctggactaagccaggttggccacagcgtgcttggcaggcacagcaggtgaaagtcagggaaccacagctctagggtgtgtgtagtcgctgtgccgagagtgacttgttctttctgttattgcccaggtatgtcttcagtccctcagacccctggtggagtgctcatgactgggaccataaattatcctaattgagctacatttgtgtggttgttttgttttgttttgttttgttttgttttagacagagtctcgctctgtcacccaggctggagtgcagtggcgtgatctcagctcactgcaacttctgcctccctggtccaagtggttctcctgcctcaggctcccgagtagctgggattacaggcctgagccaccacccctggctaatgtttgtatttttagtgagagacaaggtttcaccacgttggccaggctcgtcttgaactcccgacttcaagtgatccactcatctcagcctcccaaagtgctgggattagaggcgtgagccaccgtgcctggccttgagctacacttgtatcaagcactttgacacttactatcttattgataagtccttgagggggttgtcaagcagggactgtagggactgttcacactcaaatttcttccttttattgttttttgtttgtttattgtcttcttttacagcctctggggatataatctgtcatgggagcaccagcttctttttcttcttcctgttcagtattcattatctggaaggttcctttcttgcggtctttcctttttaaaggctgtagtaaaatgaggtacttagcctaaaagtttttctgactctaaggaaaaaaaaagaaagtgtgagtcatttgaacttgtgatgtctgtgtattgcagtcactgaacctcacacttgccaagatgaataatagtgtcccctcatttctttatacttgagttaggccagtaatcagaaccaagttaggaaagcaaccagagggtgatgtgtgtgcagaatcgaacccagagtggaaattaattctggtaccagactactgaacatgcgtgtgtgttctcaaaatacttcagtactggcatagagaaagattttaacagttggcttgtacttcaggaaaaaagctgcaacatctgtatgtgtttttaagaatttctgagattgaccagttgactattggctggaatgatatcaacatatggcctcctagttacgatttatcaaagtatcccataagcttgatcttagcccatctctagctcttacaattaatgtcagtgcacagtgggcctacagctccctattcaaaccaaccaaccattcagtaacagttacaagacaacatgtgagcatgactaaatatttggtatgaagaatttattgtttatttctgtaggtatgataatgttttgtggttaattttaatataaagagactttatcttttaatgatatgtactgaaacatttgagcatgaaataaaggctgagcgcagtgacccacgcctgtaatcccagcactttgggagaccaaggcaggaggctcgcttgaccccaggaggtttgggacccacctgggcaacatagtaagaacccatctctacaaaaaatgtgaaaattagccaggagtggtggtacgtgcccgtggtcccagctactcaggaagctgaggtgggaggattgcttgagcccaataggtcaaggctgcaatgagtcatgatcataccactgcactccagcctggtagttattttaaagtggaagcagggagagtgaggttgtagataattgtgattatccgtgaattggtgcttgaaatctgacatgtggtggttcattctatactactttttatttttttgagacggggtctcactttgccacccaggctggagtgcagtggcgcaatctcggctcactgcagcctcgccctccaggttcaagcaatcctcccacctcagccccctaagtatctgagactacaggcatgtacccccacttctggctaatttttgtattttttgtagagacacggtttccccatgttacccaggctggtctccaattcctgggctcatgggatctacccacctcgcctcccaaagtgctaggattacaggcatgagccactgcacctggccctactatcctacttgtttacaatttagaattttccataataaaatgtttttctaatcctccagtagatgttaaatttttagaagtctttatcttttctaaacatacagatatatgtctagttgagttacggttaaaaatttttttgaagttttcatttacaagaaaaaataggatcccaacaggtagaaatagggccaatagctcagagagatattaagacaatagtttgtcaaagggactccaggataatttgatcaggaaaaatccttatttaaataaaaattaggctgggtgtggtggctcacacctgtaatcccagcactttgggaggccgaggcgagccgattgcttgaggtcaggcgttcaagaccagcctggccaacatgatgaaaccccctctctactaaaaatacaaaaaaattagttgagcatggtggtgtgtgcctgtaatcccagctacttaggaggctgcggcaggagaatcgcttgagcccaggaggcggagggtgcagtgagccaagatcacaccactgcactccagcctgggcaacagagcgagactccgtctcaaaataaataaataaataaaaattaaagtgaaacactgacgcttgcatttctggcttcattggagactcgggaagagtgtcaggaggtgacacaccaatacagagttgagacacgggatttctgagtgtatggtggctgctggcagaaggccatgcctgggtttttgaaggatcctcccagagttgcttcttgttcaagtactggcctggccccactcttatttgaaaaactcaattgcaggaagggtgaccacaggtgtaatgacccatgttcttggctttgctattgtaggtgttgagttcggtgccatggaagctcttatttgggggtctctgatgaggcttctcatttttcttctcattctggtggctgatcaccagaaggatgagaccaaaagttgtgtggctgtctgtctgggttaatagattttccagtacttatctccaattggaaaaacaacccgtaagacggtgcttttagacagaggctccagctccctggtcacaacattcttgcccagaatgtctccttgcctgaatcccctaaactttctggcaataaaaacagcccacttcactgcctgtcctgctgacctgaagcattactggcatcttgacttgctatggtctgtaagcattgggaacctggaagttgtcaacatcatgggattgagcacctacctggtgctgagccctggtattcgaaggtggatgaggcacagtcactgcctcaggaagctcctctcattctggaagggggaacagacagctgagtaaacatgtgccttactataagtgttcccagcgtgatttaaaggatattcctgggacacaagagaggagagtgggtctttgcatctgcgggtcaggtgaagcttctttgagctggacacgtcactgctgaggcctgcatctgcgtccgggctttctcagagaagttaagaaggttctgaaactggtgccactggtttctctgagtggtagaattctgggcaaggtttattttcttcttgattcgcctccgtatcttccagtttcctaaaagcagcatatatttcataatcaggaaagacttttataaaagcttaaataaaggcagggctatccttggaaattgccttttcagctttaaaaaaaaaaaacaaaactccttcaggactttccttggtgttttgtaactaacatttctgtgaaaagatatattggtgaagagagtaaaacagattttctagtgttttcagcaatacaacagtaagccgcaaagacagaggaataaaaaaacaagggcagatccaaaccagagactaggaagaggtctttcaacacagcttacagcgtcaaacatctgtaaggaattgcagcataggaataagtcaggggtgaagtccaaagataagtctgactttttagaataaataaacacgaaagctttgttttcaggttcaggagcatgggctaaggagagcagaatgagctgagaccctggcctgggtgaaggtggtctgcctagctccaatgcctggatcattgaagggaggggattttggagttgttggttaaagtcaaagtgtccaaacacatctcttctcatttctagattcatgctgataattgaccttgaagttttggcccgcttgcttttttcgttataatagtaatgaaactcctaataaatctaagcacattaaaccactcaaggtgacttgtgttgggctcatttagccctgttgaataatcaccatcctgccacagttcagccaggccaccaggcatgaccagacatgccaaagaaagctttgagcaaacaaccaaaacaggaaggcgtttcattcctcaccccaaaggccaaaaagtggagcttcttgttttactctggtcttttgcatgcactctacctaatgcagccgggttcttacacctgggctagggtgccaggaggcttagactttattaattcaaaatgacttggaagagctcttttgagcagcttttcataagtgctttttggggttttagattgctggctgtacctttaaaggtaagtaggaggtgtttgttcccaggcactatggaactggcacgttggccctgaattgcctttgcatgagctgttgagtgacggagatgaaaaccgtctattgtttaaaccactgcttgtcagggtttatccttgatcccaactatcacaggagtgggcaagaagcatggctatgatgtgtggatgtctgaaaacaaacatctgaggtaatgataatgaccaagtgttccacccaaatggctattatttgtccaaaaaacactgtaaaaggttctgactttacgtccaagggaaactctttggctgctcttcagtaagctggccatgaaaggaccaagctcctttcccctgacactggcctcttgcttccagtgaactccattcaccgccccgccccacccccatggtttgcgcgtactgccattctacgccttcctatccaattgtgctgtggttccttcgacctctttttctcctgtggattaccaagcccctttcctgtaggaggactgaaagtgggtaatatgtaaacagtaagaatttaatttttacagttctagagaccgggaagtccaaggtcaaggtgcaggcagatgtggtgtctggtgaaggcccagtcttttctttatagatggcgcctcttgttgtgtcctcacatgggagaatgacagaaagggcaaaccactctgtcatacctcttctgtaaggtcactaatccaattcatgaggacctcttccttgtaacttaatcacctccttaaggccacacttcttaatactagcacattggtgaatgagtttcaacatcagaccaaggtagaggctgtggctacagctactggctccatcagctctgggtcactagctccctgtctcagtctggagagaaggttcctgacaagcctgagatagtcccccaagattctctgcccaagggagccctgtcattccaagaagggcccaacccctaccttgacctgtgaatggggctgaacagggataccacaggagtttccttctaaatggatcagattttacatggaagaaggatccagggtctcaaagattctccacagctcagtcctcttgtgatccccttgcctcatcatctggctttgtcacagccacagtaatcccactggtgcagtgacaccaggtgctctgagagcagagcagagctcctgagtgatgctgcagggctctggatatacaaagaaccgtgtctgtggcacttggagagaataaaatgttaccatggtcaattcactgaagcaggtttgcctaatttgtttctaatgcctgggaaaatgcttacaatccctaacgaaatctcattcttcaaagggttgtctttgatatttggcagtggtacttggagatactcgtaaacttatatattatagtctttggggtggtggccccattcacctgagtgataaatctaacagggaatgcaaattctcaattacatacatgttgttgctttctaccaagcctagccaggcttgaagatggaactttgtctcatcaacctcccctgaccagcaagcgtttcctcggagctgggtctgcctcagcgtctctctgccatcaccctatagcttgtaacacctgctcccctccaggcataaatttctccacaatcccaccctgtccaaacatgcagttcccgcaaaggtgtgttctttccttgtctgacaaaattcattagcttgaaggtgatgatttttgcttgtttgctgtttgtccattctggccttcgcatctctgaacttggatgtgtctgtacgttctagtagctcctggcctacagtgtccacagagcactgtttgccagaaggttcctaataagtaccttgaagtccaggatattggtttccctcttgagaaccgagcttatgattcttcaagttcaaatttactacaatagctataaccatatcataaattatactaacttggaacttaaatgtagagtcatcccttttcaactgcattctattcataactttctggatttttatgatcttaaaaacacaagttggacttgaaaatggatttttttttaatatgggctaaattgtccttaagttcctgattgtaaaaatcatgtggaaaaagtactttgatcatgcttttgttggactataaaccttctttgaaagcagatttcagcaatttcattatgtaattcattgttgttggttttgtttgaaagattattacttatagaaagaaagactgtaaaatcttagcactatcttgcaggatttttaaaatggaagaaaaaaaaaacaatagagtaaacagaagcacagctttcaccaagtgtgtttgtccaatctctttacagtactatgcaggatgacatttttattctccatgagcaagagtatgacagtttgcttgaatctgtcttcaaaactgaattcctaagcctcttagcaaagcgttacgaggagaagacccagaagcaactacctctgaaattcagcaatacgtaagtccggatctgggacccagacttctgcgtgtagctaaaaaggggtcttgatcgcacccctgcgattcaggatggggctggaggaggcctgcgaggagaagagtggggtctggctggccccagtggaaccttagagcctgcagaagacagtctggatagtagtcacagactttgaaaaggttacttttgcatttctgtgaaataatgacttcatagactagtgtattttatcatttagacaaaaatcacctgaatgaggcagacaaaggcagatttttatgtatcacccaaaaaagggtttttttaatttaggagagcagacaggagtagaatcacactggaagcagataaaagtgacagaggtgggggtttaaattccccaaaccaatgcataataaaacctgtttattggtagagcctccgggggcttgaggactataggtggccaacgtattgtgtaggtggttcacctttctttctttttttttttttttcttttttttttcttgagatggcgtctcgttctgttgcccaggctggcgtacagtggtgcgaccttggctcactgcaacctctgcctcccaggttcaagcaattctcctgcctcagcctcctgagtagctaggattacaagtgctcaccaccacacccagctaatgttttcttatttttagtagatacggggtttcaccatgttggccaggctggtcttgaactcctaacctcaagtgatccacccgcctcggcgtcccaaagtgctgggatcacaggcttgagccaccatgcccagcctcaccttcatttcttttggcaacatgatctaatggaccaggtactggctggcatactgttgaccctctaatctcatatttgctgagtaagagttatttagctagtctgggcaatatagtaagaccacatctctacaaaaagtaaaaaataaaaaaaaaattagccgagtatggtggtgcatgcctgtagtcccagctactcgggaggctgaggtgggaggatacttgagcccaggaggcagaggttgcagtgagctgagaccgcaccactgcacgccagcctgggcaacagagcaagaccctgtctaaaacacagaaagaaagttatttagcttttctttttaaatttccccatctataaaatgggaatatcctccatcttttcctagctacaaaaataaggccaagacaaagcctttatatcatgatgagggaaacttataataggcagctacttaaaattatgatttttccttcttatgatatcagaaaatataacttaaaaacagaataaggattgcataatacaggcatatatgcaatatagaagcattaaaactggatggggagtttgggaattgcaggtaaatcctgccttctatttggattttggttgctagtgtgtgtctttttccatccctgggtgggctgtgatggtgcaagaatagtacaggactaaacaaagccaggttctatgctagagtcctcaagctggcctgtgtctggcatctctcagtcctccacaagcacagaatcagggacaacagctggaagcacaatgacagcacagcggtatgacctggaaattgtctctttcctctgtcccctcagcaggcgcctctgagaccacctgacagagtggcactggcacattagccaggtgtacctccctcaccacctggtgtctcacggtaccgggccccagatgctcctttttctggctcattgtcatgcagcgacagtgccaccccatggatgcggtgcgcatcctcagggccctgctcctggtgtagattgtccgttctcgcctcatgtttatgcttttccagcagcagaactccgtggcgggatctctgagcaccgttttctcactgcgtccttcgacctgttaaccccactgtgctttttgcaggcttgaactgaagttgaaaaaggaaaactggggcccctggagtgcagggggctcccggcaagtgcagttccaccaagggtttggggacctggctgtcctcaagcccagtaacaaagtgctgcaggtcagcatcggacctggactgcccaagaactcccgtaagtgctccacgggccctgcaggcagaactgccgccgctcccccgagtctcccgagcaaatgctgcaaacatgtgcacagatgtgggggctgagaatcagtacaccttctgcttgctggggctcacgctttcttcagaatggaacatttcaaactaaagcaacagcaaggaaaatgagcaggttaaaagtttctgagggacttagtacttatgtatcagtacacctggcattacaatattgtggttaaaacaaatcaaagtttgttagcttcaaatttcccctccctttccagtcagatcttgtccacaataccaacatcatcctctatgccacctttaaagaaattgactgggcccggcgtggtggctcacacctataatcccagcaccttgggaggccaaggccggacgatcgcttgaacccaagagttccagaccagcctgagtaacatggcaaaaccctgtctccacacacaaaaataaaaatgtaaaaattagccaggcatggtggtgcatgcctgtagtcccagccactccggaggctgaggtgggaggatggcttgagcctgggaggtcaaggctgcagtaaatcatgatctttactggggtgccactgcaccccagcctaggtgacagagcaagaccctgcctcattaaaaaaaagaagatgaaaaagaaataaaacaccatacacacacacacacacacacacacacacacacacacacacacacgcactacctcaaaccccagtctaactccttccctggcctttatttttgtatttataattgatatttataaacttatatctatagcacacagcatagaataatcatacatgctatgtatgcatatactgtgatattgttctaagatttagcctgtgtgtgatcacacacatgaagatgccttatataaaataactgtttctaggccaggcacggtggctcatgcctataatccctgcactttgggaggccgaggcaggcggactacctgaggtcaggagtttgagaccagcctgaccaacacccagtctctactaaatacaaaaaactagccaggtgttgtggcgtatgcctgtagtcccagctacttgggaggctgaggcaggagaattgcttgaacccaggaggtggaggttgcagtgagctgagatcgcgccattgcacaccagcctgggcaacaagagcgaaactccatctcaaaaattaattaattaattagccatttctcaaatctgtctgcaaaggtacaccttaacatgttctctaacatattaatacaataccagcaaatgccatcatatctttatatatgtagagccactcagaaaatgttgatgtatgtctgtgtatccgttagtacttgcagaaaacagacagcaacttttggagggatttctgaagcgatttttcagtgaaaagatgtggacggggtttagggaacaaagtagggacccagggaaagggagtggcaggaaatcattattatccgcaaacctgaagcagcagagggaggaacgaggtgaactgaaggctacagtcaggaaggaggcacatgaagtcccccacctccctcctgacactccagtctccttccagtgcctcctgttggcctggcctataggcctcaccccactggaaggcagaggcctggctgtccacaggactcagaccccagggcacagagccgggcaaagaaaggctgcaaataaccagcaggctatgtttgtgcggcgggcccccgaggggaaattgcccaataggtgttggattctatcttatttggggtggcgagagtggcctaggtactgggagggaagcgtccagcaggccacactgggtttgccccgatcccacgtggtcggttctcccaggccctagagctgcagctcctttgctgtgtttgcactgtgcaccttgtcacctcctacccttctctattcttcagctcttctctttataagaaattccctctgcacccctcttccagctggtttaatcctaccttccttcctgttccattcaagaccctattgtttttcttccccacatagatgtctctgcagagatctcctctggctcctctggccctgctgtccagccctgactgtgacccacagtgtgttcctttggccccagcttgttcctcattccttcatgtctgtgtcaagggtacaagtctgcttctcctccttgtggtctgtgtttagttcaaggaccgtagaacacacactcttgcgtgcaaggcgcttgacgtaggcaggtgtgcagtcagtgccagaacgggcttcatgccaaccccgttgatccgcagcattagtgaacctgctcagccacttagcatttagaacatgaatgcaaatgtttaaatgttccatctgtctcttttaaaagtctgtaaaaatagaaacacctttgtaagatgaccaatccttctttaagaaccactgtctctaacatttcaaaactgtacctctataaccctgtcctccagcccctcccacccaatagctaccattacatacttccctcaacggctccttctccactgcaactgttctcctgcagatccacctgagagctggaatccaagcttctcaaaaattttccatatgcaaagaaccatgaggatccataaaaccaaccagtagcactggttttaactttgtcttgtttatttcaggtcctaccagaaggaacactacccaaaatacaggttattccagtgggactcaaaatgccaactacccagtgagagctgcccctcctcccccaggtaagccagctacgtaccgtagtctgggaccactaaatctggacccataacttataaaatatgtttgggaagaaacccattagcaaatcaatgcacacatattaaccaggcatggaccatttcagtgccacatgtacaacacagcagccctacttgagacctcaaaattcagaaaaataggagtcagtgagactgaactgcggctgagtttgcaatctggatttcattacctcgaaatattactcccttaggaaaggcttctgacagagagaaaggagttccttgtccgtaacaaccagactgttgtcagcttttaagacacaggatgctgctttatggaaataggagtttacaggtctaaccccaccaccactacccagctccggccaaataccactacagcagcacccccttatcctcgggggatgcattccaagacgcccagtgggggcttgaaaatgcagatattaccaaaacctatctatacttttccagtttgagttttccacaaaaccagcagaaatttttttctgtcttcacagtgttacagatagaagatatattgttactgaatttacttaaaggaagcgctttcacttaaaggaagcgcttaatggcttctctttggcatacccaaattgccagcttcctggggccattatgaataacaagatggctgcttagtgactgatgatggggtagcacacacagcatggataggctgggcaaagggacgattcgtgtcctggcgggacagggtgagatggcacacaacctaagccttaggaattgttcattcctggaactttaatttaatatttccaggccacagttgaccatgggtaactgaaacagtggaaagcaaaatcatggataaggaggggagggggctactattttgtaagttatagcagcttaatgactgaatagaagaaatctgttttctatttattttctgagattaggattcaggaggcctgttcaaaaaaacaaagtaatatctgagagtattacaaaattgttataaaatttatgctcatatttcatatttatctcttctttttttgggatggggtctcagttgcccaactggagtgcagtggtgccatcatagctcactgcagcctcagcctccctggatcaagtgatcctcccacctcagccccttgagtagctgggactacaggcacgcaccaccacacctggctctttttttttttactctttgtagacacggagtctcactgtgttgcccaggctggtcttgaactcctaggttcaagcagtcatcccaccttggcctcccaaagtgttgggattgaaagtgtgagccactgcacctggcctctcatttttaatagtaaaaatataactgacatatccagacactctaaacctgaatctaagattttctgtctctaaaaatctgtgtagtgtttgcagaatgcttgcaaaaatacataaaatcttttaatgtttttccatcactcacaaaattcagttcataaaaaattactcccagagtgtttggtattaagcagtttagaattctaagtctgatagggtcattttgagactgtatttgattccagtcttcccagccaagagaattctatttgtaccaatgtccaagataaggagtaaaaagcatttcttgaggctggtcatggtggcttacgcctgtaatcccaacactttgggagaccaaggcaggagacttgcttgagaccggaagttagagcccagcctgggcaacacagcaaaaccccatctctacaaaaatgttcttaaaaattagctgcagccaggcgcagtggctcatgcctataatcccagcactttgggagaccaagacgagcagatcacttgaggccaggagtttgagaccagcctagccaacatgacaaaaccctgtctctactaaaaatacaaaaattagccaggcatggtggtgcacacctgtaatcccagctactggggaggatgaggcacgagaattgcttgaacccgggaggtggagattgcagtgagctgagatcacaccactgcactctagcctgggtgacagagcaacactctggctcaaaaataaataaataataaaataaattaaaaaataaaaattagctggacatggtggcacatgcctggaatcccagctactcaggaggctgaagtgggaggctgaggtggctatgatcatgccactgcactccagcctgagtaacagagtgagaccctgtctcaagattagctgggcgtggtggcatgcaccagtgattccagctactcacaaggctgagacatgaagattatttgagccggggaggcagaggttgctgtgatctgagattgcactactgtactccagcctgggtaactgagtgagagtctgtctcccctccccatccacccccaccttccccccagaaaagggcatttctttagtctctggaatctcaccattgcatgctaaagtatggacactggggcccagcagtgagaaactaattctcatctcttttggagtccccatcctgccttgacccggctctgtctcctcctttcttctttgaagaaaatccaagcacaaaggaacttaagagaagcactgtagtatcatattactgcgtgtgcgctggttccagtggagaattctggccaagtccacctggaaagctcactggcctcagctaggttggccaaagtagcctcagatcaaatcaggccacaaagtttccgaccttgagcagggctccccaactctctaaatgacagttccttcatcaaaaaaatgagacaatgggaccagatccatttgaccagcacttctcaaactgtctgtggtgaaagaccaggagttttcagggggttttaaaaaatttccagtccgtcacaaaccatgtatttgtatgttacaataaaaatgaattagtagaagaatggaattttcaaaacatataaaatataagccaaaatgtcttattataagatgcaacaggcatgaaatagatctgtcaaactgccatgaacgtttctaaatgcttactcttcatttctgaccttatcgtggacaaggggatctcgagcagcatgtggagcagcccctgtggggaccccacttttatcactggccatgtgacatcccgagggcatgtcacactcctaagatgcccctctccttttgttgggaccctaggcagcaagcagggtccttctaccctccccatccccagaccctgtgggagcccattcagctctcactcactgagggaatgaggtaagatgaagagcagctgtttgccccaaatgtctagttctgatctggtctgacggcctgtgggaggaaattgctagagacatggctggatgaggagccaccctcttgaaagctccaccctgataaaaccgtggttcaaagtaagaattccacctattattactgggcatgaaatatttctgcaataataaggatatagagaaaatgcttgtcggagctggaagccaccaagcagattctggacctatctcgtggttctttcatgaagaactgagactatgaaagatcaactctcttgctcatgatcagtatagctctcagaggcagagccagaactgaacccctaatcctttcctaagggtcatcccactggtaccaaagagttctcttaatttggttggaagaggtctttaggtagggttcaccaaagtgggccttgaagagtcttgttctctttctccactcagcccagatctgtcagtgggagaatgaataagggcctcttcatacgtagcatggaatgctaatgcccgagtctgccaagacgcatggtttggagcctgccactgtaacccattacttattggctaatgcgattttaactagacatcgctgtttggctgagagagcttgctccatccggactgatccaactgggtggccacttttcccttgcctgtgtagagcaccccctctgcctcacacagcaggctcctgccgtggatgcccaagattgacccctcgaaaatggatgtccagctgtttaagcagctgcctgtcagccctcttgagtcataatctcataatttttcttaggcccaagaaggtgtctcccagccggctgtaagcttaccttactgtgggctttgaaccccaggaaatctggggattctattgccaccaagcatgtgctgagtgtccgctgtgttccgggcacatcccgggaagttgaccatgcattgttgtacatgttaaatacatacaattttatttgtcagttatacctcagtaaagcccggtgatggggaaaacagggaatcagctctaattctcacaatgtgttagcagtgatgccttccatttttttcaaatgcggaaattgagactcagaagttaagtaagctgcccttgtagtacatggaagaaatgtggagagacttttggcaaaggatccaaaaatctgagccttatttccttctctgttcctctctctaggataccatcagaacggagtcatcagaaaccagtatgtgccatatccccatgctcctggaagccagaggtccaatcagaaaagcctgtacacctccatggcccgcccgcccttgcctcggcagcagtctaccagttcagaccgagtgtcacagacgccagagagcctggatttcctcaaggtcccggaccagggagctgcagggtaagattctcacatcctctggatgaagccggcaagctccatctccatcattcaaaacaagggttcagagattcctgtgggctgtcaatacacaggattctaaggtttagttttccacctcagtgctatatgccaggacccaaggctgtggggctgtggctggttatttgtaaaggtacagtcacattaatagcacacaattcatttcattctccagagagggcttatcttggaaacatcagaagacgggttccccttggccccagatatggttactctgtgacctctttgtgctttcttgcatggttgaggaataatggatcttttgatttgtgtctgtgcctgcagttgcataaatacaacagctttaagagtcttcagcaacattaagcataacatcccagcattctatatgatatttgttgaagaatatgggtctttgtggctttatagtgagagcctctctgcctttctagaatataaataaagagtggtgaagagaacccagcctttttagccggaggaagtgaagattcctgaaactctgtgtagatattaaaagagctatcagttttaaaagggggttaagacatgtcctgtggagtcgtagggatggaactagcgccaactgaaagccagttggtgaactctgccaggaggtagattttggctccagtaaaaggaagaacgtagcaacccaaatatgagttgccctcgtatgtaaacagcattttgttcctgggagcatccaggcaccaggtggatggggatcaccaggcaggagtgttcagagtagtgttgtcaaatggtagataaggggaaagagaggcctctctaacactggacctgctgtttgctctctctgagcttcagtttccttgtctaagcactaatgtaatgccatcaaacttgcagcaaacttgttgggaggactagaaattatatacataaaatctctagcatggtacttggcatgcaggcgtctgctcacttaactctagcttgagggtggtaatgacggtgacagggtgatgatcataaggacccccgtcacttcatggaggttgaactagagacttgtaaggaatcttccagctctgcacgactctccatggtggagtggctctgtctgctaaagctagtaatggcctgctcccacccactctctcttctcttcccctctctcaagcccacttccattttccactgtctcctgtctccagcaccatggagaagtttcaaatgaggatcaggaggtatgaatgcaaaatagacctgtgcaggaagagaaacaacagctccttcctctgagggggcagccatccatctacctttttgtttgttggttggttgctttgttttttgagacagggtctcgctctgttgcccaggctgcaatgcagtggtgcagtctcggctcactgcagcctcctcccaggttcaagtgattctcctgcctcagcctcctgagtagctgggattacaggcacgcaccaccacacccagctaattttttttttttttagacggagtctcactcggttgccaggctggagtgcagtgccacaatctcggctcactgcaatctctgcctcccgggttcaagcgattcccctgcctcagcctcccgagtagccaggactacaggcgcctgccaccatgcccggctaatttgtgtgtgtgtgtgtgtgtgtgtgtgtatttttgtagagacaagagtttcactgtgttggccaggatggtcttgatctcctgacctcgtgatccacccgccttggcctcccaaagtgctggaattaagatgtgagccaccgcacccagcctaatttttttacttttagtagagacagggtttcgccatgttggccaggctggtctcaaactcctgacctcaagtaatccacccgccttggcctcccaaagtgctgggattacaggcgtgagccactgtgcctggcctcattcatctttatgccctattatttgatgtttttcctgccttggcagcttccttctaaagaccacagagctcttaagagctttaccatgttctctcctagcagcattccttttgccctggcaagtcttatctcacttcatttgggctacaaatatgaaagcaccttagttggtttttttggggggggttttttgtttgtttgagatggagtcttgttctgttgccaggctggagtgcagtggtgcaatctcagctcactgcaacctccatgtcctgggttcaagtgactgtcctgcgtcaacctcctgagtagctgggactacaggtgcgtgccaccacacccagctaatttttttggtttttttttgtagagatggggtttcaccatgttggccaggatggtctcgatctcttgacctcgtcatctgcctgccttgtcctcccatagtagctgggattacaggcgtgagccaccgcgcccagctgaaagcaccttagttttatcacacagacagccatcagtagagtggatgccgcccttatgtagacctctctctaagtgcacgtgcgcgcgcgcgtgtgtgtgtgtgtgtgtgtgtgtgtgtgtgtgtgtccctctcctcttcccttccactaccccccagtcttgggtaagtagctatatcccaccagctctcatgaccgtggttcacgtgattggcttggtctaaaccagtagttctcaaactctagtgtgcagtagaatccgctggaaagcttgctggcccactttccgcgtttctgattctgtaggtctggggtagggcctaagaatttgcatttgtaccacgttcccaggtgatgctctgatccagggaccacattttgaaaaccactggtctgaaggcacctgtagtctgattgataaagccagggaagcctccatgtgaaggtgaattgcaagggtgctgttaggtttatgggatttttgctctctaacccagacctacacctttcaggtgggtgagcatcactaagtcacaatcccacctaggcccagtttgatgcctcaaagtaggcagggtattaaaagcagtcaacagaatgcaccaaatctcttagctctgtgtgctagctgcctacttactttggttttggcaagcaaaaccatctttccagcctactttgcaagttgcaaacttgcacatcagccagctgggagcatctgtcagccaaaagtaggcaatttaggaacactgtgtcttaaccaaggctgctcccttccagccctctgccatgtggttccctatttaagtcttatggcaccctttgccaccctccagcctaaagactgggtacacgtggtgctgtcttggaggcaggccatgaggccggaaggagaggacaccttcacacctgtctgctaggcattaagatttccttgtatgtaaaacacaattagtaggcacactgtgtcttagccagcctcctctttgtaaccttaaatctgctgtgcaaacattccttacaaaatagtaccttgggcaaaaggctcagccttttcttagtatttattttctaaaacatgtaaaggtgaaaattaaaagtatctaatgtggccagagactttggatgtggcattttatggatccccatggttacctaaatttaacagcttctcctatttgccaagaaaacatgaattgcatttattccacaggaggctgttgaagcatgcagggaattttaggatcccaagtttgtactttttccataaacatgaaaattcctatacatcaaagttctaaacagtcaccttgactttaccaatctataaaagtaggattactatggtctttctttcctggctttcacattctgagtttatctttccttcctctctctcatccctcagtgcactttttctgtaatttattttggatcatgtaatatggataaaatcaaatgatgtaattagcacctcaagttaattcaggcaagtctttatcagtttattttaggttcaatcagttgttctgaagagagcatgaagatttcactaaattaattaccatcccaactggattctttaccctttcattgcagtattggtgcacatggtagctatcattatcattctccaggaaacactgagagatctgcgtgggaatcaggatcttgccatcgattagcatagcttttgagaagtcttaattcaggtcaaagatctttcctgtttctcaaggaaagggaagaggttaggcaagaatcctattaacagttcatccaggccgggcgcggtggctcacgcctgtaatcccagcactttgggaggccgaggtgggtggatcacgaggtcaggagatcaagaccatcctgattaacacggtgaaaccccgtctccactaaaaacacaaacaattagctgggtatggtggtgggtgcctgtagtcccagctaatcaggaggctgaggcgggagaatggcgtgaacccaggaggcagagcttgcagtgagctgagattgggccactgcactccagcctgggcgacagagcaagactctgtctcaaaaaaaaaaaaaaaaaaaaaacaaaaaaaaaaaaacagttcatccacccacctttgctctgatctcactatccagtgtgctttgtaattttccctcctataactgaaatgtacctaatctacctgcagttcattcttggaagcattaaaacccagactggaaatgtctgttgacctttttaatcctgtggtccattttgtgggaggataacttcaggaaatttcaagatactccagagattaatccaactagaagttggaaaaacagaaaagtcttggaagtgctcagtggtagggcttctgggcatgccacaaaggaggggtcaatagaaatatttaaatgctgcctgtgtgtctcttgtcaagatcctcccaatggagtcatatttttatggggcttaaaatttccatcaagtgtccaatagcaatatttctcaacccataatctatgggagcagcagccatatcctggcccaggcagacatggtgctgaggaattcctggcatccatttccacatttccagtaatgtttatagattcaaccttttggaacacagcatatttttaagagccagtgaaataaaatgccattattttccttcttggaatttcaagacataaatttcccatctgcagaacaaagaggtgatattcgaaagcttaatcctagctcccccgacatagactaggcacacccacccaggaggtgtgggagctacagagaaattcacaaaaggtggcatttagagtgcagagagcacaggatttgcatctgtaagagtagggtgagtcctggttcattcattctttcctttttcttttattcatcaatatttactgagccatgtgccttctatgtgctaccccaggcttgtcacttaatctttctactcttggtgtcttcacctgtataatagggatactaatataataattttgaaaacccactcctcagggttttcttgaaggttaaataagggctttgtgtgctataaagcacaatgctatttgaaagttattttgtatttgattcattaccattattcattggctggtcttgcaaggaaattttaatgctctaccagggttgaaaggtgatgtttcctggcccagtggctttattctcaagaactcaaatctctggcctgcctagagctgtggactccatgaaggtctacgcttcaggcattgttggctgtaatgcggggaatgggcagcctagggaagccaagacaaggagaccagacagggagacgcccgcccccaacacacacacacccttggcagctgtgcctgttctccgtgggcacagagcatcagtggcacacagagttctgcagtaatggtaataatcactagacatgagagcctcatttggacaatttgaagatgaaaagtcacaaactccttctggctctgcaccgttccacagtctcttcctttcttttttttgtattgtttttttttttttttttttgagacagagtctcactctgtcacccaggctggagtgcaatggcgcgatcctggctcactgcagctcaacctctgcctcccacgttcaagcgattctcatgcctcaacctcgcaagcagctgagattacacgcatgagccaccacacctggctaatttttagtagggacggggtttcgccatgttggccaggctggtctcgaactcctggcctcaagtgatccgcccacctcagcctcccaaactgctgggattacaggcatgagtcactgcacctggcctccacggtctctttctaactaaacatctgagctgcagtcatcataacaatgaacagcccatggaaaggatggacattgctagggcagagggaattagccctcagtttagagagttttcatgtcatttggggttttgttttcttgtgggcttttggcaccttgtgagattcggcagccatccatgaggactcaaatgtcagctgacatccaaatgtctcggggcaagtatatcacttggtcttctctggtcactaatataggacttctcttgcagagcaagttttcacaaagcaaactggatgtagtgtacttaattcatcaggaaatgttatttgtttctgggttataatgtgattgccctactcagaaaaaagaacctggtgcaaaaagaagttgctgtgggtcagctttttcgtgcatttatgttaattggtaatagacacataaagtgatgtgtacaaattaccctaaaataagaaaactaaattggattgtacagaaattacatataatgaaacactggatttgctcagtgatgtatagttttataaccatatattaacatatgtatattacatatataaataatatatacaatataagtaatatatattatatatataatgagcctttattattgaaatgtcaaaagaaaaaataagttattgtgagtctgaaatcttgctgcaactccccatcatctagccaagcacagtggctcatgccgttaatcccagcagttctggaggccgaggcaggaggatcacttgagatcaggagttcgagaccaggctgaccaacatgtgaaaccctgtctctactaaaaatacaaaaattagtcgggcgtggtggcaggtgcctataatcccagctacttgggagactcaggcatgagaatcacttgaatctgggaggcggaggctgcagcgagccaagatcattccactgcactccggccaagtgacagagcaaggatctgtctcaaacaaaacaaaacaaaacaaaaaacaaccattatctcaatgaaataattatttttataacacgattttcaattctgtgatgtttattagaaatacaaatactgtatcacagagtaccagacctaccaaaattatctaagttgtacaattataaaacaaatggtggcacatggctgtagtcccagcactcagatagctaaagcaggaggatggcccaagtccaggggttcaagactgcagtgaggtatgatcatatcattgtaccccagcctgggcatcatagcaagaccttgtctctaaaaataataacaataaggaaataatgaaacaaaagttggcaaggcatttttagacatgagtgagcctgtgctgtcgtgagggcagcttgaggatggtaggatggtaggatggtagtgtgctggtaaacagtgggcactccagggaggaaaaggcctgaactgtaacatttaccagtttccatggtaaaattctctcttcatggccaatttcaagctaccagtgtgactactactgagtgcggagttgggaaaacatgggcagtctcaccattgtatagtatttctaccatacatcagcaatagactttaataacttcaaatgcatagatagaggaaaataagtaggctgggcacagtggctcacgactgtaatcccagcactttgggaggccaaggcgggtggatcacttgaggccaggagttcgagaccagcctgggcaacagggtgaaaccccatctctactaaaaatacaaaagaaaaattagccgggcttgttggcacatgcttgtaatcccagctactcgggaggctgaggcaggagaaacgcttgaacccgggaggcggaggttgcagtgagaagtaggaagagataaatgatgagcatttattgcttttgttttaatgtaatttctttgttgtcaatgatttggtttttaataatggccatgtttgacaactggctcacaaaattcctgaaagttctatcagctctcgcaagctggactaagcctgttctggcacagtgggcatgcgggtctcatgtgccctgtaagggggtgtgtaatcccttcctcctggactagccaattgcctcggctgggagtagggggctccacctgcctagaagacctcattaatcaaatttctggcagtttctttgaaagtcattcctggccggatgcggtggctcacgcctgtaatcccagcactttgggaagctgaggcaggtggatcagttgaggtcaggagttcaagaccagcctgaccaacatggagaaaccccatctctactaaaaatacaagattagccgggcatggtggtgcatgcctgtagtcccaactacttaggaggctgaggcaggagaatcgcttgaacccaggaggtggaggttgcggtgagccgagatcgtaccattgcactccagcctgggcaacaagagtgaaactccgtctcaaaacaaaacaaaaagtcattctttcttctcattaatgacacaggattgccacctagtgacgcagaggagattgcctgggttttcgaggctgttggagtctgggaaaatggctgttcccaccaactgtgttccaaggtggcttccaggtctccagtctggtgaatcgtagagattgtgacggcttcgttgacacagatttcctgtgttcctcagtgctgttgagagctctctgtaaaactttcctagaatcagaaaaaagacctggaacccggtgcggtggcttacacctgtaatcccagcactttgggaggccaaggtgggaggatcgcttaagcccaggagttcaagaccagcctgggcaacatggcaaaacttcatctctaaaaataaagaggccgggcgcattggctcacaactgtaatcccagcactttgggaggctgaggcgggcggatcacttgaggtcaggagttcaacaccagcctagccaacatagtgaaaccccgtgtctactaaaaatacaaaaattagctgggtgtggtggtgggcgcctgtaatcccagctacttgggaggctgaggcacgagaattgcttgaacctgggaggtggaggttgcagtgagccgagatcatgccactgcactccagcctgcgtcatagagtgagactcagtctcaaaaaaataaaaataaattaataaataaataaaaggaaaaagaaaaaggacctaggccattgcctgaatctgctcaggttttacagatgcagagcttggccccaaacccagcacacagactcaagcccacgtccccctcctgctacacactgtcaacatagagcttgaggccccatctcagggggagttagccaaatagccacacaagtcactgtcatgctacaattgacccatgttctggagaagccgtgggctaggagagggtatggccgggggtttgccagagtatgaggaagcagtgatggaaatgagatccgaaggccgagcaggagttagcagtgctgcctgggaagtgggcagaggccaggggagcatagccagaccaaggatccagaaagattccatgtggctgcagtgccaggagccttaggcgtgtgccaccatgttggccagggatgaaaccagcaggaaatcccaggagcctgcatcagtcatctcacaggagtgtcgtgagggtgaaatgaagcagcatctgtgaaaatgcctaggacaaggcctggctgagttgaggggagtttatccagacttcacacagctaccggcagtttcccagaagacatcctgtctgctagccctcacaagaagggtgtagacatgtgcaggctggccagggagaatggctctcactgtggctcgctttgggaatatgccgccccagcaaagcagctgtgcctctttgtggtcacaagacagagccaatggtggcagcatcagtgttgcccttcctaatgcaaagtgcaaactgcagaggtcctccctcctccacccacctgcccactcctcccggctgccatcagacagtccccactatccacacccatctcaaagctgccctggcctcccccacctctcacctgtggagttactaggaaccccattcagcctagtgataaagggccaaatggcttacactgccagcatggtagcagttgtccacaacctggacaattatggaccccaaattccccgggtaatttcggaggttttactttggccaggagtcacttatcctgaggaagtagcctctgatgccttgatatcaaagaccacgcagtggccacatacacacagctttttgcgtcctgcatccccttaggtcttatttataatttggtatcttatcaccagaaagaatccgttccatgagacttacgatctctagtttaaaacaatctagacgccttttttttttttttttttttttgcacctaattaccctggctagagtttccaggataatattggacagaagtggtgagtgctgacatccctgttttgttcctgatcttatggggaaatcattgtgagtttcaccagtaaatatgatgtaagcttgaagtatgtggacaagggtcctctccccaaccagggctcatgaagaaaggtaggaaggcaccaatgtggcctgcagcagggagtaaggctggggtgtgagcaggggccgcccctggcagagtctgtaggcgccatgaagggttttggtcctttttccaagagcagagagaagctgttagaaagattttcaggttgaggatggggcgaactaataacagctgagctagcatgagggccaagtgtcctagaaaggaaacaactggcaaggaagacacgaaggacagaaacaggtcttagtcaaagctggaggcaggtggggcagaacaagtgggtgatgcccagggcagggagggtcttacctctcaggagccatccgtcttgtcttcccactaagaggtcttaccccgaccctggcgaggggagtccttcagcaggaggaccctgtatctaagcccccatacttgggctccagagaccttgtcagtctacactaaggacactagggtttttccctgaacaagacaggacaaattagcatctgtgggttcaactggcccgctgtgcccatgggttccacatctgtggattcaaccaaacttggaatgaaaatattcagaaaaaatatggatagatgcctctgtagtgaacatgtacagacttaaaaaaaaaatttttttttttttgggatggagtctcactccgtttcccaggctggagtgcagtggcacgctctcggctcactgcaagctccgcctccctggttcacgccattctcctgcctcagcctcccgaatagctgggactacaagcgcccgccaccacgcccggctaattttttgtatttttagtagagacggggtttcaccgtgttagccaggatggtctctatctcctgacctcatgatccacccacctcggcctccccaagtgctgggattacagattacaggcgtgagccactgcacccagcctttttttttttttttttttttgagacaaagtcttactctgtggcccaggctggagtgcagtggctcaatctcgactcactgtaacctccatctcccgggttcaagcgattctcctgcctcagcctcccaagtagctgggactataggcatgcaccgtcacgcccagctaccgtctgtattttcagtagagacgggtttcgccatgttggccaggctggtctcgaactcctgacttcaggtgatccacccgccttggcctcccaaggtgctgggattataggcgtgagccaccatgcctagccagtcctatattttttaaaaagcctttttcttgtcattattccctaaacaatatagtataacaactatttacatagcatttacattatattaagtattataagtaatctagaggtgatttaacgtatacaggaggatgtgcataggttatatgcaattgttacactttcatatgagggacgtgtctgtggagtttagtatctgtgaggagtcctggaaccagtcccccagggagatagggatgagtttttggtgtgtgtgcgtgcacatgtgtgcatctgtgtccttccatgtgcacttgtagcccagttctgtggactgccaggctggaggcttcctccctcccagggtgttgtaatgcccgccgccatcccctttcattccttgttgctgagaagtcacatgacgtctggtatccaggctaatggctcttattaaccaaatgctgacacatcccaatatatagggtgcttaattaaaaacctgctcgcctggccaactttcagagaagcaagcacttcttgaacagggaatggggatttccagtaggcactaggtagaaaacgaatgatgtcacactaagaacctacaaaatgcctttcctctgcactaagagaaaagtgcaggggggtggtggtggtgggaggagtggagcctgagtagccttgaggattgctccctcccacgtggggtggtgtaaaagccgagtctcaggggcgcccagcccctcctggggacagtccaccaccctgctggcagtcagtgttccccccagccacccctttgtgatccaggttgttcatcagcaccccatgaacatctgtcatcacaggacctgggcaaggccagcaggctgtggctcctgagagcacagctcaaaactgggtgtggttgttctttccagaactcaggccccaggaaggccctcccttttcctccttgctcctgtaggtgtgaatgatgtgcacagacctaacagccagccccaccctgttgaggtccagcccaacttcttgagggagaaatcttaagtttgttttgtagggaaatgaatgtagcctttactttggtttgtccttaagcgaagtggaaaaaaagaaatgttctccatgtttccgttttcctttttgtttttgctaaatgctttttatgaacatatttaataaatgtttcaggtataagtgtaaagatctcactaaataggaacaagttgaacttacacacctttgaaagaatgtatgaatggtgacttaaggcagcatagtatataggaagaataactttaaagctagaagatctggattagggttagagcactggagttatttttaataattatgacagtggggtgaagggagtgtcactggtatccagtgggtagaggccagggatcctacagggcataggacagcctcccgcacccacccccatacacacacacacacacacacaacagagaattcccagccgcaaatgtcagtagtgcagatgttgagaaactgctctggataaactcttgtataagaatatttacagcaacatttttggaggggcaaaggggagctctgaggggtaataatgaaagaatgggaaggagacctgaggagtaatactgattgataaaatgagagggaagtctgtggattaataatgagggggtgggagggaagattgtggagtaatgatgagggtatgagggaagtctgcagagtaataatgagcaggtcggagggaagtgtgaggagtaataatgagggacgggagggaagtctgaggagtaataatgaggaggtaggagggaagtctgcagagtaataatgaggggtaggagggacatctgtggagtaataatgagagggcagaaaagcctgtagagtaataaggaaggggtaggagggccgtctgcagagtaataatgagggatgggagggaagtttgacaagaaataatgagaaggtgagacggaagtctgaggagtaataatgagggggtaggagggatgtctgcagagtaataagggggtgggaaagaagtctgcagagtaatgagcgggtgaaaggaaagtgaggagtaataatgaaggggtgggagggaagtgtgaggagtaataatgagggatgggagggaagtgtgatgagtaacaatgagcggtgggaggtaagtgtgaggagtaataatgaggggttgggagggaagtctgaggaggaatgaggggggtgggagggaagcctgaggagtaataatgagggggtgggagggaagtgtgaggagtaataatgagggatgggagggaagtctaaggagtaataatgaactggtgggagggaagtctctggagtaatgagggtgggtggatagatgggatgggagtagacaggagtgaggtctgaggcataataaggttgtgaatggggagcaaatctcatggcagcattttttataatagtgaaaactggaaccatcccaagtgaccatccacagtgccctggagaagtaaactgtgacacactcactcgcgcagtggtgtagtatcaggcagcaagggtgaaggaacgatagctgcaggcatcagcagggcacgtcatccagttgttgagcatgtgaccgtggaatatgattcctttcatacagttgacagtcggaccacaaatattggctaggggtatttacatgtgtggcaaactgtagagatgagccagagaatggttaatacaaactgtaaggtggtggtaatctggggggaatgcagtgaaggagaaatgcctacaggcttctgtggcacctgcaaaagttccatttcgaaacttgaggaaggagggacagatacctgaatgttcctgatttaaatgtatgggtatacttttgacacttttttatggatatgtgtctcccacatttccttctatgctggggacacagtgacaacagcagctaaggtttttaagagctatgtgcatttgcaacaaccttgtcagaaaagttacttttattcctcaagtttaaagactgcaccctgggccacatgtcttctaaggatggagctggatttgaacttgaacaggccagtgccggccgccatgctccaaaccaccgttcggtgctgctgccccctgttggggcccagtctcatctgctccactctctccacagggtcaggagacaaacaaccagtcggcctcccccagcagggggcagacccaagccccagcccaagcccaagcctcaggtgccacagtgcaaggctttgtatgcctatgacgctcaggacacagacgaactcagctttaatgccaatgacattattgatattatcaaagaaggtaagtgtgtggctggttggctgggacagcctcccaaagagcatgcagtcacattgctgtaagatctagtgtgaaaatgaaaagaatttatgggctcctcaaactgcaatttgtagaggcaggtcaggcctcaggctcagtctgatcaagacaccagcttttttaatgcttctttcagctctgcccccttatttatattccctcccttgtcaagctgtttttcttcatggtagcaaaacggcagcagcaattccaggccaacatatcaaaccatgtctgaaatgtgcatcatctctgaaacttctgttcttagtcattggacaaaagtcctgacttttattctgatcagaccaaattagccatgtgtccatccctgaaccaacttcagtagcaagacaaaggctgtaccctgagaggatgagacctggtaggggctgtccccagaaacggggaggtctgtcccacccacacttcctggcttcttcataatgaaagtggatggagtggaagccaggaagacaaccttgaatatccattattaaagcagtccatgggcttggctgagtgctttattaatttggtagatatcttacttttttcaacaaactttttgatttaaagaacaaagggaaaacaacatggatggagccaaatcacttgagcccatgggagcggagtgtgtgtggctggggcagaacagactttctcatcttcacttccaccacctctctctccctgcagatccttctggctggtggacgggtcgactacgaggcaagcagggcctgttccccaacaactatgtgaccaagatctgaggtgcccgtgactctgacacatggggcagaggagctccaggcacagaccaggggaggggatatttaggggctccccttacaatccacaatgagcaattgcttctccaaggcctggagctattctggtaccttccccatggaggacactgaaaaggctgggttggggacagggagtatcactccataagtgatcctaaaaggtagcctcttcataggaacccaggaggacaaaaccaccatgcattaagatttatttattgtatttaaacctggtgagaggacaagtgaggtctgctcagaccttgtaggcttctatcaaaacagcaccctgcttgctcaccaggcctagagaatggctgtaggtggccgctgacaagtgcctttagttgaagagcacatttctttcatctctcttgtccatacctgatagacacattcctctctgccaccttccttcagggaggacccgccctctgcagactgggcttagcgtgagcaggcacttcccatgtacgtgccaagggtaagctggcctgctgagcccagggcgacagaggggcactggtttacactttgccgggaccatcagggccgccaagcaggtcaggggctgggggctgggggctgggctgctggctttgctttctctgggtcttcaattagaatgtggctggcccatattggtttgtgtttaaatgctgtacttactacaagaaggatcttttttcaagctgtacatttataaaaacagatcatatactgtatatataaaaatcttgagatggtagaaacatgtatgaatgtactaagtagtattccactgtactcattcataaggtaggttttcttacaaaactcacaccaggtacttaaagatgtgctctgcttttttccaactacggagtgtcactgctttctaggtcagtccctgcagactcttctcaactctttccctataggaaacttactccgcgtcctgcccccacctcctaaataaataaaggaatcggcgaacaccttcttcttttatgacatttgttatgggttgaattgtgtgcctccaaagaagatgttggagtcccagccaccagtacctcacaatatgaccttatttggaaatagagtctttatggagcaaacaaacaaaactaattaaaatgaagtcattagagtgggtcttaatccaatataatggtgtcctgatgaaaaggggaaatttggacacagagaccaacatgccagaggaaagaccatgtgaaaaggcagggagaagacagccattcacaagccctggacagaggcctggaacagattctccctcacaccctcacaaggaaccagccctgcccaccttggtcttggacttccaacctccagaactgtgaggcaatacatttcgctgtttaagccactcggtttgtggtagtttgttacggcagccctaacaaactaaaacaatgttttcttgccataatagtgaaaagctggaatcagtgtaatgcccatcaataatggaatggttgtaagtagagactgccatttctctacctttcctcctctgggtgccatagccattcttaagctactggtaacttagagtttgagcagcatacacctttgaggctttcaggatcctcaagtccatgggaaaaaattatcagggcttacgtataagggaaaaaaattgatctagatttgaaacgaagatacatttaattctgctgtgttttacttcaagaacagggagcaaactccattctgtaacagtaacgaataatgttaaaaggctacttcagttccatgttgcgaccagagaggaaagtagagccatgatgcggtgagttgaggaaaggtaatcctgttgacactagtggtctctaaagtactttcacattcatggactccccgcagtgggaggaagataccaccagaactgggacagaggagcatgctggagtccccacagccaccagcactcaggctgcgttctcagggcaggaacaccaggaccatcttcccttgttatcataagcccctggctggctgggacaagcctttgtttttcctcctgattgattgattggcattttacacttgtgtgtaactgggaaccatcgggctctaggtcacaaaacagggactgagttaaacccccacgagtaacaccctcatccatggaaatcacagaccaagcccttagcacctgcatcgtgtgcccagccagtgccaggctcaaggagatgcccaacaaatggtgctgaaataggtaagtgacccacaggggaaggagacttagatctgcgtagagatgctgaaatgctgacactattaagaaaagtttggagaaatagtggtttatcttaaacttatttgtatatatttagaaattcaacatggggactaccagaaaaatctgggataaataacatttccctttttttcctaattaaaaagtcttcagaaaaatgtcttttttccctttaagacactaacctgggtttcctctagtctgtggatctagcctggcctgccattttgttcactgtgcagttaagcaaatatgaccactttaggagtcacttaccaggaaagaacatacagaagatcaaggggccacccccaccttctggaacttgccatcctgtttgaaataaggggtgttcatgtgcacacacagcaacgtgtatagcagtatcaaacacagtataaaaatgtgacatcccttcaaccaaaggttttaagtaaccaggaactaaatgagaaggcctgactgtgtaccctagggtagaggtgttcaagctttagttgtagaagagagagagacagaggtctgtataagggtggtatccactctactgatggccgtctgtgagacagagagaggctgatctgaaactcctgggatcaaacgatcctcctgcctcagcctctcaaagtgctgggattatgggcaagagccaccgtacctggccaactggcttaaagacatgcaaaagggccgtctcttccacagtgttttgtgaaacaatacagagacatgtggagaggacaaagggtgaagccttcttgaataagcttgctccccaaccatgaaggatgccaacccactgacctcccaacgtgtggtcccagcccatcgtaatcaaacctgactccccactactaccaagtccagcccaatgaaggtagaaaagcatcgtgcagtttcctccttaaaggacctgccctgtgtgcacaccatgtccaccaatattctgctggccagagcttagtcatgtggcctcaactcaagggggctggaggtctctgcacagagctgtctcagcagcttacccagagcaccagagtgacagcgggctcctgccaggtggaagtgttcacaaaaatgagtaagagaaaatatggatgtgcctttatgaattacaaactccatgggcttccatagagcatggcttttacataatctaaattccttctctttgcgactccctcctgaactcatccccagaccctccctgagtggagctggtcacaccaagtcagcctgtgcctctagttgctaccatttcttttataggtgttgtcccagttaagatttcactggcagtagggctggattctggtttccagggcaatcaagagcagagcatgaacggtgcgtctttggtagacaatttaactctgtgtttctggcacccctcacttttgtgatcaaaagaaagaccagaggagcctttctgcaattctgccctctttccctgttttgcttttctcccaaggcctagctgattgattgcagttctttctggatttagtaacttggttttattcctacccactaatcttgatgtctttttccctactagatcatacctttccactctgagcaccctttctaacaagaagactggctcagtatggttcactaggtcgcccaaggtcacacagttcttccctgggggagccatcacaggaactctgagtcaaaggcctgtgcgtttttattttcagacagcacctcactttgtcacccagactagagaacagtggtgcgatcatgccttactgcagtctcaaactccagggctcaggtgatcctcccacctcagcctcccaagtagctgggaccacaagcatgtgccaccacattcggctaattatttgtacagatggggtctccctgtgttgcccagctggtctcaaagctctgggctcaagcagtcttcccgccttggcctcccaaaattctgggattacaagcatgagccactgtgcccaaaaggcctgtgcttttaatcattttctccaattcaacagatatttagtaatgtgatggtctactgtgtcagcctttcaacttccaatatcttcctctcagaacataaaagtctatttaaaaagagagagagaagaaaactcacgcataaaactcaacagctagaaacttgtaagctcctttaatgggcaggagctccatctaacaaatctgaatcctctgattcatctctttccaagaccattaaccttctctttaaaataattaacagctatgttcaagtatcttcttcacactagaagctatactaagtgcttggcatactttacttagcaccaccctatgagggagacactcttatccccacttcacaggtacagaaactaaagtatagagatcaccactacttaaaatcaaacccaaagcacccacgttcagagttagtgctcttctatactatggatacatcatctcatttttaatttccgtgtttttatgatatggtttctacttctgccactcatttcccatttatgacattttagtttggggtgcctgctgtgccatctaagaaagtatcttaaaggtctttttttatgacatcctggaagaatttcctaagtcaggacatttaatatttaactaagtaaaatatgtaataaggaagctataaaatgtctttggaatatgcttacaaaactcaggcgttcttggagagaagttgagctcaagcatctctgggaagtaactgcttgtcagagccaggaaagctccctttcatggtctcacttcgttaccattcacacttgtgatcagagttgtccaaggctgccatgggaacaagcttcactaacccaataagggatattcataaaactctatactaggatttcagcatataaagatacccaaaacttacagttaaagacatactagtcaggcagtcctgcctgcccaggaagagagtaaaaagccagccctaactggagccagtttctcctccccaggggcagttgtcctcaagctgcacctgaatcaaaagagcagacgctgaatttctctgtcagcaagaggcaaccacactctaggttggggaaaataactgagataaatgagtttactgcaaagcacagaacctttatgaatcttccaatcatttgcaatgtttcacaagtgtatttgactaactaactcctttctcttacaacaccaattaacatcttgttaaaccaacgtcttgggaagttgtttttatacgagactcactatgtttatggtttttgtttttaagtcaatggttggaggctgaggatgcactccccccgtagaaaacaatgttcgagcgtcccagatcgacctcagactgctgagctagcagtgagaatttcaagccaatgggtgttagcttgctgggctccgtgggggttggacctgacgagccaggcgccacagggaatctgctggtctgccgccggttgtgaagactgggaaaagtgcagtgtctgggccggagtgtacctttcctccaggtacagtctctcacggcttcccttggctaggaaagggaaatcctccgaccccttgcgcttcccgggaaaggcaacactccaccctacttctgctcgccctccatgggctgcacccactgtccaaccagtcccaatgagatgaaccaggtacctcagttggaaacgcagaaattacctgcttggttgggggaggggtgcctgccattgctgaggcttgagtaggtggttttaccctcacagtgtaaacaaagctgcccggaagttcaaactgggcagagcccactgcagctcagccaggctgctgcagccatactgcctctgtagatttcctctttcctgggcagggcatctctgaagatacggcagcagccccagtcagggacatatacataaaacccccatctccctgggacagagcacctgggggaaggggcggctgtgggcacagcttcagcagacttaaaagtccctacctgagagctctgaagagtgcagcagatttcccagcacagcattcgagctctgataagggacaggctgcctcctcaagtgggtccctgacccccgtgtatcctgtctgggtgacacctcccagtaggggccgacagacacctcatagaggagagctctggctggcatctgacgggtgcccctctgggaggaagcttccagaggaaggaacaggcagcaatctttgctgttctgcagcctccgctggtgatacccaggcaaacagggtctagagtggacctccagcaaactccagcagacctgcagaaaaggggcctgttgcaaggaaaattaacaaacagaaaggaatagtagcaacatcaacaaaaaggacgtctactcagagaccccatccgaaggtcaccaacatcaaataccaaaggtagataaatccacgaagatggggagaaaccagcacaaaaaggctggaaactccaaaaaccaaaaaatgcctcttctcctccaaaggatcacaactcctcaccagcacgggaacaaacctggacagagaacaagtttgacaaactgacagaagcaggtttaagaaggtgggtgataaactcctccgagctaaaggaacctgtgctaacccaatgcaaggaagctaaaaaccttgaaaaaagattagacgaatcgccaactagaataaccagttcagagaagaacataaatgatctaatggagctgaaaaacacagcacaagaacttcatgaagaacacacaagtatcaatagccaaatcaagcagaataaaggatatcagagattgaagatcaactcaatgaaataaagcgagaagacaagattagagaaaaaagagtaaaaagaaactaacaaagcctctaaaaaatatgggactatgtgaaaaaaccaaatatacatttgagtggtgtacctgaaagtgacaaggagaatagaaccaagttggaaaacactcttcaggttatttatccaggagaacttctccaacctagcaaggcaggacaacattcaaattcaggaaatacagagaacaccacaaagatattcctcgagaagagcaacctcaagacacataatcatcagattcaccaaggttgaaatgaaggaaaaaatgttaagggcagccagagaaaaaggttgggttacccacaaagggaagcacatcagactaacagcagatctctcagcagaaaccctacaagccaaaagaaagtgggggccaatattcaacattcaaagaattttcaacccagaatttcatatccagccaaactaaccttcataagcgaaggataaataaaatcctttacaggcaagcaaatgctgaaagattttgtcaccaccaggcctgccttacaagagctactgaaggaagcactaaacatggaaacgaacaactggtaccagtcactgcaaaaacataccaaattataaagaccatggacactatgaagaaactgcatctactaacgggcaaaatagctagcatcataatgacaaaatcaaattcacacataacaatattaaccttaaatgtaaacgggctaaatgccccaattaaaagacacagactggcaaattggataaagactcaagacccatcattgcgctgtatgcaggagacccatctcacacacaaaaacacacatagcctcaaaataaagggatggaggaatatttaccaagcaaatggaaaccaaaaaaaaaaaaaaaaaagcaggggttgcaatcctagtctctgataaaacagacttcaaatgaacaaagatcaaaagagacaaggcattacataatagtaaggggatcaatgcaacaagaagagctaactatcctaaatatatacacacccaatacaggagtacccagattcataaggcaagttcttagagacctacaaggagacttagactcactcccacacaataatagtgggagactttagcaccccactgtcaacactagacagatcaatgagacagaaaattaacaaggacatccaggactagaactcggctctggatcaggcagacctaaccatcatctacagaactctccaccacaaatcaacagagtatacattcttctcagcaccacatcacacttattctaaaattcaccacataattggaagtaaaacactcctcagcaagtgcaaaagaatggaaatcataacagtctctcagaccacagtgcaatcaaattagaactcaggattaagaaactcactcaaaaccgcacaactaaatggaaactgaacaacctgctcctgaatatctactgggtaaataacgaaatgaaggcagaaataaagatgttctttgaaaccaatgagaacaaagacacaaggcaccagaatctctgggacacatttaaagcagtgtgtagagggaaatttatagcactaaatgcccacaagtgaaagcaggaatgatccaaaatcgacactctaacatcacaattaaaagaaccagagaagcaacagcaagcatattcaaaagctagcagaaggcaagaaataactaagatcggagcagaactgaaggagacagagacacaaaaaaacccttcaaaaaaaatcagtgaatccaggagctggttttttgaaaagatcaacaaaatttcaaagaccgctagccagactaataaagaagaaaagagagaagaatcaaatagacacaataaaaaatgataaaggggatatcaccaccaatcccacagtaatgtaaactaccatcagagaatactatgaacacctctacgcaaataaactagaaaatctagaagaaatggataaattcctggacacacacacgctcccaagactaaaccaggaagaagtcgaatccctgaatagaccaataacaagttctgaaattgaggcagtaattaatagcctaccaaccataaaagtccaggacccgactgattagcagccaaattctaccagaggtaaaaagaggagctggtaccattccttctgaaactattccaaacaatagaaaaagagggaatcctccctcactcattttatgaggccagcatcatcctaatgccaaaacctggcagagacacaacaaaaaaagaaaattttaggccaaaatccctgatgaacatcgacacaaaaatcgtcaatacaatactggcaaactgaatccagcagcacatcaaaaagcttatccactgtgatcaagtcggcttcatccctgggatacgaggctggttcaacatacgcaaatcaataaacgtaatccatcacataagcagaaccagtgacaaaaaccacgattatctcaattgatgcagaaaaggcctttgacaaaattcaacactgcttcatgctaaaaactctcaataaactaggtattgatggaacgtatctcaaaataataagagctatttatgacaaacccacagccaatatcatactgaatgagcagaaactggaagcattccctttgaaaactggcacaagacaaggatgccttctctcaccattcttattcaacacagtattggaacttctggccaggccaatcagacatgagaaggaaataaagggtattcaattaggaaaagaggaagtcaaattgtctctgtttgcagatgacgtgattctatatttagaaaaccccagtatctcagcccaaaatctccctaagctgataagcaacttcagcaaagtctcaggatacaaactcaatgtgcaaaaatcactagcattcctatacaccaacaacagacacagccaaatcatgagtgaactcacattcacaatgcctacaaagagaacaaaatacctagcaatccaacttaaaagggatgtgaaggacctcttcaaagagaactacaaaccactgctcaaggaaataacagaggacaaaaacaaatggaaaaacattccatgctcatggataggaagaatcgatagcatgaaaatggccatactacccaaagtaatttatagattcaatgctatctgcatcaagctaccactgactttcttcacacaattggaaaaaactactttaaatttcatatggaaccaaaaaagaggccgcatagccaagacaatcctaagcaaaaagaacaaagctggaggcaacatgctacctgacttcaaactatactacaaggctacagtaaccaaaacggcatggtactggtaccaaaacagatatatagtccaatggaacagaacagaggcctcagaaatatcagcacacatctacaaccatctgaactttgacaaacctgacaacaacaagcaatggggaaaggaatccctatttaataaatggtgttgggaaaactggctagccatatttagaaagctgaaacgggatcccttatactggtataccttttacaaaaattaactcaagatggattaaagacttaaatgtaagacctaaaaccattaaaaccctagaagaaaacctaggcaataccattcaggacatagacatgggcaaagacttcatagctaaatcaccaaaagcaatggcaacaaagccacaattgacaaatgggattgaattaaactaaagggtttctgcacagcaaaagaaactaccatcagagtgaacaggcagcctacagaatgggagaaaatttttgccatctatccatctgacacagggctactatccagaggccacaaagaacttaaacaa

SEQ ID NO: 1205 - DNA, 4668 bp, Homo sapiens
cgagactcagccagaggagtacggattaagtggccgaagaaagaggagtgaggcaggggagcgaggcggacgctccgagcgcatcggactcacctgggccggcggcgagcggcgagtacgagtggactcttgccctccgcagcatgcgccccgcctgctaagtcgccgccgtctcgccctcacctagcaccgccaatcccgcctggatggagtcccctctgggttcccattggctcctgtgagtgcttgggtgtcgggagcctgtttttggcgaggggaaccaacttttgaagttcgcccagaagactgcgttccagccccagttccccggcagcgggacccggcgaagacgcgaccgcggcgcgagtcaccatgggaagcaaaggtgtctaccagtaccactggcaaagccacaatgtcaagcacagtggtgtggacgacatggtgctactgtccaagatcacagagaactccatcgtggagaatctgaagaagagatacatggatgactacatttttacatatataggatctgtattaatctcagtcaaccctttcaagcagatgccatattttggggaaaaggaaattgaaatgtaccaaggagcggcacagtatgaaaacccaccacatatctatgcccttgcagataatatgtacagaaacatgatcattgacagagagaaccagtgcgtcattatcagtggtgaaagtggtgctggaaaaacagtggctgccaaatatatcatgagctacatctccagagtgtctggaggagggaccaaagtccagcacgtgaaggacattatcctgcagtccaacccgctgctggaggccttcgggaacgccaagaccgtccggaacaacaactccagccgatttggaaaatactttgaaatccagttcagtccaggtggggaaccagatggtggaaagatctccaacttccttctggaaaaatctagggtggtgatgaggaacccaggagagcggagttttcacatattttaccagctcatcgagggcgcctctgcagagcagaaacacagccttggcatcaccagcatggactattattactacctgagcctctcgggctcatacaaggttgatgacattgacgacaggcgggagtttcaggaaactctgcacgccatgaatgtgattgggatctttgcagaagagcaaacgctggtgttgcagatagtggcgggtattctccacctgggaaacatcagcttcaaagaagttggcaactacgcggctgtggagagtgaagagtttttagcttttcctgcatatctgctagggataaaccaggaccggttgaaagaaaagctaacaagccggcagatggatagcaagtggggaggcaaatccgaatccatccacgtgaccctcaacgtagagcaggcctgttacacccgggatgcgctcgccaaggccctgcacgcccgggtctttgatttcttggtagattccatcaataaagccatggagaaagaccatgaagaatacaacattggcgtcctagacatctatggctttgaaatattccagaaaaatggctttgaacagttttgtatcaattttgttaatgaaaaactgcagcagatttttattgaactgacattaaaggcagaacaggaagaatatgttcaagagggaataagatggacacccattgagtactttaataataaaatcgtatgtgacctcatagagaacaaagtgaaccctcctggcatcatgagcatcctggatgacgtgtgcgccacgatgcatgcggtgggtgagggggcagatcagacgctgctccagaaacttcagatgcagattgggagtcatgagcacttcaacagttggaaccaaggcttcatcattcatcattatgctgggaaggtatcctatgacatggatggcttttgtgaaaggaaccgggatgtgctttttatggatctcatcgagcttatgcagagcagcgagctgcctttcataaagtctttatttccggaaaatctgcaggctgacaagaaagggcgcccaactactgccggaagcaaaataaagaaacaagccaatgaccttgtgagcaccctgatgaaatgtacgccccactacattcgctgcatcaagccaaacgaaaccaagaagcccagagactgggaggaaagcagggtaaagcatcaagtcgaatatttgggtctgaaagagaacattcgagtgagaagagctggctatgcctatcggcgcatcttccaaaaattcctacagaggtatgccattctgaccaaagccacctggccttcttggcagggagaggagaagcaaggcgtcctgcacctgctgcagtcggtcaacatggacagcgaccagttccagctggggaggagtaaagtgttcatcaaagcccccgagtctctatttcttttagaagagatgagagagagaaagtatgatgggtatgctcgagtgatacagaaatcatggaggaaattcgtggcccggaagaaatacgttcaaatgagagaagaagcctcagacctcttattgaacaagaaggagagaaggagaaacagtattaacaggaactttataggggattatattgggatggaagagcacccagaactccagcagttcgtgggcaagagggagaagattgatttcgcagacacagtcaccaagtatgacaggaggttcaagggtgtaaagcgagacctgctccttaccccaaagtgcttgtacttaatcggacgagaaaaagtcaaacagggcccagacaagggcctggtgaaagaagtcctgaagcggaaaatcgagatagaacggatcttgtctgtgtccctcagtactatgcaggatgacatttttattctccatgagcaagagtatgacagtttgcttgaatctgtcttcaaaactgaattcctaagcctcttagcaaagcgttacgaggagaagacccagaagcaactacctctgaaattcagcaatacgcttgaactgaagttgaaaaaggaaaactggggcccctggagtgcagggggctcccggcaagtgcagttccaccaagggtttggggacctggctgtcctcaagcccagtaacaaagtgctgcaggtcagcatcggacctggactgcccaagaactcccgtcctaccagaaggaacactacccaaaatacaggttattccagtgggactcaaaatgccaactacccagtgagagctgcccctcctcccccaggataccatcagaacggagtcatcagaaaccagtatgtgccatatccccatgctcctggaagccagaggtccaatcagaaaagcctgtacacctccatggcccgcccgcccttgcctcggcagcagtctaccagttcagaccgagtgtcacagacgccagagagcctggatttcctcaaggtcccggaccagggagctgcaggggtcaggagacaaacaaccagtcggcctcccccagcagggggcagacccaagccccagcccaagcccaagcctcaggtgccacagtgcaaggctttgtatgcctatgacgctcaggacacagacgaactcagctttaatgccaatgacattattgatattatcaaagaagatccttctggctggtggacgggtcgactacgaggcaagcagggcctgttccccaacaactatgtgaccaagatctgaggtgcccgtgactctgacacatggggcagaggagctccaggcacagaccaggggaggggatatttaggggctccccttacaatccacaatgagcaattgcttctccaaggcctggagctattctggtaccttccccatggaggacactgaaaaggctgggttggggacagggagtatcactccataagtgatcctaaaaggtagcctcttcataggaacccaggaggacaaaaccaccatgcattaagatttatttattgtatttaaacctggtgagaggacaagtgaggtctgctcagaccttgtaggcttctatcaaaacagcaccctgcttgctcaccaggcctagagaatggctgtaggtggccgctgacaagtgcctttagttgaagagcacatttctttcatctctcttgtccatacctgatagacacattcctctctgccaccttccttcagggaggacccgccctctgcagactgggcttagcgtgagcaggcacttcccatgtacgtgccaagggtaagctggcctgctgagcccagggcgacagaggggcactggtttacactttgccgggaccatcagggccgccaagcaggtcaggggctgggggctgggggctgggctgctggctttgctttctctgggtcttcaattagaatgtggctggcccatattggtttgtgtttaaatgctgtacttactacaagaaggatcttttttcaagctgtacatttataaaaacagatcatatactgtatatataaaaatcttgagatggtagaaacatgtatgaatgtactaagtagtattccactgtactcattcataaggtaggttttcttacaaaactcacaccaggtacttaaagatgtgctctgcttttttccaactacggagtgtcactgctttctaggtcagtccctgcagactcttctcaactctttccctataggaaacttact

SEQ ID NO: 1206 - protein, 1108 aa, Homo sapiens
MGSKGVYQYHWQSHNVKHSGVDDMVLLSKITENSIVENLKKRYMDDYIFTYIGSVLISVNPFKQMPYFGEKEIEMYQGAAQYENPPHIYALADNMYRNMIIDRENQCVIISGESGAGKTVAAKYIMSYISRVSGGGTKVQHVKDIILQSNPLLEAFGNAKTVRNNNSSRFGKYFEIQFSPGGEPDGGKISNFLLEKSRVVMRNPGERSFHIFYQLIEGASAEQKHSLGITSMDYYYYLSLSGSYKVDDIDDRREFQETLHAMNVIGIFAEEQTLVLQIVAGILHLGNISFKEVGNYAAVESEEFLAFPAYLLGINQDRLKEKLTSRQMDSKWGGKSESIHVTLNVEQACYTRDALAKALHARVFDFLVDSINKAMEKDHEEYNIGVLDIYGFEIFQKNGFEQFCINFVNEKLQQIFIELTLKAEQEEYVQEGIRWTPIEYFNNKIVCDLIENKVNPPGIMSILDDVCATMHAVGEGADQTLLQKLQMQIGSHEHFNSWNQGFIIHHYAGKVSYDMDGFCERNRDVLFMDLIELMQSSELPFIKSLFPENLQADKKGRPTTAGSKIKKQANDLVSTLMKCTPHYIRCIKPNETKKPRDWEESRVKHQVEYLGLKENIRVRRAGYAYRRIFQKFLQRYAILTKATWPSWQGEEKQGVLHLLQSVNMDSDQFQLGRSKVFIKAPESLFLLEEMRERKYDGYARVIQKSWRKFVARKKYVQMREEASDLLLNKKERRRNSINRNFIGDYIGMEEHPELQQFVGKREKIDFADTVTKYDRRFKGVKRDLLLTPKCLYLIGREKVKQGPDKGLVKEVLKRKIEIERILSVSLSTMQDDIFILHEQEYDSLLESVFKTEFLSLLAKRYEEKTQKQLPLKFSNTLELKLKKENWGPWSAGGSRQVQFHQGFGDLAVLKPSNKVLQVSIGPGLPKNSRPTRRNTTQNTGYSSGTQNANYPVRAAPPPPGYHQNGVIRNQYVPYPHAPGSQRSNQKSLYTSMARPPLPRQQSTSSDRVSQTPESLDFLKVPDQGAAGVRRQTTSRPPPAGGRPKPQPKPKPQVPQCKALYAYDAQDTDELSFNANDIIDIIKEDPSGWWTGRLRGKQGLFPNNYVTKI

SEQ ID NO: 1207 - DNA, 25519 bp, Mus musculus
  misc_feature (1)...(25519): n = A,T,C or G
cttgatccctgagacctgcatggtggaagaagaaaactgactccagcaagctgtgctctgaccttcatacttacacagttgaaacccacaagcattcacacacacacacacacacacacacacacacacacacacacacgcaccaaataaataagtagatgtaaacaagacaaaaacaaaacaaaacaaaacaaaacacaacccagagagtaaagaaaccactttttttctcagccaagggaaatgtacacagtgccccataccataagtcacgtagtcgagtatcctagatttgggaaaatcacgggtcagcacattccaagtgcaatgggtgtgcctcgcttgggaaaactaccttcctgatcatagtgtctcccctgccaggtaagtacgagaaaccactgttttttaagaacaagaacttcgagtagactccacatgcagcaaggcaggaatggttaaatatctcccaatacatccttcagttccactgtgtataataacatcaagttctgttttcaaaatactttcatgaattatatagagcaccacactatggctagacgccgatggtttctttcctctttgggtatgtgtgcgcatgtaccatggcgtggatggagagatcagaggagagctgggaggagctggttcttttcttcaaccgtatggaaactggggattggacacaggtggtcagcgcttagtggcaaacacctttaccaactgagtcacctagctggaccaactcttggctgttttttctttttgaagagatttgttatgccgtatgtatgtgggtgttttccctgcatgtttgtctgtgcatgagtgctgaagggagcaccagatgccctgggactggagttatagacagtttctgagcctccatgtgggtactgggagcaagatgtgggtcccctgggagaccagcctgatccgaaacactgagcctactacttagctttttttttttttttccataatatttgagctatcccagaggtagacgggtgtcagatggcacctttgggtgtaaccctgatggttcgggccaggaaacggcatcagggactgttttctccccggaggaaggctacagagggctgggtgcttgtagagcctccgccctctttctttgagtctctcatagctttttcctcatacttctctgttttttaccccctccctcctggccttggtggcttcctcaaagtgtctgtggtgcctgaaataccacagttcacacttctttcagggccttgttcctttaagtcatgactcttaaagctcttctggtcacaggtatgtcggcggggtcttgggggatcctcagggtggggagaagggggtcctcagattggaaaggaggggatctcttggatctatgaatggagaggaaggtcataggaaggagtaggtggggagagatcaaaggttttagggaatgtggataccgagacttgaactcaggtggtcggtgtttaatggcaagcacctctaccaattgagtcaccttgctggacaaactcttggcatttctttgaaaaaagggaatcattgagtgtgtgggtgttttacctggatgcaggtctatccatcaggtgtgtgcagtgctagtggaagtcagtagcgggtatcaaaaggggagggggatcttttggatctgtgagtggagagaaaggtcagggaataggaaggagctaggtgaggagaggcaaagggcattagggaaggataaaggattccaaaagaaaaagagcagaggtaggcaggaggaatagttagggatgcatggatgaaggactaaatccatcgatgctgtgagggttgtttggcagacaggctaccaggatccagagaggtgaaggagctgcaccagggagcgcagcggatacatttccggctgtgtttcaacacataccacttctccttagtcttacgttctaattaccaagaacctagtgtggatgtttgttgaatgactgataatcaaaaaaaaaaactgttttgtttccttttatgtctacttttgtagagagggagtcaagaagggaaggaactacttgaaacttgcataggaaggaaaatttctaactgagccctttgttgtgtaaaccattgtggttgtgacagtgggggaagaggccattgtgggcttagaaagggactggtcataccccatcataggcatttgtgcaggcctttgagcctgcgtcagcatatttggcctgtgggttaaatactcttgctacctgtcttaaaagacaaacatctatcatccatcaatgatagaggatgctagctttactcccagtgaagtgaaatgtcactccttaagagtctcattcatctcctggataaacctgtatcacaaaaattgtgataatgggctacagtttgagattccttgatgaaaacttggtagatagaggtgaagcccagggcttgcctagtatgtacaaagctctcaatttgatccctagcaccagataaactggatacagtagtgtacacctgtaattcctgcaccctgggggtggggtgtagaggcaggagaatcaggagcttaagatggtcttcagcctaggatgtgtgagacactgtcttgaaaagctcttcaagctgggtgtgatggcacacacctttaatcccagaactggggaggcagaggcaggtggatctctaagagtttgaggccatcctgttctacagagatagttccaggatatccagggctactcaaagaaaccttgtcttgaaacaaccacaccaacaccaccttttcctctatggtcttactatgcagtcctgctggtctggaactcactgtgtaaccagctggtcttctgtagaaaaagaggatggatttctgtgtggtggcccacccctgcacccccagcatttgagaggtagaatgggagacaggaagaccaggaggtctaggttatccacagttacactgtagtgttccaggccagactggactatatacaatcctgtctcaaaaacataacagagagatcccacactgtggatccctgcccaggaccatcagagcttcaatgaatgtggacaggaatggtcacgggtggaaatgtgtgttgttctcttaaccatattggttcctttgctttgactcttacttctccgttatccttccagccctagccttgtgtcatggcttcaatctggacactgaacatcccatgaccttccaagagaatgcaaaaggctttggacagagtgtggtccagcttggcggaaccaggtaaagtcctcaggggagcctgctgtctgctttgcatggagaagctaggggaaagaagaatttccttattgaggtctcttttgcttttcttttcttttcttttcttttcttttcttttcttttcttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcattcttctttgtgaatggatgggactccattgcgtagactgcattttatttatccagtcatctattgactggcctctgtgcttggcttttgtgaggaagacagtgaacgtggacgtgcacccctgccatgtccctgcctgactgcttcacaactcctctaaccccaaggatcattgtgcatacatctgtcttctcagtacctccagaggctgtgaatatgtccttgggcctgtccctggctgtttctactgtcccccagcagctgctggtgagttgccctccaaaggaagagggtctcgaggggagagatggaagagagggagatgctgggctggaggtcttgtggagggtggaggggttgcaatgggaggacgggaggcaggggcagccctttgactcctgcgctgtccctcaggcctgtggccccacggtgcaccaaaactgcaaggagaatacttatgtgaatggattgtgctatttgttcggctccaacctgctgaggccgccccagcagttcccagaggctctcagaggtaggtcccttagaacgggttgagatggtggctgctcacggtatagtggtgtagggggggtctgggtacagggagattagaaaccctgggtctcttggggagaagttaaggtgatttcattagctccgcacttctaggaggaggagctcaagccactggtctttacacattgctggggtctcccaagcatagtctttggtgctgttgatggggtagaccctgctctctgcttcatcttcttcccacccgttctacgtcagccatcaggcttctgagtttcctactgcctctgttctccaaggacctttccaagatgtcctcagaaccattaggatgggaacgcttttctcaaatcccagatgggaatccattgttaaccttctggagtaaatatcaactctttcgagtcattcatggtggtacttccttgtgatgccagcaccaggagaccgaggcaggaggatcatgggtttgaggctagtctggactacatggcaggactctgtctcaaaaactaagaaataaaataaacatcaagttgccgtgcaaagaggtctttcctctgctctgtgtctttctagtcatctcactatcagccatgaaactcttgtttgacatctcacatggacctggctactctgttgctgctgctgttgtttgacatctcacacggacctggttactctgttgctgctgctgttgtggttgtttttaatctcttctttcctctgcatgtgaacaggtacattgccaggcacattttgtatgtcctgtgtctattgttgcctaacaaatccagtggtttaaaaccgtgaacatttatcatctcaaattttatgtgagtcaagaattttggcatggtttagactttacttctgcatctctcaggagactgcagtgaatctgtttagccagggcttccacttcctttgaagtcctgactggcacaaggttctgctccaagctcctgtctgtgcctgtggaactggtgagctctgtttcttgtaggctgggggtctccccagcggcttgtctcgtggtcacttcctggatcagctggatcatctcagagtgaaggagacatcagggcatgacaggaggggtaatcaggaaggtagggatggggagaggtgtagccagcatttgctactgtgcgggttcttctctcttccacccttctccgctctttctttttcaccccccttacactagataagagagagaaaaagacagagaggaaagaaagagatctctgaataaagtcaagggtcaaaaatggagaacattattcttaaactactccctgctgattgggatgttgaactccttggggcatgtttgatcttcactaccaggatatcgaatttcttcttctttcttctttgcacatgactacttaacaaaccatggccaacaacatgaatcaacaaacaatgaacaatccatctacaactttcaactagctatctatctggaccttagcatttatataccctttgaaaagttcccagaattccaaatgtcacatacttgcagaaactatctgtagctggcaaaactattcctctgatagagcacgaggcaaatcatagttgctggtgtggacaatctgaagcagccccacatccacacccgggattaaaacaaaaacatattcttatctgtgttttttaacaaaattcttattatagagaggtagatgaatagatggggacagggataaagggtaggtgagggagagagggaggaagggagagacagaggcagagacagggagagtcatcacagaattgttatcaggtatttcagaattaacatctcattacctctgctgtattctaattctttggagtaagtttaaaaaaaaaacagtccagctcagctaggtgtagtggcctatacctgtgctcctaacacttgggaggaggaggaggagggtcaggtgttctgggacatcttcagctgcacagtggagggagactgccatagttactgttctattgctgtgaagagacaccatgaccaaggcaactgattgtttgcttttagtgtttggtgtattcttagtgctcattcacttaacaactatcttaagttttctctttttccctggaatctcttggatgttcactctctaggaatttctctagagccagctttagtggcttttttttttttttttttttttttatgggggtaagtttttctttcttcttcaatgatgacaactttgctaagtatatcagcctgggttggcagctatgtttttttttttttttcagaacttcaaatgaattcattattctaagtcctggattttagtattctcaactgaaattaaattaatgagatgaaattaaaaaaaccagctgttattttgataggcgctcctttgagtgcaatcaacctttctcaaaggttttcagtacacttcttttgttttgtataattagtggttttcactgtcttgtgatatggggagtttccttaacagtcctgcctacatggggctctgtctgcctcttgtacttgagtgggcatctctttccctagagttggaaatttttcttctatgattttattaaaactgtatttctaggcctctggaatagaacttttctttttctatgttcataattgtagattttgtctttttatggtgtcttaaagatttcatgtattctgtccatatgtttttttttaaaacaatatcattctttttgactgaatgaatcaattacactactttttctttttaaaccttccttccttccttccttccttccttccttccttccttccttccttccttccttccttccttccttcttgccttcctgccttcctgccttcctgccttcctgccttcctgccttcctgccttcctgccttcctgccttcctgnnnnnnnnnnnnnnnnnnnnttcttttttttttatggtatgcatgccctgtgtgcatatacccctgcataccaatgccaggagagaacattaaatccctgtatagatggttgtaagccaccatgtggttgctgagaattgaacctctgaacctctggaagagcagccagtgcttaaccgctgatccatctctccaaccccacactactttttcttcaagccttgatactctgtgaaacacaatccctgcgtggggatttctactgagatttttgttttttcttatggaagttccccccatcatcatctattgtttttatttagcattgcttttttggattctatttctatccctagaattgactttcttaattcattcaactatttgtgctttctttgaattcattcaggagtttattagtgttgtctttgaaatccatcaacatatctgttaccatttttttcgaattcattgtttatagtttcatcaaaatgactctcatcggaggccagtactatttagctggtaatttttgtggggacatgccgtcttggctttttgtggtgtcttgattgtgcttttgtgtcaggactgccacacctgtagttgttttgttggctgactcttcctggcacacacggattggatatttggactgatgctttgcaccatgatattacgtcaggtcttgacttactcaggtatagcttgaagtttagtcatggtgagacttaggactgatttgtgggtggatcagctaggttgaccctttattggctacagtgagaatgacttccaactttgcacagtgtggtgggggttggtttctgacctcatgagcgtgggttcagggtttagtgtgctagtgagttgggtgctgggtgcatggtttcacacggctctgacttcaggagtctggatctgcacatatatgcatggtataaaggtcagggtattatagatggcagcagcagggtttcctgcatcttctggagttggtttgtgcagtcagggtgtcacaggtaggaacaagatttcatgtgccctctggccttaggagttagaacccatgcattagcaggccatggagtactggtgttaccagactcagcttgtgccccaacaagctaggttcatctatctgtcttcaatgagctaattgaaagagctgaattaatagtgaaaagtagaaaatgtttattcaatatggtcacatggggaaattcaacggcccagtgaccttcttcccagtctgccttggagggagagtttctaaaatagaatgcatgagctgggtggtggtggcgtatgcctttaatcccagcgcttgggagacagaggcaggtgaatttctgagttcgaggccagcctggtctacagagtgagttccaggacagccagggctacacagagaaaccctgtctcaaaagacaaaaacaaaaacaaaaacaaaaacaaacaaacaaacaaaaaatagaatgcatgagattaaccctctgaaactgtaagcaagcatccaatttaaatgctttcttttataaactgacttggccatgatatgccctcacagtaatacagtacagtattatacagtactgtatgtatagtaagctgaccataaagaatatgttctagttagatgggtacccactaaataccagtgatgggaaggtaccatgagtattcatccctggactaggacaggcttagtgcctgtgagggctgcagcgatccccactggtgaatgaagactgtagatatctaaggtggggaaagatgttggtactctcttgcctagcttcctgtcatagggagaagcctctattggtttggcactgatcttggctttggtggccaggtgtaggctctctgtggccagccttgacacactctggcaccctccctagttatttccatccaaatgcagttggttttcatcgcactgcctaccaaggacttctggtcacccatcttgctgatgtgcaagagatctgtccatattttattttcttttgtgcaaaatcacaatcccccccccattgtccagctgagagctgacagtcaaagctgacatttctaatgacttaactaatatgtattctttttctctcttgcccagaatgtcctcagcaggagagtgacattgtcttcttgattgatggctccggtagcatcaacaacattgactttcagaagatgaaggagtttgtctcaactgtgatggagcagttcaaaaagtctaaaaccttggtgagggctagtgggtagccctacacaaggctgacactcatgacaaccgggctgccactgttctttattattattgttgttgttgttgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttaatggtgtacgaaaaagaaaaaccgaaccaaaacaacacaaaggacaaaataaaaataacttgaactcaagccaccaaccccaagtttatattcagtgtgggtctgctgtaagttttaagcaggcagggccgttctgtctgtgttgttataaagattgctctggttttggcgtgtatgcagagatgagtgtggggttgggcggaagtgtaagaagctgagagtctggctaatgaagttaacaaagtgcttgcaatgcaaacgtaaagacatgagttccacctccagagcccatgtaggaaagccagacccagtggcgattcgcttgtaatcctgatgccagggatgcatagataccaggatccctggagctcagtgcccagggataatagcccagcataactgagctctgtgctaatgagaaaccctgtcaagtggacagctgctgagaggtgtgacacattgcagcctctccttttctccctttcttctctctctgtctctgtctctctctccctctctctctctctcacacacacacacacacactacaagggtaggaaaatgaggtagaaagcttgtatagtaaatctctgtgggtgagatttggttatggactgagaaggtctatttctttatttctttacatttttcccctatatttaacagtaacaaggaacctacatgtggtggtgcataactgtaattcaggagatagaggcaggggatcaccaatttgaggctcagcaagactttgtgttcaaaacattaaaaacaaaaacaaaaaccaaaaaaaaaaaaaaaaaccaaaaacccaacaaaaccaatgaaacttaggggggagaaccccacgtagacagccaggctcagcacctgcgatcctgactctgtagctgcctcatgccggatgctaacaatatctctgcccattcgtgtgtctgccgtcctcttccctccacaggagagaactgtttcacaaaaccaatggggcccgggagaatgctgcgaagatcctagttgtcatcacagatggagaaaaattcggtgatcccttggattataaggatgtcatccccgaggcagacagagcaggggtcattcgctacgtaattggggtaggaagtacagatattgggcttggtacttctgtggagattggagatttcctaccaatgtggtctgtcttcaatatgcaaacatcaataaaattaacggaaggcaaggaccattgctaggccgtatgcccagctgccacatatctatgccacaataatgctgtatatgtaacaaatgattcaaaatccagtggttttataggtaagctcgtcgtttggcaggttcttttcttggactcagcaaggctcacttacgcatctgtcattagctacaggcggggggggggcagatctgctaagcttgcctttgctctccccacttctggatgctttagatttgtctgctgagaaagatggccttgctgggaacaagtcaggtagcttggctctactgcttcctgggtctcattttccagtggcctcaccttcggatgctctcatgatgaaggcagaggagagagggagtagatgttgcaggcatttttatatttatttttgttttgtaagcttctatttgggtcacatttgctatcaatccagggctgacacagagacagtaagtggggcaggatattccaccaagagtagatgggtgtggcaaaaattgggaaaaagacttgggtccagaaagaggtaaaatgctgggatcaccagtgtaatcacgcttgtgcgccaccttgaataacatagaaaaaggtatcacaaaatgacagtgtggcaagtaagaaggacttgcacatataaacatgattctcttggggatggagagatggctttgtaagagcacttgttgttttcccagaggatcagagttcagttcccagcacctgggtcaggtgctcataacagcttgtaactccatctccaagggatttgacaactctggccatagacctacacatgcgcacacacatgcacatacccagacacacaaagacacacagaaacacacagacacacacacaaagacacacagacacatagacacacacagatacacacacacatacagacacacacagagacacagacacatagacacacacagacacacagacacatagacacacacagacacacacagacacatagacacacacagacacatagacacacacagacagacagacagacagacacacacacacagacacatagacacacacagacacacagacacacacatacacaaagacacacagacatacacacacagacacacaaagacacacaaacacacatacacagacacacacacacaaagacacacagacacacacacaaagacatacagacaacagacacacacagacacacaaagacacacaaacacacatacacagacacacacacacaaagacacacagacacacacacaaagacatacagacacacagacacacacagacacacagacacacacagacacacacagacacacacagacacacacagacacacagacacacacacacacacacagacacacacacagatacacacacacacacagacacacacacagacacacacacagacacacacacacagacacacatacacacaaagacatacagacatgtacagagagaaagagagacaagaaaaaagatagacttataagcaaaataataatattaataaaaaaggaatatcttttgctggagagatgtcagcttcctaccagatggatgatggatgacatgacagatggatggccatctggagatcaaattgctccctgtgctatgtacaacctgcctaactgtccccaacagccctgttctaagctgccttctgctgaactctctattggacagaaaaagtttcagattctttcatcaaggcattttctttgctacatggggctgctaccatcagaggatatataatttagctttggctccttggcaacaggtgggaaatgccttcaacaaaccacagtcccgcagagagctcgacaccatcgcatctaagccagctggtgaacacgtgttccaagtggacaactttgaagccctgaataccattcagaaccagcttcaggaaaagatctttgcaattgagggtgagacagcccagtccggaccagcagttcctacttagcatccgtaccccagcatcagcttatctccagacatttgggtctgacttgctccatccctttgaaataagcaaagctagatttttgtctctaattatcagatctagactataggatgattaaactgtagcacagtggatttaaatcctacacaatatataccaaaaaatttatatgtgctatgagcactggttgacttagtcatgtctcctctgcctagcatagtgtgttctacagagaaatgtccaaaattttttcttcttcttcttcctcttcttcctcttcttcctcttcttcttcttcttcttcttcttcttcttcttcttcttcttcttcttcttcttcttcttcttcttcttcttcttcttcttcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgctactacacctggaccacattatggcatttcatatataatctggattatggcttttgtggaaaagttggaaggttaaataccttgaggaccccattcttccttgagaaaagattgccatagctgaagggctgccatccctgtgaggtgcatgtgtccatctcaacaccagagcctccctctgcctggtaacgatagcatttgaggtttggggtatttggtctatgctttaccgcttgctttaatgaagaaagttttcttccttacaggcacgcagacaggaagtaccagctcctttgagcatgagatgtctcaagaaggcttcagtgcttccattacctctgtgagtggtcctgtgttaaattgggcgtgaagatggggcacaaaagaaagaagaattgtgtagccgcatgctttctcacccagcctctttggtcccagcaataatgattctgaggcttagttatatattaataaacgcttaggccataggcttcagcttgcccctgactagctcagttacttatagaaccagttttaactattcaacatcttccacatggttagtcgcctctccttcagtctcatgcaaccatctcttccagagttcagggcgaatctttccaacctgactctttcccagagttcctctctctccctgccagatgtcctacctcctaatcctgccttagctcattgaccatagtcttttttactgataggtcatgcttccatacatcatagaggagattctctctatagatgagcaagggtttggggcttttctccagagcaggttgtcatggagaggcttcttggtaggcgccactggtcatctctttctccacctctcagttctgttatgctcctttccccagaatggtcccttgctgggctctgtggggagctttgactgggcaggtggagccttcctgtatacatcgaaggataaagtcaccttcatcaacacaaccagagtggattcagacatgaatgatgcttacctgggtaagtgaagaggacaggcattgctctaggaaggggtgaggatgtgacatctctcggctgacatggatgcttgttggcccttgggagagctgtagagattcttttctatttctatttaatttagttatgttcatagtagttacaccaacacatcacgcatggggatgctct

SEQ ID NO: 1208 - DNA, 349 bp, Mus musculus
gatcattgtgcatacatctgtcttctcagtacctccagaggctgtgaatatgtccttgggcctgtccctggctgtttctactgtcccccagcagctgctggcctgtggccccacggtgcaccaaaactgcaaggagaatacttatgtgaatggattgtgctatttgttcggctccaacctgctgaggccgccccagcagttcccagaggctctcagagaatgtcctcagcaggagagtgacattgtcttcttgattgatggctccggtagcatcaacaacattgactttcagaagatgaaggagtttgtctcaactgtgatggagcagttcaaaaagtctaaaaccttg

SEQ ID NO: 1209 - protein, 116 aa, Mus musculus
IIVHTSVFSVPPEAVNMSLGLSLAVSTVPQQLLACGPTVHQNCKENTYVNGLCYLFGSNLLRPPQQFPEALRECPQQESDIVFLIDGSGSINNIDFQKMKEFVSTVMEQFKKSKTL

SEQ ID NO: 1210 - DNA, 14469 bp, Homo sapiens
  misc_feature (1)...(14469): n = A,T,C or G
tttcttttgctgtgcagaagctctttagtttaattagatctcatttgtcaattttggcttttgttgcaattgcttttggtgttttagtaaggaagattttgcccatgcctatgccctgaatggtactgcctaggttttattctagggtttttatggttgtaaattttacatttaagtctttaatccatcttaagttaatttttatataaggtgtaaggaagggatctagtttcagttttttgcatatggctagccagttttcccagaagcatttattaaatagggaatcctttccccatttcctgcttttgtcaggtttgttgaagatcagatggttgtagatgtgtggtgatatttctgaggcctctgttctgtttcatttgtctatatatctgttttggtatcagtaccatgctgttttggttactgtagccttgtagtatagtttgaagtcaggtagtgtgatgcttccagctttgttgttttgcttaggattgtcttggctatatgggctcttttttggctgcatatgaaatttaaagtagttttcacaagatcagctacagccaacttttacagcaaacggttaggctgttcctcctgtggtagtaggaggcagggtttttttttttttttttttgagatggagtctcagtctgtcacccaggctggagtacagtagcgtgaactgcaacctctgcctccaggttcaggtgattctcctgcctcagcctcctgagtagctgggattacaggtgcccaccaccacacccagctaatttttgtatttttagtagagatggcatttcaccatgttggccaggctggtctcaaactcctgatctcaagtgattcacctgcctcagcctcccaaagtgctgggattacaggtgtgagtcaccgaacccggccctctttgcccatttttaaattgggttatttattttcttactattgagttctttatgtgttatggatattaaccatttatcagttgtgtggtttgcaaatattttcccccagtctgtaggttgtctcttcactctgttaattattcctttattgtgcagaagctttttagtttgatgcaattccatttgtctgtttttgtttttgttgcttgtgctttcaggatcatataaaaaaatcattgcccagaccaatgtcatgaagctttccctctacgtttccttctaatagtttatagtgttagatcttacatttaagcctttaactcactttttaattttttttattttttaatttaattttattttagatggagtctctctctattgcccaggctggagtgcagtggcacgatctcagctcactgcaacctccacctcccgggtcccagcgattctcctgcctcagcctcccaagtagctgggattacaggcctccgccaccatgcctggctacttttttgtatatttaatagagacggggtttcaccatgttggccaggctggtcttgaactcctgatctaaggtaatccacccgcctcagtctcctaaagtgctgggattacaggcgtgagccactgcacccggcccagcacttttgatttttgtatttggtttgagataaaggctcagtttcattcttttgcctgtggatatccagtgttcttaacaccatttgttaaaaagactgtcctttccccattgtatgcccttggcacctttgttgaaaattagttgattgttggccgggcgcggtggctcatgcctgtaatctcagcactttggaaggctgaggcgggtggatcatgaggtcaggaaatcgagaccgtcatggctaacatggtgagaccccgtctctactaaaaatacaaaaaaaattagccaggcatggtggtgggcacctgtagttccagctactcgggaggctgaggcaggagaatgggggaacctgggaggaagaggttgcagtgagcctacatcatgccactgcactccagcctgggtaacagagcaagactccgtctggaaaaaaaaaaaaaaagaaaagaaaattagttgattgtaaatgcatgggttcatttctgagctctgtattctgttccattggtcaatgtctctgtttttatgtcagtgtcatgctgttttgctgagtatacctttgtggtgtattttgatgtcaggtagtgtgatacctctacctttgttgtttatgctcaagattgtcttggatatttgaggtcttttgtgacttcatattaattttagtattgttttttctatttctgtaagaaatgccattgggattttggtaggaattacattgactctatcgatcactttgaatagtatggacctttaaaaatattctttcaatccataatatgggatatctttccattgatttttgtcttaactttctttcgtcaatgttttatagttttagtgtgcatatttttcaccttcttggttaaattaacttgtaagcattttattttttgatgccattgtaaataggattaatttctttttcagatagtttgttgttagtgtatagaaacaaataatttttgtatgttcattttgtattccacgactttactaaatttgtttattaaatttgataactttttcgtagagtatttataacaagtttcttatatataagatcatgtcaattgcaaacagggacaatttttttttctttatttctaacttgaatgcatttcttatctttttcttgcccaattgctctggctaggactttcagtactgtgttgaaatagaagtggtgagtgtgggcatccttgccttgttcctaattttagtggtaaaatcaaattttcaccactgggtatgatgttaactagacactttttttaatgttctttatcatgttgatgtaatttccctgtatttctagtttgttgagggtttttaatcatgagtggctattcctgtggcctgaatgtttgtgtcctccccagattcatatgttgaagcctaattccttgtgtgatggtatttgtagatgggacctttggaaggtgtttaggtcatgagagtgtggccatcattaataggattagtgcccttagacaaaagcaaaatgatggttgcctatgaaccagaaaataggctctcaccagatattgaatctgcttgcaccttgattttggatgtcacaagtcttcagaactatgagaaataaatttctattgcttataacccatccagtctatgttatttgttataccaaataagctaagacagatgtttagttttattaaatgctttcttttcttattgatatgatcatgttatttttattccttattctgttaatgtggtgcatcacatttattgatttgcatatgttgagccatccttgcatgccaggaataaagcccacatggtcatggcgtatgacccttttgtgctattgaattcagtttgctagtattttatttaggattttggatctatgttcaatagggaaattggcatgtagtgatcttttctcatggtgtgtttgttgggatttagtgtcaggatagtgcttgcctcatacaataagtttggaagtattccctcctcttcaattttttggatgagtttgagaagaattcatattaattcttatttaaatgtttggttggtagaatttgcctgagaagccaccaggtcctgggcttttctttgttaggaggtctttgattactgattcaatttccttactcattatagatctgtttaaactttctattgccttatgattcaggcttggtaggttgtatatttctaggaatttatccattccttcaaggttatcaagtttgttaacatataattgttcatagtagtctcttaatgatcctttttattgctatggcatcagttgtatgttctttcatttataattttacttatctgttgtttctgttttttctccctttttccttggtctacctaaaagcttgtcagttctttttttttttttttttgagatggagtctcactctgttgcccaggctggagtgcagtggcatgatcacagctcactgcattctccacctcccaggttcaagtgattctcctgcctcaggctcctgagtagctggcattacaagcacgtgccaccacacctggctgattttcgtatttttagtagagacagggtttcaccatgatggccaggctggttttgaactcctcatctcaggtgatccacttgcctcgacatcccaaagtgctgggattgcaggcgtgagccactgcacctggccaaagcttgtcaattctatctttttgaaaaatcaacttaatttcattgatttttttctattctctatttgatttatttttctgtaatctttattattttcttccttctactaactttaggtttagtttgttcttttatttctcatttcttgaggtgtaaagttaggttttgtaattgaaatttgtctttttgttttagaattaggtgtttatcccgaactttcctttagtactgcttttgctgcctcccattaagtttggtatattgtgtttttgttttcatttatctcatgttattttctaatttatttttttatccattagttgttcaatggtgtattgtttaatttttacatatgtatgtttttttccagtttttcttctggtattgtttttagtttcattccattgtggttggaaaagattcttgatataatttaaatcatttcaaatttgttaagacttgttttgtgacctaacatgtggtctgtcctggggaatggtccatgtgcacttgagaagaatgtatattctgcagtagttggcttgtgtattttgtatatgtctgttaagtccatttggtccattctcccttgggttttttttttgtctagttgttctatttgctattgaaagtaggattttgaagtttcttactattgaattgctgtctatttctcccttcagttctgtcattattagctttatatattcagatgtctgatgggtgtgtatataattaattgttgtaactcctggtgaaatggccatttcatcattatataatatcattatttgttttttgacttaaagtctattttgtctgatattagcatgtcatcctgctctcttttggttaccattttaatggaatagcattttctactcctttacttttagcctatgtgtcagtaaatacaaagtgggtatcttgtagatagcatataattggattttgtatttttattaattctgccactctgttttgagagtttgcttctgtttacatttaaagtaattattgatagagaaggatttactactgccattttgttaattgttttctgttagtcatgtaggtcttttgtccctcttttcttctcttgctgtcttcctttgtgttttattgttgttaatttttgtattaatatgctttcattttgttctctttttgcacttttttttttttgagacggagtctcattctgtcacccaggctggagtgcagtggtgcgatcttggctcactgcaagctccgcctcccgggttcaggccattcttctgcctcagcctcccgagtagctgggactacaggtgcccaccacctctcctggctaattttttgtatttttaatagagacggggtttcaccacgttagccaggatggtcttgatctcctgacctcgtgatccgcccacctcagcctcccaaagtgctgggattacaggtgtaagccacgtgagccaccgcgtctgaccctttttttgtgtatataacttctaaaggtattttctttgtggtttccacaaaacatctcataattatcatggtctattttaagctgataacaactgaacttaaatcacatgcactctatacttttattccccactacacgttttacgttattgattcacaatttacagttatttatattgtgtatccagtaacataattttagctatagttatttttaatatctttgtcttataacttttataccataattaaaagtgtccaattcacttgcattaaggacatgacaaaatcacttttaaaatttctttaaaatttattatttggctgtcatttttttcaatattactcttgcacatactttaaagagtcaaaatagttccaaaaagctcactattaaaaaacaacaatttccacatacacgatggttttggcttcatttcccttgctcttgagggaaccactttcagctctttcaattctctatttgttccaattacataataataattttgctactttttgatttttgttttaccactgacttcccaccatggaaggtggagattgatctctttttcagttttccttttgccacatagtagcactcttttaccccccattcacgcctcatgtttatgtgatcattttgtttagatcaacattcagtgtttgcattattctgactacgtaaatgaaattcagctgagccaaataatatacttttacttttccctgtatgcagggaaatgcaggtaattaatagaaattggggttgggcgtggcggctcacacctataatcctagcacttgagaggctgacagggcagaatcgcttgagcccaggagttcaagaccagcctgggccacaaagtgagacccccgtttttattttaaaagtttttttaaaaaagaaattgtaggtatcctcttgaggttgtggtctaaaggtgaataattccttgataagttctaagctgtcctagttccttggttagttgcaagagatgagacttgagtagagcttagagaacctctgtctgggccatgctggatgactgagttatacatctcctgtctttcctacccctttctctctccacacctcttttttaccctcagcggatagcaggctccaagctctctcccaggctccagtattttggtcagtcactgagtgggggccaggacctcacaatggatggactggtagacctgactgtaggagcccaggggcacgtgctgctgctcaggtgagaatgccttttggagtcaaccggacattctcccttgaaggaatgtttcctgtttgaaggtccctgatggttttctggtgtccctttaggtcccagccagtactgagagtcaaggcaatcatggagttcaatcccagggaagtggcaaggaatgtatttgagtgtaatgatcaggtggtgaaaggcaaggaagccggagaggtcagagtctgcctccatgtccagaagagcacacgggatcggctaagagaaggtgaggcttggtggatgagtctcaagaggttaaacgaccgaggacatgaatgggtgctgcaatccactctgcccagccttctggctgtcctgaactgagttctcacaggctctgacaaccttctccaagccttacctgagtgagcaggctattgtcctgctgggtagggaagtccagtggacctccctaaagaggtgagcatgtggcacttccttactcactcagttctccagagaactgaaggccccatgcctgtgaacaaactatgtttttgttttttaataaacggagagaaaacctatttggggagattgaattgatgaagctaaacagagatttacaaagcactcacatacgcattttatcaccagtgacttcttcccttgttcctattctcaaagagtagaactgtgtttggggtgggagaatagtaatgacaatactaagaataactgtctctagtagtgacagcactaggaataactgtctctagtaatgacagtactagaaagaattgtaccctctttaaaagtaaaattattagctaggcatgatggcatgttcttgtagtctcagctacttgagaggctgaggtgggaggggaggatcacttgagcccaggaggttgaggccagcctgggcaacatagcaagacccatccctaaaaaatgattacctttctaggaacagttttcctgtgctgaggagatagcattccagatatgagagcagccagcatggctagaaattaagagcaaaatgttagagagtagggaattgaagaagaggtacccttaaacctacatagaagtccccctctactctttggctgactcttaagacacgaatgcctaggtcagtactccaagacacccagtagaaaacagcaactgaaaagccaaagagctgatcagagaattcagcagctcctcagtgctggggagacagagatttgagaggccttggtaaataccttggtctttccattgagacaactgactagcaaccaagagaaacaatatacaatagaaatagacccacaggtgattcagaaattagagtgattggataggaatttttaaaaggtaactataattaatatcttcaagaaaaaagggaaaggatgagaacttcagcaaaaacctggaattcataaaatagagtcaaatggaaactctagaaccaaaaatcgcactgactgaaatgaagaattcagtaaatagatttatagcaggattagaagcagaacagagaattagtgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagcactttgggaggccgaggcaggtggatcacctgaggtcaggagtttgagaccagcctggccaacatggtgaaaccccatctctactaaaaatacaaaattagcaggtgtggtggtatgcgtctgtaatcccagctactcaggaggctgaagcaggagaattgaacctgggaggcggaggttgcagtgagctgagatcgccccattgcactccagtctgggtgacaagagcgaaactccatttcaaaaaaaaaaaaaaaaattccccaaactgatgaaagacatcaagattctttacaaaatcaaagcaggataaatatgaaggacattatatcattgtacgttataatcaaactgctgaagaccaaagacaaagagaaaaaaatttaaagtagtcagaaaaatacaataaattttttagtgagtgacagaatagctaccatttattgagcacttattgtataaaagacactgtgctaaatacttgataagcactatttcatttcctttttaccattgggagggtatcattattatcctcactttaaaaataaagaatggaggccaggcgcagtggctcatgcctttaatcctagcgctttgggaggctgaggcaggtggattactttgagaccagcctggctaacatggtgaaaccccatctctactaaaaatacaaaaattagcacggcgtggtggcatgtgcctataatcccagctacttgggaggctgaggcaggagaaacgcttgaacctgggaggcagaggttgcagtgagctgagatggcaccactgcactccagcctgggcaagagagtgagattctgtctcaaaaaagaaaataaaaaataaaaagaaaggaaggaaggaagaagggaaggaaggaaaggaaggaaagtaggaaaggaaggaaaggaagaaaaggaaggaaggaagaagggaaggaaggaaaggaaggaaagtaggaaaggaaggaaaggaagaaaaggaaggaaggaaaggaaaggaaaaaaggaaggaaggaaggaaagggaggaagagagcgaggaaagaaagaaagaaagaaaaaggaaggaaggaaggaaagaagactcagagaagtcagataacataccccaagtcacacagctgagaagcagaggagctgggccttgaactcccatctgccgggttccgaggctcaggcccctcactgctgtgccaccctgtcccttcaggacagatccagagtgttgtgacttatgacctggctctggactccggccgcccacattcccgcgccgtcttcaatgagacaaagaacagcacacgcagacagacacaggtcttggggctgacccagacttgtgagaccctgaaactacagttgccggtgagcaggctagtggccagacccctgggtcttccaagcatggagtgggcttggggagctgaggagggcagatccccaaatcccggctatctcttagaattgcatcgaggacccagtgagccccattgtgctgcgcctgaacttctctctggtgggaacgccattgtctgctttcgggaacctccggccagtgctggcggaggatgctcagagactcttcacagccttggtgagtccagagttggggtcctgcaggggtgtggaagagaccagagaccaaggtggttgaaactcattttatttgattgcatctaattttacttcaacatttgattttattgtttaatttcacaatacttggttattttctttcctttcatttgatcatatttattttttaaaagtttccctttgagaagaattgtggcaatgacaacatctgccaggatgacctcagcatcaccttcagtttcatgaggtgagtttcctttcctcctcacctcctccagagaaggacccgtaccatgacccgctcttttctcctcctggcccccaagggagccgggtgttcctgggctataaggtccggtgtggctgcccctccactgttgtctcttcatcaagtgtctgcgtctctgttctgccggagcaggcttgccacagggaagcccagcgccccatcccccggcctgtcttcttcttcccacagcctggactgcctcgtggtgggtgggccccgggagttcaacgtgacagtgactgtgagaaatgatggtgaggactcctacaggacacaggtcaccttcttcttcccgcttgacctgtcctaccggaaggtgtccacgctccaggtagccacatccttctcaggctctatctgacctttgcttccccatcctcacggccggaggtggatatcaccgcctttgcctcccctgccttccagaaccagcgctcacagcgatcctggcgcctggcctgtgagtctgcctcctccaccgaagtgtctggggtcttgaagagcaccagctgcagcataaaccaccccatcttcccggaaaactcagaggtcagaactcctggctcctcccctccttttctctttgatttctttggggattcttttcttcttcttctcttctttagtagtggttcctttttgtacaaaacagctttattgagatataattcatataccatccaattcacctatttaaagcatacatttcaagcccggcacagtggctcatgcttgtaatcatagcactttaggaggtcgaagcaggaggatcgcttgagcccgagagtttgaaaccagcctgggtgacacggcgagaccctgtctctacaaaaaatgtaaaaattagctgggcgtggtggtgcacacctgtagtcccagctactcgggaggctagggtgggaggatcgtctgggcctgggaggttgaggctgcagtgagctatgatcacaccactgcactctagcctaggcgacagagtgagaccctgtcttgaaaataaataaaatgaaataaaataaaataaagtatacagttcagtggctttgagtgaattcatagggtcttgcatccgtcatcatgatccattttggaacatcttcattacctcacaaagagcttctgttcccgttggccctcagccccagtcctcccatatcccccagccctatgcaaccactaatctactttgtctatagatttgcctattctggacatttcatataaatgaaataatcccgtatgtgatcctttccctagcataatattaagcaaggacttagcaaggatcattcatgtcgtagtatatgtcagtacctcattgctttaaaaaaattgtttttaaattttttatatatatttttgagatggagtttcacttcgttgcccaggctggagtgcagtggtgcaatcttggctcactgcaacctctgcctcccaggtttaagcaattcttgtgcctcactctcccaagtagctggggttacatgcgcccgccaccacacccagctaatttttgtatttttagtagatacagggttttgccatgttggccaggctggtctcgaactcctgacctcaggtgatccacctgcctcagcctcccaaagtgctgggattacaggtgtgagccaccgcacctggccttcattgctttttatttggtgaacaatatcctgttgcatggatgggccatatttcatgtctccattaatcagatgacgggcatttgggttattttttctctcatatttctgtcattgtctctcctttctctcactccaggtcacctttaatatcacgtttgatgtagactctaaggcttcccttggaaacaaactgctcctcaaggccaatgtgaccaggtgctctctgctaccaggcttctgcaggcagttgcccgtctgacgccccagcccctggcccatggtgggcctttgccctttgcccactggttctcccttcaactcatttgttcactcagcaaacactcactgaccacccaccacgtgctgggccttgtgctgagtgctggtgggatggtggtggatcagacgatagtggttcctgccctctcggagatgataatttagtggcaaagacagacaagaaatctagccattaatcttgcatccatctcaaatccagtatgagatgcaagattagatgggggacggccagtgttcttgggagtttggtgttcagagaagattcctaaagaaaatatatttaggagctgggcgtgctggctcaagcctgtaatcccagcactttgggaggctgaggcaaaacaattgctcgaacccaggagttcaaaatcagcctggacaacatatcaataccctgtttctacaaaaaaaaaaaaaaaatacaaaaattagccaggcatggtggtgcatgcctgtaatcccagctactcaggaggctgaggcacaagaattgcttgagcctggaagattgaggctgcagtgagctgagatggtgccactgcactccagcctgggcaatagagtgagacccagtgtcaaaataataataataataataatgataaaaaataaaagggaaaaaaagaaaatatatttagacaaagcaaaggcatgaactgagggcgggcatgaagacagaaggcaggaagcagataccagggacgggaagatcagggtgtgtttaagagtggcctcagcatgaaatgcagggctgaaggagttggtggtggttagatacaggccatgtcccaaaatgactgacgggtgttgtttgggatttgcagtttcgcctctgggagtgacataatcatatttgcatgttagaacgatcactcttcaggagggctggcgattggggtgggagcaggtgtgaattcaggggaccagttagaagaaggtggttgcagacatccagctggagagggatgggcctgggctaggcgggggcaggggttggagaacagtggggtttcagatgcagagataacagaacttggtggctgattggaggcagggagtgagggagagggaggagcaaagactaactgtcagttctcaagagccggctggagctctttctttccctccagtgagaacaacatgcccagaaccaacaaaaccgaattccaactggagctgccggtgaaatatgctgtctacatggtggtcaccaggtgctggcttccaggactttagctgagcctccacttctgggctggacatggctgattgtgcatctgtgtgcatgagtctgtgcatgtgtgtgtgtgtgagagtctgaggatctctgtgcatgtatgtgtgcatgggtgtgtatttgggcatgggtgtgtgagtgtgatgatctatgtgcatgtttgtgtgcatggacgtgtatttgtgcatgtgtgtgtctgaggatgtatctgcatgtgtgtatgtgtgcatgggcgtgtatttgtggatgtgagtgtgatctatgtgtgtgtgcgtgcatgggtgtgtatttgtgcgtgtgtgtgaggatccttgtgcatgggtgtgtatttgtgcatgtgtgtgtgaggatctatgtgcatgtgtgtctgggcatgggtgtgtgtgcatatgtgtgtgtctgaggatatatgtgcattgtgtgcatgggtgtgtatttgtgcatgtgtgtgtatgaggatctgtgtgcctgggtgtgtatttgtgcgtatgtctgaaggtctatgtgcatgcgtgtgcgcatgggtgtgtatttgtgcatgtgtgtgtgaaggtctatgtgcatgtgtgtgcgcatgggtgtgtatttgtgcatgtgtgtgagggtctatgtgcatgtatgtgtgcatgagtgtgtatattgtgcatgtgtgtgtgtctgaggatctatgtgcatgtatgtgtgcatgggtgt

SEQ ID NO: 1211 - DNA, 1186 bp, Homo sapiens
tcagcggatagcaggctccaagctctctcccaggctccagtattttggtcagtcactgagtgggggccaggacctcacaatggatggactggtagacctgactgtaggagcccaggggcacgtgctgctgctcaggtcccagccagtactgagagtcaaggcaatcatggagttcaatcccagggaagtggcaaggaatgtatttgagtgtaatgatcaggtggtgaaaggcaaggaagccggagaggtcagagtctgcctccatgtccagaagagcacacgggatcggctaagagaaggacagatccagagtgttgtgacttatgacctggctctggactccggccgcccacattcccgcgccgtcttcaatgagacaaagaacagcacacgcagacagacacaggtcttggggctgacccagacttgtgagaccctgaaactacagttgccgaattgcatcgaggacccagtgagccccattgtgctgcgcctgaacttctctctggtgggaacgccattgtctgctttcgggaacctccggccagtgctggcggaggatgctcagagactcttcacagccttgtttccctttgagaagaattgtggcaatgacaacatctgccaggatgacctcagcatcaccttcagtttcatgagcctggactgcctcgtggtgggtgggccccgggagttcaacgtgacagtgactgtgagaaatgatggtgaggactcctacaggacacaggtcaccttcttcttcccgcttgacctgtcctaccggaaggtgtccacgctccagaaccagcgctcacagcgatcctggcgcctggcctgtgagtctgcctcctccaccgaagtgtctggggtcttgaagagcaccagctgcagcataaaccaccccatcttcccggaaaactcagaggtcacctttaatatcacgtttgatgtagactctaaggcttcccttggaaacaaactgctcctcaaggccaatgtgaccagtgagaacaacatgcccagaaccaacaaaaccgaattccaactggagctgccggtgaaatatgctgtctacatggtggtcaccaggtgctggcttccaggactttagctgagcctccacttctgggctggacatggctgattgtgcatctgtgtgcatgagtctgtgcatgtgtgtgtgtgt

SEQ ID NO: 1212 - protein, 369 aa, Homo sapiens
QRIAGSKLSPRLQYFGQSLSGGQDLTMDGLVDLTVGAQGHVLLLRSQPVLRVKAIMEFNPREVARNVFECNDQVVKGKEAGEVRVCLHVQKSTRDRLREGQIQSVVTYDLALDSGRPHSRAVFNETKNSTRRQTQVLGLTQTCETLKLQLPNCIEDPVSPIVLRLNFSLVGTPLSAFGNLRPVLAEDAQRLFTALFPFEKNCGNDNICQDDLSITFSFMSLDCLVVGGPREFNVTVTVRNDGEDSYRTQVTFFFPLDLSYRKVSTLQNQRSQRSWRLACESASSTEVSGVLKSTSCSINHPIFPENSEVTFNITFDVDSKASLGNKLLLKANVTSENNMPRTNKTEFQLELPVKYAVYMVVTRCWLPGL

SEQ ID NO: 1213 - DNA, 24859 bp, Mus musculus
ttccaccaacaaatactctgaagccacagataagatccaaccttgccacacgcagcacatagcacagcaactgcagtagaagtctcagcgggtaagagttcttgtcatttgggattcacaccaaactggggagatgggtgacctgggtgacagaacactcattcaccaattatcttaaggccttggctatgtattaatgactcgaagttttgtgaactgggactagtcctattggactgctgggaacgctaaggttttatttttgaaagtggtttagcaaacgatgaattgtaaattgcttttaaccgtgttgtttcacccgtgggggaccctaacagtcatagcaggtgccttccttccaccctagacaccggcctaggcctgagaatggatgtttcataaacccgtaggggtatgtttgcagtccgggagaaaggggcgctgtcttcagaacttccgagaaagtcctgggtggcacagcggcaggttgtccccgtccggggatccccctagccaagcgagggtgcgccctccgcaggcggctcccggtaggccctccgtttcagctctgggtctcccccccaacccctctgtgcccgccccggccacctcgggggcgaggcagcccagcgcgtgggaggggacggcgcgccattggcttgtgcgcggcactagaggagggaccagtgcgggccgccagactcgggcgagcccagcagcgccaggagtccagcttgccctgccctgccctgccctgcctgcctagcgcggcgccgcgatgtgagactccccgggccggagcgtccgcagggcacgccagctccgcgagcgcagcaccccgcgcgccaggaacgtaagtctgctgccggcagccgctagcctcacacttcaccgccgttgccaccgcgctggccgctgcctgcgcagcgcagcccggggacgccggggggccttagggaccgctgggggcatcgagcaccctgcgaacgacagccgggcgccaggacagcttggcacttgcggggcggcgggcgcccgagacccccgctgagctcctactggcactgtcctctgtccttttcgtttgtccccttgcactgactcggtttccctttctcccccagctctcttctccgccacctccttccccaggggctgtttatttcgctctcggcctcctccagggctttatctctttgattcggagctagtgagagcggagagtaaagcagtttcttttatcccggggtctctgtcttcagcgcttggttctcggtcccctccccctttctcgccaccgccccccctcctcccgcctttgtttcccggcgggaggattgcgcggtgtaaacttgcgagtttccgggtcctcgcccccacgggtacgcgggcggagaaggtggaggggttcccgctgtccagtggtctggccggaccttttgtgtgggtgccggggactggaggagtcgcggactctcgcttcacaaagtgggggagtgtcctcggcgcggagatgaagatagatcagagggggaaggggcaaagccggcgacactcctgagtccctgctggagaggagcgggcagaaaagtgtttgggcctgaccccagtcgggggtggtggtgtcaggagggtattgcaggtggacccgggcgactctctctcccaaaccgcgcagacagctgtaaagtgtagcgccattgcctggcgcaggatggattggggtcccgtgtagtgcgcagaaaatattacgcgcaccatcctcggggcacagcgaggccagccgctcgcttcggctcccctttcgtcgccttcttgcatcctggatggagcgggcttctcctcctgcctgtgaggtggaggagcagggataggcccaggacccactcccactttgacccaaagctttacaagcacacggccaaggcctcctcaaagtcccccagcacggacttcctgtttcgtttcttttagaaaaactttctggatggggcctggagagagtgtagaagtccctgggttgcagggacacccacccagctgtgtctcccgtctggaggctcctggagaaaggccgccacctgccgccggcgggattggtgggctcctggaagaatccggaagaacaccacccgccccttagtggcagcctctggctcagtccgaggctaaaaaaaatactattttcctgtaggatctttggaaagtcagaatatacttcgggtttctgttgtcaccttcgtacagacagagcgctctcctagagtcccctctggccttcgtgtcttaggtgccctctgccttagcttctcttcttctggactctcaggtatgtctgccttcacttgctgttcctggctttgatttttctgggtccaggacctctgccgctcctatcacctcaactcacagcctggacttgtgacagccccctctgctggagacagaggctgccggctaggggcagggtcttcacgaattattcttggcttttctgtgtgttcacttactgctccaagtatcagtgagtgagccacagaagagtgatgtcgcagtggccagcacgggtcccacaggtccctgcacacctgtggaagctgtcaagactctagatagtgctgtgtcttaagcaagatcagataaataaataatacataagtcgattgggccacatgccgtgccttggcgttttttctcaatacccagaaggctgaggcaggaagagtctgaattacagaccagtttggactatttaggaagaccccgtctcagaaagaaagccagagtcaggggaacatggagagtgttggggtgttgaggccatttttaaggagtggtcagtgctgctttctgggtcctgcagaatagcctgtgcaaagagccagaggcgcagcactgcgctgatcctgtggagtggggtgaggaagagacaggaggcactggtgagacaggatggggacccccacatctcacaggtgatattaagagaggatctgtaaaccagcatcttacagccccccccccccagttaggaggggcagccacggggtgccattttgttctgaatccaggtgggaaggcctcatccccagtagcattctctgtgtccctatcacagccacagtagacagggacaggaggacagccgctcaggccaagtgctctggaaatcccctgtctcccaagaccctcatgcttcttcatgcctgcctgggtcagtgtgctggtcatgacccagagtcaccttgattctgcctcaccccacttcctcctgatactaccctctttggaacactctatttgcgtgggcatgaattcctggaaggggttctgctccgaaactgctttagtaaagggggtggggggactggggcccaggtgtttgagtctgtcggtctaaacagcagccttgttgatcactggctacaaaaacacaaactattctggatgtttgtagacgacttctcttcagggggaagtgtcattatgcccatttaacagatggggaactttgaggcccagagaggcaggcctgtcttccgacaccatgcataggatataggggtagaggatgtgagtgagcttggagttttgagtgacttgccttgttaatcacttagccagagactaagtatgaagagggagatctcagccttggactctgatccctgcccaggggaaagcatggcttcagatcatctagtctgaagacattgtgttaagcttgtcttcagggaagacacccccccaccacccccgcctccacccccaacccccattgccccttctgttttgttgagtagcaagggagaggtctggggaggaatgacaatagttgaggggaactgctgcctattcacaggagagccctggccctgtgggaaccagaagctaatggatgacagggccagctgcccttgagggcactgactctcggtcaccaggccccagggaggctggcccactcagggttgaaaaggacaggaattctccatgctgtgccttgccttttgcaagcgacagaaggacaggaaaggccttgtcggtgacttctgagaggctgcctgagaagctggccttggcttacacggggcagcagcctcagccctctgggtgaagccaagccctgctccccgaaggcaggggtgtggctcccaccctctctcacacagctaccattggggttttttttttttgtttttttgttttttttttttttgtcccctaagctctgaagatatatgtgatgagagtcagggctttcccccatccctctggaagtcagccaccttccaaagacagagaaaggaaagaagatagaaagaagaggaaaggaaagaagagaaaatctctacaggaaagcgggaagaggctgggaggggctgctgaggctgggcagggcctcgttgaaatgcaaataaatgtgtttatatagctggggtcagggttgcctagtcaaacctgtggagggccctcgagaccacactctccacccacacagaacactgtcctgacagcaagcccgggctcatcatgcctgtgacctcagctgtcctccttgaagcacagtgattcagggcaccctgacctccaagtgccagggcaaaccccgtgaccccagatcccagactcagggtcttgagggttcgaggaacctggtatggactctgtagctttgtccctgggatgggtctgttaccacgtccgccacactaaggacttgaaagcatggtctttgtcacctgctccgttcacagccagcatcttagtgacaatggagcccaccggcacttctctgtccacccaggcagtgtgctatagaataatttcattccctggggactaaggctctgcttgtctgccagcaggccctgggcacagtagcttccttttcatttccctcttgtttgggcttggaagatctccgaagaggcccatccagtcctacaggctgtgccctataacccttggctttgtgggtggggcgtggcccccgtttgcagggaatgttgctcttcacaagacagcaagtctgtctgagtccaggtctgggaatgcaagcctagggtgggaacgtggtaccttcaccctctgttctccatgacaacctgaagatgtgggccactctgccacagggccctagcggttggttcctagcgtttggctcctccatcttgtcccaaactagtggggttccctagaagaggcctcaggtggttctgtaacccagaaaccccaaagtccgactctgactgtcgctgtcctcacttgaatgcagccctgctcagacctatttccagctagtctacacagagagatagcagaacaacgggctcccactgttggcactggttcccagaaccctgcccacagcacaggccctgaacccaagagaggcccgacagggtatggaggtgtggcttcagacactggggacacaccaaggctttcgaggggacggtgctccggaagacagtttgaagctcagttatgcttggggggaggggcattccatgttcctaaccaggtacttatgcacagacatgcacacacgttcatccccccagcctcccatccccggatcctctccggaggtcctgtgcaagctcagctcgcagtcaacttgaattccatcaccaccacaccctccaagccagggactcctgagtaagtcgtgtgggccttagtgctctcgtctgaaaaatggaatggaaatatggctactgtcacaggcaatcatgtggacttcaggggttcccagcctggatgtgcttgctggcagctggctgctgtccccagctcaggcaggacgtgtgggcagctagctccctcctcgccggtaggagggcatttgcagcgctgcacctgtgcccacactggggaggaagtggctccctggttgaagggttgtggctgttactcaggggaagtcactggagcagctgtgggtgttctgggttccttcttcccctccccctcccaggccagcaggtttcctaagccatcccccttgggcacagcctccctgtcgggacagctctgcagtccattggtttctatggcaaccaggcttcctgggaaggatggggaagtcctggaggatcagcgtgggaggggtggacccctgcctcatcaggtctgctggccagggctgagtctggctaggagttcattaataacacaagacattttgctgtcctttgtggagcacagaccaagagcccgattctttcggctgcactctatggtgtattgcaaactacctgggtaggctcagtctagttttttagatgaggacttggaagtaattttctcgaagtcacagagaagcggagagaaagagctgagctttgccgccaagttttcctagttattaagagtgtgtccctctgctgggtgtagtgacacgtgcctttgatcccagcactggggaggcagaggcaggcagatctctgagttaaaggccagcttggtctacacgaccgccagggctactcagagaaactctatctccaaaaaaaaaaaaaaaagggcgtgtggggggcgggggcgggggtggaagagtgtcatttctcattctttggtcttgtacacccagggaccctccttttcctgtgtttagacacccactttccttgagcctgcagcaccccaggaaggtactatcatcaaagccatttattatactggagcttcagatgatactactagatttaaggcctcaccccttagagagtgaccaggttggaagtcagccctttgtacaaccgtctctgccctaggccaatagcttcaatgtagttgaaggcagatcctgacccatgggcattaagttcctgcctattcagtgtgtggtaggagcaacagcctgcctgcctcttctctctccttggctacccctgtagactgcagttagggaggcctgggttgtgaggacagatgctctgaggagcacagaccctctgttcttcttctgttgggtcagcctttggaactagggagtgggaagtgaggagacataggttgtagatgtctagggatgaacacaggagaacagctgagccccgaggaggagagcaggggtagagctggcctgctgagagcggggtgggggtgtgtgtgggggagtaggaggggtaggagaaggaccttcccactaggacgagtgctcagagtgactgtcactcttagaaggatggaggttgctggggatgttctcgaggactctgacaggaaagggaggcaggacatggtcttgcaggcacctgtttcatctctacagttgggagcatgagggtggatggttagccactcctcccacttccacagtcaccgtggagatgtggaggcccttagcgcacagcgtgcaggaaaccaagcaggcctgagtggaaggggccttttccactctcctcatctgagtgaggaaaagaaaggtcgctgggagggagaacagaccctgcccagggcaaggctcatggctggagggtgctcgcctacattcactggcacttctgcatccctgccccccaccccctcgtgctcctgttcacagagggaaactgaggctgggtgtgccctagtggctcacataaagcctgcagcccctaagagttaagtgggtagagccaagattcaaagccagcatgttgccagccttcccaggaatggaatgggggaagtgcctaaaacccttggcaaatagctttggcagggaagagtcggggtggagaggccgaaaggccgtgtttctctctctgagtgtgtgttagtgttagtgggtgagtcacggagcagaggaaaactgtccctagctgagatgcttccagctcaacacagagggccatgcatgatttagctagccttgcacctggtactgaggtctggggcttgatcccatgtggtgggtaaagggctaatgagatcattctcttggtcctctctgtcaaagccaccgtggtccagtgtaggggaagtgctggggaggtggcggcatcctgtctaataactgctgtcttcactggacactgtccaagacgggatgctgaccactgagttgagggagatgacatgctttgtggcgttctgggagttagtccctcctttccccgtatgagagaggaaactgaggcacagaggtaagcagatggcatacaggcccacttaaaccactggaggtcccagatgtgagtccaggcagcggagtgtgcagccctccagctgtggcacagcagttgttttctgaattcatctctgttcagggtcctgattcttcttagaccagctcggggcgggtgtgtggtgtgtgtgtgtgtgtgtgtgtgtgtgtgtgtgtgtgtgtgtgtgtgttccgactcctggtgataccagcagagctctggtgtctcgctgtccatgcctgacacacagaggaactcagtggatgggctgtgttctgtgcagtggcctctcttcatactctgagccatatttacctcaaggttggagctaaagtcctatttcacagacaaggagactgaggctcggattagtgaggtgacttacccaagtggcacagcaggattgaatccagtgacttgtcacatctggcttcatgagaaagtttaagaatctagggtccccaaagagtagggctaaaatagaaacagcccacagctagcgttgtcatgcgtatcatggatggcgtgtgtggtgccctggctgtttgctttgtccacaccccatttacctcagaggcctgcaaatgtgcggtccccaccaaaagcacacaaagcacaggcagaaacaactgaatgtccctgttcgctatgagtgtcccacagaacaatgatgcacagtagaaaggaatggacgcctggggcaccgggcgagctgggaaaggcatcccgttgagtgggagacgctgcgcgggcaaacgttcatatgctttatgattctgtttatgctacacgtgagaacaatccagacggacctggagtgacagagctcagacccgtaactgctcgaagtgggagaactgggtacacccggggctagcacacggcagtcttgacaggtgaactcactgtgtcctcacctggaagtggacatgtcatgaatgatctccacagtcatttcagtgtggattaagatgggggaggtgtgtcagaggggacatgcgaagtatgtgctgatgtctctgtccttcaaggagggttggctgggccgggctctgcacccttgtgtggtgtccagtctgtctggagtcaggagaaagtggtggcctgggttggggatttgggccccacttgaaatggtgtgactgaaaggacatccctgcgtccccttagaggtgctgagtgcctctttatggggcttaggcagttgtcgcatcctgtctcccgccatcaggtacaggaaggaaaacagccactcatttcacacatgaagagtaagactgtgtgtcagaacctggggcccaggtctcactcgcccttcagccccagtggtgactgggtttgtggtgttgtcatttggaacaaaacctcaggacctcttctatgtacctcccctccccctggcatccacaccggctgtgcccctctgctggtgtgtttgttgggatgctctatttcattctaagactctgggcgtttgagaaggaacctgggctatctggggacatttcctggggctgcaagacatcagggacatggcgctgggcagcaggtggaaggaggaacttctaagctgtgccttggaatgagtttgctggagtgaacgcgagatgctggggtaccaggaccctgggcactggccgggtgagcaggttggtggggatgcagggctgggatgctgttcttgtgttcagtgggactatgtacatcctggtggagctctgtggaatggtctacatttgctcccatccttcagggcatccttgagatgcagagactggagctgcctggggtcagccagagcctcacttggttcccctccgcgccctgtgttctttcctaggttgtgaggactgagcacaagagagggcccctcatctcagactccagtgtgcatctcagcatctagctcattgcccatctcagtacgtgccctgtggtatggggtggcatgactcggggctgtggaagatggtgggcagatggaggctggggtagaggctgtggatgctaatggccaggagtggttcacgtccaggcagtgtggccactactatggaaagcctcattttctgggcttaatgtcaccttccctcatgactaacactctcctcctctaggttctgggcagtgatggctgtttaggaggtagaaggaccagcaggcagtgggaattgtctgggcaggtggcttaggacttaggaggctcactctgagtctctgaagtctcctttgtctcgataacccagaaatcttgtcaatgagatccatcctggtccaaatgccttttctaaaacccatattgccactccagggctgactgtaaggccttgtctgacccagtcacctgggctgtgtcatgtccatgggggccagcctggaagcatcctcctcaacccattttacaggagaggaaactgaggcagccgcagcaccatcttctcttaggccccgggtggggcctggccacattcttctcaccctacactgggacctggggtctggaagtccagcaggaacgatggctgaggccagtgtctccccatgtccctcagcagaagaaaaaatggcaggcaaacagccccctccgctcatgaagaagcacagccagacggatcttgtgagccgcttgaagaccagaaagatcctgggtgtgggcggggaggatgatgacggcgaagtgcaccggtccaaggtgagccatgctaggaagaggagtcatgagcctgcaacttccagggccctctgctcgtgtcaggggaatgctatgcccagtggcagaagtttggggacaagaacccagtgcttcttagggtactggcatagactgtcctatagacatgagtgcatcctgctagctctgctggttatccatgtggttattgacccattgtacaggtgaggaagctaagactcacatagaggggctaagtaacttccttaaggttatatcagtgacccacagaaccaggcttccagcccctgctgggcagaccctgagtttctttccttaccacctcttttcagttctcttgtctgggtaccaagggaggcaggagaggttgagcttgcattggggaaaacatttatgttaatcagggatgttctgatggcccccaggtgtccacaggagctgggaggaaggtgggtgggtgagatgctgaaactgaagacttcttccctgatgcctctgacttgtgtgtccacagatcagccaggttttgggcaacgagataaagtttgctgtgcgggagcctctggggctcaggtgagcagtaggtctcgtttggatggttttgtgtcccgggtatgtgtaaggtcctacgtgactgggccttgctctgaattacatccacactgttcattgcctcctcaaatagccctggctgtttgggttgcacagggttcccccccaccccccgtttgggttggcagtgggggtcagggtgagtgtggctgtaactgtcttctcggaacctccccagggtctggcagtttctttctgctatgctgttctccagtgtggccatcatggtgagtactgtgtgtccccgcccaggctgcaagtaggtcctgagacttagatgggggtgggtgtgtgtgtgtggctctttcccttaccccagctgctgctgtcttcactctgaggcccatacttcagggtctaggccaactcccgggacatcctgtccattactggtgtgccgtgcccccaaagtaaccagcacacatgctctgggctctgggctctgggcatcccagcattggatgctgccccaaggaggtccctagcatttgtctcacctcatagctgaccctgtgctcctcctgctgcccacaggcccttgccctccctgatcagctctacgatgcagtttttgatggggctgaagtcacaagcaagacccccatccgcctctacggtggtgccctccttagtgagtattgctgggtctccagcagcctggtagccctcttcatctgtgtctgtgctgccaccttgtggccattgctagaatgcatgtagttggttcactgccctggcaatggcagaggtagcttgggcctggaggcccttgccccattgtgtagataaagataccaagtcctggggagatgagcacctggcttgggttggatagggctttagaagcaatgtgagctgtctctggggggaaagctatagctgaagagctgaggaccggaagaggggccgtctggtctgagaagtgggtgttgtggaataagtgggttcggactcctgggctagggatcaggctgccccggtgcttgattccaacaggcatctccttgatcatgtggaacgcactctacacagccgagaaggtcatcatccgctggactctgctcactgaggcctgctacttcggggtgcagtccctgggtgagtggtgtagggtggtgggaaggctatcagggtgcaggaagagaagggcagagcactgggtgctcctacaacatagaccagtgtcctgaatccacagcccagccgttccctccaagcctgacactcaggatgcacttctaggcacctgccacttgggggcagcagactggcctaggctggtgttaggcttctggaggtcgtcagcctgcagtcccactcaccacagggatggtcgagggtattcagcctagcctagcgtcatgatgggagaggctcaagcacgtgtctgctcctgacctttgcctcccccgacttccttcacagtggtcactgccacgcttgctgagacgggcctcatgtccctggggaccgtgctgctcctggccagccgcctcctctttgttattgtcagcatctactactattaccaagtcggccggaaacccaaaaaagtgtagcaggctgggacctgcctgggcctggacctgggcccgagcagctggggacttcactgtccatgggtcctagacaggcctgcaggcaggcagggtgcacacgccttccttccctcccaggcactccacggagtcatcttgggtctcctgggattctaggagtgacagaccaggctgtggcctctgcaccccacccctcacccttgtgcagggacaactccttgccctgtgtttcttggcctctagactctaacaggcagagtctagagtaagttttagggtctgggctgagtcaaggtgagttcctctgccaggaagccctttctaggaggttgtgtcggccccagcaggggctctcagcttctccccatccagaaacccgatgtgtgagtccctcatcacacacgcacacacacacacacacacacacacacacacacacacacacacacacacacggtgtttctagagatccagttgaggacatctagcaaggggagtgactgcctcccttgggccaagttccccagcctcagcctgcacatctctctctttggcctgctggagggtactctgattctctggctggccgcctgcgtcccagagcaccagagtcccttcccgacaggctagggttaggcaatgtaccacaggcctgatagtccctggctcctagctgcccataggctcctagtgcatgaggaattctgaggagaggacaagtggggacatttcctcggcatggcctccaaggcctgcatggctacacacctggctcagtgcctcctccagatcccctcctgaggctgccccaaggcctacgggttaaagccaatagctgctcacatgcaacaacggaaggagattcaagagtctgccatcccttagcagcccctaagtgggcctctagagctgaagacacacccctggtgccaccagcctgtgtggcccctccccttggccctagctcccagcacctccctacccttcagcagcaagcacactaagagatttggcccgaggcttctcccttctgcaagggggtggtcccctatacccgaggaatctttctctagggcacctgggctcacagcctccctgggctcggttgttcctgctgccaagtgctctgtgaccatggcctttgcctagtggagggaactcagtggaggatgtgcccagcagtggccggggctgcttctgtaaccaaggtctggcagagtagcgattccctgcgtgttcaggaagggcccattgtgtatacctgcctcttgtcactggcttggtgccagtccctcagtcccacctctttactcggaccatggaccctgccactgccagctcttagtacagtcccaactaccgtagaccaggtgacatttgttgacaccattctcagaggtgttgaagatttatcatcttgaatcctccacaaatacagatacagtcccaagggaggtagttgtagaaatggaagacgccagccctgcgcagcctgcagggacatccgccaggcttcccctcagcagcaggagcccaggtcaccctggttaaactgcagtgatacatttaggtgggtggggtcaaggcatatgtggcctccgggagacacctgcttggaaggaggcagtgatggagatagagccccactctgagtctgggctcagagtgccctgactgctctcccccaccccatccccagctcctcttgtcatgcttctgcctggcccccaagactgcctctgtcatggtcactatttattcttggtccctttttctttttgtaagaaacagtcacaagaaaacaacaacaacaacaaaaaacaaccaatgagaaacaatctgcgtggtgtcctgttttatattacaaaatttctcttaatatagaatataaaaaggggagacttgggagatacaatgataaattagctctgtttcctactgcaagggacatttacaaattccaaaatagactttagcatatgacgtgtgtgtgtgtgtgtgtgtgtgtgtgtgtgtgtgtgtgtgtgtgtgtgtgtatcagagttcctggggatgaaggtgctgggttcagaacccaggtaggccaggggcttgggacaggataatggggagcatgagccacaggtccagtcttagctcctcgcctgtcagatacagctgtcccttaggccactgctctgggacaggaagtggctgttctgctcactactggctgaggcatcttggggtgaaggaagagctcccctccattcctctgggagtacacagagcagctcaccaagccccaccaggatgacctcagacagccttgcaatggctaccagcaagctcagagggtgaagactgtgtctgtctggccccatgaggatgctgagaagctgggttgaatcagggctacttgggagcgcttcagcgtaagtgtggaaagttctggtgagggactctgatctgccctggaattgcctaggctccatatctggcttctcagtccctccctgtcccagccctgcccatctctggaagcctgggctagttctgggtggcagccgctgtggttgggctaagtcctcaacctagccatgaacttccaatcaatagccaagccatttgccttcctagacagttggagtccagtacgtgctgggttctgagtcagcctgggtcctcttagtctgggggtgcaagccagcagaggggccccctgatctggtgactcagcctctagggagcttactatggggatgccaattaagctgtcataaagacaacttccgtatagcattcagagacacccactccccggaaggccaggctgggtgaggaccacataaagaggagagaaaatgggagaagtagccccccttgcacccagacagcagaatagaacaggctatggctatgactcccaggtggcagaagggcaaaggaaggctggagttcaggtcaggctcttccatctgagagaggagagcagacacctagctgttccttccaccactgttccccttttgtgcccttggcagacataattaatcaaatttgagatcctgacagacaacactaatggattcaacacggtcctggcagggtcaggcatcttgcaactagttgctaacctagcctgcagttcaagtttgtgtgtgtgtgtgtggtggggggggggtgttggttggttggttggttgtgaacctattagtctggggtgtttgtttgtgtgtgtgtgtgtgtgtgtgtgtgtgtgtgtctgttggttggttggttggttgtgaacctattagtctggggtgtttgtttgtgtgtgtgtgtgtgtgtgtgtgtgtgtgtgtgtgtctgttggttggttggttggttgtgaacctattagtctgggtaatctgagcctagagagactaacaaaataaatgttcagcaaaaggtcagaaggtgtcacggtaggagatgctgtggggttaagtctgcagacaagaggcatgaccttaacctctagaaaggagagagagtgaaggggtacacagacggaaaaatggaaaccccttctgtctgcggaggtgatggtgacatcagagcatctgaaggcaggaggctgagttgggaggtagtgagatccatccgtatgtggagggatgcaggggtgaattcttggcagggaccttgaagaacacattcaagcctcagctctgggtagaaagagagaaatgaacaatactggggtgtcttccacctgggagaacaggggtggggcatggcccacggggacaggtgatgtatcacagttggatctctgacagaggtacaagcagggcagagtggacacagtacggactgtagagctggatgcaggcagttcctggccagtttacatcggggtggagtcctggctggagcgacagcagcctggagatgaccttgtcatgcacatgctgtgtgactggacggaaatgaaagggccaccttctgatccagtgtccacacacagccaccctcagccagcgggagcagggaccgcttcgctctccagcagatggtgctgcagagtctgtccttgtgttgtgaaaagccggctccttggggcctgaggaccggctcctcctccaggatgtgtttctgcctcctggttgctctgatcctggaaatgctaagagaggtgatccgggccaagggacactccagtctgacagggccaaggagctctgaggctgatgaacctttggtctcaggaacagctggtcccaggccagccctaggtccttgtagagcccatgccccttgctttagagcctaggtgaggccccttcatgtctgtcttttttttttgtttgtttgtttgtttatttaaaaattagctctatgcttctggccgtttgggctggccttgcttccgcccctggggccagaggacagggaagagaaggggctggcttctgggcagtggtgggctgagtgtcttcaggccaaggcctactggatgccccggaagaggcacatggcaaagaccatgaggaagagctgcagagaaagggagaagatgatctggagtcagactgggtgcacgtcgaggggctgcccagcacacctcctgaggggaatcgtgattgtgacactacccggggcaggcaagcatctgctcaccacttgggtaaaaaacaggcgttggaaagcaagtcatctgtttaaacagctcaaatctgtcttttttgggttggcagagactttaagcaaagcacaacccttcttgggcacctgagtgtgtaccgagagcttaccatgtaaagtaggtttccaatgctgttagcagcagcctttctaaccagcaggaagtgaggcatggagatgtcagagatgtcttacaacctgatttaggtcacacagcttcagtgggggtaacctagcttgagcagagacacacttccccccctccctccccccacccagcccttgcttctaagcccctgcgctctcgatagctcacctgaagctggtgaggtttccagaggttgcacttccctaaccctgacctgtggctacatcgaggcaaggctatgtgcaaatccttgaaatgtgcccagcctcaggaagatctgtgtgcctcttgttggtcttagctctcacaggaggctttgtccacttccaggagtgttggcacatacagcaggagcttaatatatgcatgtggaattaatgaatgatgcctgtacttctcctgtgacttacacagaactggtatcctgagagacaaggcacagaggaccctgaacaagggcacatcagagtgccaggcgaccagagcttccatgaaagggtccccaaagagcaggaagtgagggctgcacattaggctacctggcctcactgccccagagtgcatccctgaactgggcaggggggcagtgagaagggaatgctgagtagtaactcaaaagttgacagctactccgctacggtgtaggttctggggcactgggatgaaggattctaaagctccattgccaagtttaaaagacccctgaccatgtgcaaagtcaggactcatccagaagcccccgccttccaggcagcttgtggggtgtatcctgcaaagcgcacttggactgcagagctggggtgaggtgaggtgcctctctgggcctgcctgttcccattgtcctgggagaggcacagatccgtagctccaggccacaagaatggctctagcagcagacgtttgcagtaggcagcggctatgaatctgggaaataggctgagcgtacagacgctggggcttcctccctcccagggcccctccactcacctcaatagccagtactccaatggcaaaggctccggccaggtagacataggtttcgaaggtgttgaggatcactgtataacagccctgggaaggaaaggccagagatgaagccacggtatggaagtgtggtctgcagtcaggaccactgtcagtattgaagtccctggcatttggcctcagggctcagcagctgcaagctggcatttttatactgatgtgggaggaggaagcatctggtcagtggcagaatgtcaccaacatccctccctctgccgcatccagtccccaagacagtcccaaggctaactaagccacagacctagactatgaggagatgtccaaacactcaggcctcctggtgctctgtagaagtgggggtcagacatgcagggcaaagctgaatgggatggatctcttcaatcagaatgtcaaatggtgccccagccccaggtgggacagtatctcacagaggtgcacagtgccccaccaagtccctctcttgacctgcctggctgctgagggattgacagtccccctccccaggctcaaggccaggcagcccatcctcaaacattgctcagctcttttcccacagcctcacaggagcagctgccttcatgtgactcatgtgcctgcggtcccctggcactgtaggtgacagagccagatgagccaagacctctcccattgggccccaaagacattgtactctgtgtccactgtaccccactcccatgctggccacaggtaaaagtcacacacacacacacacacacacacacacacacacacacaccagtcagtgttggggatcagaccactgagccatactcaccccccagctctgactgaaatatatgcactttttggagatgggatctaggctacacttgaactctgtatagttgaggatgtccttgaacttctacccctggctttatcacctgagtgctcatattatccagtttatgagggattgggttggaacctagtttttgtgtatgctgcacaggtctactggctgagctatataatctcagccttttgaaacatattctttaaaaaacaacagtttttttttttcttttatgagcacctgaatattctttgggcccaactagaggacttccatgtggactggttggtggtggggcaggggtaggaactgtgcccatctatgtggggtatatattggatttcaggttctgatgaggctggggtcttgctgcttcctacatagattcccagtgtctttggccatgtggacctggggaggctatatctgagcacgcagacagtaagacctgatcagagactgcggctacatgggagtcaacgtgtcttctacgtggagactaactaggaactgggcaagggagaccccattgtccctggagcctcatagagtaggtggacatattctgcctagcacaagtgacctgagccgagcagaaggttggctggtggaaattccccggtgacagggaagcccttggcatgagtggacagtgtggacagtgttacctacacccagcatccctcctccagggtcttactaggttctatgtgccctgcatcatttggttctctgtgtagcccctactgagaagtagctcatctgtggtttacctccttgcaaaatgggagagagcaggtgggtggctccttcgaggccacacatagcaagggaagcccagattcaaagaggggcctgatagttctttccctctacatagagggggtgggaactatattttaaaatgcctgtcctcatgtggccaagcccctccatcggtgcctggagttgactatgccctgggtgtcaccccaccataaagcatccccatctgtcacagggaatggaacatcacttgctagatgcctgtcatagcacctccgatgtccagctcctgctcacagtcaccccaaaactaactagacatagggcagctggtcctgggcagcaacccctacattctcatcactagcatcccatcttaggttccaggatgagcaccccacctcctacctgggactcctgactagatatttcaaaggtacttcactctcaatgttccccaaacttcacacaccatgtcccccaacccagaaggcacagaaacacctttgtcacatgcctggactcgcattgacgtctgttacaaggccagtaattcacatcaccctcctcgggactgctgctcatgtagaactgtcttgacttcccagtcctacagcagccaaagtgccaacctagccacattcgtccccaaaggaactccatactctagaagtctggcttgtgccagtcacaaatgtgtcctgggctttgtgggaggcagttctggagataacccaactggagatggtctcccagtgggggctcctaacagaaagtatggctcagcggggatgggtgtgggaggaccagtcctgggagttagtctcactgggcctgaagaggctctgtgatggagaatcgatatggctgtgtggtcctcagtgcaggagccagcaagaggatgctcacaggggaaggtatcttgcggtagaagttcaggacttggggtcctggtcctgcattctggctgaagttgggggtatagcactttctcagaagggtgtgactcagtcaccagagtgtgctttcccttggttaaatgtgtgtggttccatggcctttgcgagagagcagaagcaagcttctgcctcactttcctgggctgtggcggactttctccagcagagtggtaatgaaacagggaggcttgactttccctgggcaggtgtcagcctaggcccgtcggcaatggaagcgtgaggctccccatatctttcaatccttcccaaattctactcgctctaaccatagatccctgcaatccaaaccttcatgcctgctctttccattcacatcccggggcccttcctcctcatttctgtctctttcccccagggtaggaaggcaggatgtgtgagagacactgcgctctggcctatcctagggaaggtatgaagtcaagagctgagctcttggtatcaaactgagctcatgggactaggtctcagcccagtaatgccctcccttggagcttcgagtaccctaagctctggcccatgcacactctagcacttcattcaatctgtcttcactctcagaaccaccgctgtgggcaaggatcacttcattcactggatcaccatctaccacctctccctagaccaggagccccatggaagctcagcctgtcccttgtgctctgtcagctccacagtgttttgaattctcccagaagtctgaccaaagaagaaggccaggtgtggctctccttctcatcccttccctcttcccatctgccacgcccaacctctccctgcttctctttatggacaaggggggttggggtagtgggggtggggatggtccctctggccagcaggacggaagggaccaagggtgaagtggagctgtgctccttgttgagggggacaaagctgagacctctgtttctcttagggcgaaggctaagaggaagtcctcagatttcaagaaaagaaagaactctggatgcttccctagttatctagggtcaggtcaataaaaatctcctcctcttggatcaagaagtgttcttgctgggcagtggtggcgcacacctttaatcccagcacttgggaggctgaggcaggtggatttctgagttcgagaccagcctggtctacagagtgagttccaggacagtcaaggctacacagagaaaccctgtcttgacccccccccaaaaagaagtgttcttacttggccagagtaagcttcctcataaatagagtatatgcctaaggagtgcctcccccatcttatttggaaaactcagcctggaaccacagaccaaattctcaccccagcctgaatccaactcatttcctctgtcagtgtgatcttctcacttctttggttcttagaggccaaggtagcctgtgccacagccagaattgtttacaaagctccagcccaccttcagaccctctgggcagacattgcttcccccagctttgcccatatttgagaagtgtctccccgcctggggaacccacctgcttgtttatgaacggattccgtcccagctggcactcctccctgctcagcaccactccatctcgagtctggggttccctccgacagcaagccttgggcacctcctcagtgtccagcgtcagcagccgaaacacggaggccagcttgaagtcttcaggtccgttgaccccacagcagccaaactaggagagagccgaatgtgggagctagtgagggactggaggggacatcagcctctgccagggccaagatccctctgccctgcatatgactgcggtaatgacctgtgttcctgagcttctgggtcttctctgtaagagggacatggccgtatgttccttacctcaccagcacttggtaagcagtgcacatatagatgctatgattttatattgtgctgtgctatttattatctttactccggcctgtgtataactgttcatatgcagatgtgtgtgtgtgttgtgggatcatgtgaacatatgagtggaagccagaagtcaatgtcaggtgtcattccttaggtgctgtccatcttatttttcagacagaagctctcactgggacctggggtttgtagattaggctaggctagctggccagtgagtcccagggacgtgcctgtctccacttctccagtgttgggcttataagcatccatcatcgtacctgatattttacatgggtgctggggaccaaactcagttcctcctactcacacagcaatcactttaacgactcacccaccccctcagcctctgtactgagtatcgctaacatcactcacaatggtactgcgtgaggacctaagtcaggggcagtggactgtgatccactagccttgacagctcggagtgctgtgcaaatgacgatgcagaggtcaagagtaggatcagtgattcttgatggattgttgatgcctggtccaggcaagggactaggagggctctagaggacaggctttttcatgtcacattatggctctgagtgttcacggcatcccacgataatatggggaggggcactcactgtgatcatgactgaattccaggtggcagagaaaacatccgtatcgttatcgccttggtagtgcttggtaagctccttggtgaagaactctcgggtgagctgaggacaaagtagagggtcctgagtcctcccagcctgtctttcccaaggtgatactaagctgttcattttgggcaggcaccctgttcccaaggcttggaactttggtgtgtctcatcataggctgagagaagcgtgtctgtatttacgggctcatctaactccaggatgggacacactgggaaccctgctcagccttgcagctctccacagaggatgagtgtgtgggtgtttgggagctggaggacatgattgcctgtcattctgttcttcagaatcaacagtcatggggcccaacctacaggaagccacagtgtgggtaaagagggatcccttcaatcacccatatctacccgctatgttctcaaagccactgttctcaacagcttcctcaggctggctccttgtcccaggctggcccatgtcttatccttccatccctcctgaagcccatctgtctgtggtacgaggccttgtcctctaggctcaggggaaggagctggctgaagcctgtggtgtaggctaagcagggagaggctggtagcctagcaaggcacacagcatgcccagactgggtatatcctctccaaccccatgactatgtgacacccatcatcaggccgtcactggggttggatagagattctaaaaccaagctggagcctgtaccaggtgctccaggagtggggacccttaggcacccctggtcggggccttctggaattacccctataggagaccccacttctctggaccccaatgcattcctgaggtgcaggttatgtttagacccaaggccctggatgagacagctagttctaaggg

SEQ ID NO: 1214 - DNA, 2646 bp, Mus musculus
ttgtgaggactgagcacaagagagggcccctcatctcagactccagtgtgcatctcagcatctagctcattgcccatctcagagaggaaactgaggcagccgcagcaccatcttctcttaggccccgggtggggcctggccacattcttctcaccctacactgggacctggggtctggaagtccagcaggaacgatggctgaggccagtgtctccccatgtccctcagcagaagaaaaaatggcaggcaaacagccccctccgctcatgaagaagcacagccagacggatcttgtgagccgcttgaagaccagaaagatcctgggtgtgggcggggaggatgatgacggcgaagtgcaccggtccaagatcagccaggttttgggcaacgagataaagtttgctgtgcgggagcctctggggctcagggtctggcagtttctttctgctatgctgttctccagtgtggccatcatggcccttgccctccctgatcagctctacgatgcagtttttgatggggctgaagtcacaagcaagacccccatccgcctctacggtggtgccctccttagcatctccttgatcatgtggaacgcactctacacagccgagaaggtcatcatccgctggactctgctcactgaggcctgctacttcggggtgcagtccctggtggtcactgccacgcttgctgagacgggcctcatgtccctggggaccgtgctgctcctggccagccgcctcctctttgttattgtcagcatctactactattaccaagtcggccggaaacccaaaaaagtgtagcaggctgggacctgcctgggcctggacctgggcccgagcagctggggacttcactgtccatgggtcctagacaggcctgcaggcaggcagggtgcacacgccttccttccctcccaggcactccacggagtcatcttgggtctcctgggattctaggagtgacagaccaggctgtggcctctgcaccccacccctcacccttgtgcagggacaactccttgccctgtgtttcttggcctctagactctaacaggcagagtctagagtaagttttagggtctgggctgagtcaaggtgagttcctctgccaggaagccctttctaggaggttgtgtcggccccagcaggggctctcagcttctccccatccagaaacccgatgtgtgagtccctcatcacacacgcacacacacacacacacacacacacacacacacacacacacacacacacacggtgtttctagagatccagttgaggacatctagcaaggggagtgactgcctcccttgggccaagttccccagcctcagcctgcacatctctctctttggcctgctggagggtactctgattctctggctggccgcctgcgtcccagagcaccagagtcccttcccgacaggctagggttaggcaatgtaccacaggcctgatagtccctggctcctagctgcccataggctcctagtgcatgaggaattctgaggagaggacaagtggggacatttcctcggcatggcctccaaggcctgcatggctacacacctggctcagtgcctcctccagatcccctcctgaggctgccccaaggcctacgggttaaagccaatagctgctcacatgcaacaacggaaggagattcaagagtctgccatcccttagcagcccctaagtgggcctctagagctgaagacacacccctggtgccaccagcctgtgtggcccctccccttggccctagctcccagcacctccctacccttcagcagcaagcacactaagagatttggcccgaggcttctcccttctgcaagggggtggtcccctatacccgaggaatctttctctagggcacctgggctcacagcctccctgggctcggttgttcctgctgccaagtgctctgtgaccatggcctttgcctagtggagggaactcagtggaggatgtgcccagcagtggccggggctgcttctgtaaccaaggtctggcagagtagcgattccctgcgtgttcaggaagggcccattgtgtatacctgcctcttgtcactggcttggtgccagtccctcagtcccacctctttactcggaccatggaccctgccactgccagctcttagtacagtcccaactaccgtagaccaggtgacatttgttgacaccattctcagaggtgttgaagatttatcatcttgaatcctccacaaatacagatacagtcccaagggaggtagttgtagaaatggaagacgccagccctgcgcagcctgcagggacatccgccaggcttcccctcagcagcaggagcccaggtcaccctggttaaactgcagtgatacatttaggtgggtggggtcaaggcatatgtggcctccgggagacacctgcttggaaggaggcagtgatggagatagagccccactctgagtctgggctcagagtgccctgactgctctcccccaccccatccccagctcctcttgtcatgcttctgcctggcccccaagactgcctctgtcatggtcactatttattcttggtccctttttctttttgtaagaaacagtcacaagaaaacaacaacaacaacaaaaaacaaccaatgagaaaca

SEQ ID NO: 1215 - protein, 247 aa, Mus musculus
LIAHLREETEAAAAPSSLRPRVGPGHILLTLHWDLGSGSPAGTMAEASVSPCPSAEEKMAGKQPPPLMKKHSQTDLVSRLKTRKILGVGGEDDDGEVHRSKISQVLGNEIKFAVREPLGLRVWQFLSAMLFSSVAIMALALPDQLYDAVFDGAEVTSKTPIRLYGGALLSISLIMWNALYTAEKVIIRWTLLTEACYFGVQSLVVTATLAETGLMSLGTVLLLASRLLFVIVSIYYYYQVGRKPKKV

SEQ ID NO: 1216 - DNA, 40506 bp, Homo sapiens
cagttaaacaccacaatctctagaaacctttcccagagaccctcgaagctgtgagtctctcagcacctgccaggcaccacatttctcccatgggtcctgtggtagaagaatgtgtcccgtggtgattcccaagccaactgtgtggaccaccttaacctctgattcccagccccagggaaaatcaggagattaacaatcagttcctttgggctggtaatattccttccattttacagatggagacactgaggtcctggatatttaaaaaaacaaaaacaaaaacccatatgacactctcagggagcctgggagtcccagagcttcagtccgattttctgcagtgactcagggcttagacaatcattacagcagcgattactccttaaattggttatttttcactgttgaagctgttgtgtgggccttttttttttttttttttttcagtttggattcaccaggctgggggagggagagattgaatgtgaggcaaagcagaaggaagagaaagaaaaaggggaggcgggaaagccgggcagcagagaaaggcccaggagtctttgggatttctcaccatggggtgggggagggggaggctgccccggacccctggggaggcaggagagagggaagtaggagtgggggcagggagatgacagcaggtggtggggcatagttccgaggttagctgcagccatgggcagttctaatcagcttcttagactcctgggatcagtgcctgggctaagggtgctgtgtgtgaggttgggggtgggagcgttgagccacctccactctcacagtctacccccaaccatctcccctccaccttttctcttcccacactgttcagatacctgccgtgtgcttggcactgtgctaggcacaaaggcatagcaggaaacgagatacagccctgcccttgagtagctcacagccagccctgggaacctggaacccagccgtcaaattcactacagggattggagggagctactggggtcagcttgcgggggtctatggggaccgagggatgtggcccaacttcggcatgaggcttgggggatgggcgaatgggggagagtgggtagggaaaagctgccagaggaaactttgtttgttttttgttttttgagatggagtctcgctctgtcgcccagactggagtgcaatggcaagatcttggctcactgcaacctctgcctcccaggttcaagtgattctctcatctctgcctctccagtagttgggactacaggcatgtgccaccatgcctggctaatttttgtatttttagtatagatggggtttcaccatgttggtcaggctggtccaactcctgacctcaagtgatccacccgccttggcctcccaaagtgctgggattacaggcatgagccaccgcgcctggcccggaaacattttagctgagataagagaagcatggtgaagagctggcagatgaagactggggtgtgatgggtaagaaaggtcaagccgaaggaacagcagggacaaaggcaaggtcctaacccgggacagagcccggaacaagaggggagctaggagtagcaactgctcagatgtctgtctcttgcactagattatgagcttctctgattcataactggggttgcattcatcactcgttttgtggatgtatctatgtctgtacgcatgcattcattccttcatttgttttagctggaataatctaaagcttattatgaatcttgcaggatgaagctgtagatctatgatggcctgtccccttaggctgccaagtcctgctgcacaggctgtgcactgcaccactccatctgccataggtgtagcaccctgcagccttgctctacatggtcattgataagtagtaattattctctccctctctgcatatataatccccattttctgttgtgtacactgagagaagggaggagtcctgctcgagttctcatggcctgggggagacccacaggaactctccctatctcagtatccccactgacacttactttctcagtaggcctagatagttgatctgagagcttccgggtcagatgcccttcctcactccaggaccatggaactgccaggcagagtgggcttctgtttactgccttgggctgaaaacacatatcagcgattggcaaaacacagggaagttgcagctcaacctgttagactggcaaatgtatgctatgcccttctcttactgtaaggatataaaacaatcacttatttatactcaggaaccagaacacttgggtcctcctgcctccccctgctcagccccaccctgaacagaggggctcccagaatgccctggggcctgtggcaatgggggagagaatggaaggggaaaaggagagctgccctgggacctttacggtggagggcagaaacattattaagtacctgctgcatgctgacccttaactgtttttcttctaattatcaaaatagtcctgtgaaagggagtcagaaacccaggggacagaaggagcacggtttgaatccaggctgtgtctcttatcagctggagacttgggagagttacttatctttttttttttttttttttgagagttacttatctataaaatggagataataacagcaactacctccacagggccagtgtgcagagttcacgaagccacccactgcaggtgcttggcacagtgcccagcatatagtaagtgttcagtaaacactaactagcatcatgagattcggggttgctgtgagccctgttgtacaatggagaaacagaggcccagggaggctacagaagttgccagaggccacacacttaggagttggcatagccagaggtgagtgtgtggagttttgaagggaaggtctgaagactgtcactaagcattaaatccgcctgaggcttcaaaccttcactttaaattcacccagtgctgtgtgcccagccttgcactgaggggtgagatggagtggctgagtgaagaagatgtgttaggctccttggagccaccatcccagagcacgtggcctgatggggacagacagaagatagtagttcccatgaagcagtgtggcagatgctgtcaccagctgctcccagagctggaagaggtagcctccaaggcttcctaggatgtgtggggggtgtgagtgggggtcggggagggctgggaaggacttctcagagatgcctggtagagggctcagcgtttgcaaaggccaggagggttgaagtaccacagcatctggagaaactgtggcaaaaaccgatccgtggtggttataaagaccccttgtggcatccaagggaaaaaaatgtgggcttcgaagctgacaaatttggggattcaaaaccctggtacatgaagccagccctttctgggcttcagttctccattttaaaaatggactacctcacagaggttgcccacagaagtcgcgcaaaaagttggtcatttctctctctcccccatcccagggtgagagtggggcaaggatgggcggtggtgagtggcggaggggaggccctgggtcagccctggggtcctctgggtctgcagatctgcctccggggtcaattctcccgggtgggcggaggtctgcgccctgccaaaccggtgttaacccgccccttgaccgctgaccggtgcgtgggaggaggagagcaccaggtgaagggctgatgactctccagcaagtgttccctccatccgccgccggctcggatccccagagacccggatcgcagcttccctgctggccgagcccccagcacccgcggcgcgccccagccctctgctcctcctcggagcaattacataacgacgcctctggtgggtggcggagaggccttctttgttattgcgatccgcctcggcagcggccccgctgtattaataaaccgatcactcaaaacgccagcctgggctttatgtatgtagatttgggttggggcgcctccgagggaattatccacgctgcccgctcctcacccaggagggaaggaggtggaatcccttccctcccctcccctctggtctttcaccctgcccttcagctcagagtccctcccccacccaccttgctcagcagcccggtcccaggagggcaaacaagaatattccagaatcaaaaagtgtgggttccaggcccatcttcacttccctgatgggtgatagctggcaaatggaaactcattagccttacctgtaaaatgagccgaataatagcaaagtgcccatttaaattagataatctaggaatctgctttgcaaattctaaagcaatggttctcaatctttggcttgtatcagaatcacgtggggggctgttggacgacagattgttgcccctgtgacttcctttcccagagtttcagttgtctgaggtggaaatgagaatttgtgtttctaacattttcctgcccccaagtaggctttgagactcatacactctaaagagatttataaactagaatctatttgtcagatgttcctgtcggtccgcaggtgacttactgtccccaaactgtatggcttcactggggtgggggtggtccaggagtggcaggccttacaagggatcagcaatgcctgccctggccagcggcagcaccagaaccacctgagctctgggccagactgccagggttccagtcccacctccctgctttctagggtgtgatcttgggtaagttatgtaactcagtgggcctccgttttgccatctataaaatgggactagtaatggtaccaacttcgtgagatttgttaggattaatgacatgtaagattctagaccagcgtctggtacatagtacgggctcagaatgctattttttgaaataatgataaagcccctggggttttatcattggacaggaggcaagtgaagcggtggccattggcctagccggctgcccagggtccaagactatgatcccacagcccagaatggctgctctgggcactcactgtgaagaggtcctgggggtcgcccaagatgagggtccaaaatctgctactcacttccctgcatagcaattcttttcttggccagggctcagcactctgaaaatctggacccagcctgaggttcttaagtcagctatgctgacaaggggtactccatactccatctgccctgagttttggaagccgtcccttcagtaccagcacagagcaacagtgtcccaggcctgcgatacaaggtccacagacatctccccgactctcccagctggtggagggtggatttcttgcagatggccacatgcacacagctcaccgccatttccacatgtccattcattaattgagtcaatgaacattcattgagaactgactgtgagctccggactcacatgtactatctcacttaaccccccaggtaccctatgcatcatcatgattttcttctttccatttggcagatgaacacgctgaggctcagagacactgagttacttgcctaaggccacagagccggttagaagaggactaggaccttgaacctaaatccaggatggttctagtggctaaatcccactctcatactgcctccttgagccctcccccacaggaagcaggaaagggctggccatggtcttctggtcccctagctgtcatacactttctttggggagatctgagcctcatttcttccacccccatcctgatcagttctctctcccacagataagaaactgcttgacatttcctggtcctggtgtagcaacagaggtggtggggatgagtcactggagggaagcagctggcagttgtgtggggtcggggaaggagggctggtcagtgctcactctggaggggtgggggcaggaagcactggggaggcctgcctgggagttcctgagctcccagctgctccttccagtccccaaagctatgtgtaacagagttctcctcaccaggcaggttcacagagaacgaagctctggaggaaatgagaggaaaccaggaaggggaaccagaagcagttgtgaaagcccagctctctgcctcagtccttgtgttgtgggatggaggctccttctctctgggttttgtgccagcttcaatgaaccctggctagacaactctcaccccagagctccctgttccagttgagaatgcaccagcactcctgaggccctctccctccgctcctcccaggctgccgcataataacaccagtggcactgattgataactgtcgatgtgcctgccccatgttaagggcttcacgtgcagcctctctgctaaacctccaataactcccaccaggtaggccctgttattatcaccattttacagatgagcaaactgaggcctagagaagtgaaatcactggcccatggtcccataaccaggacttgaacccagatctgtcaggtccaaaatccctgggctcaaccacaacaggtctctgacaacatcatgttcctccacacgtgcccatcagtgctgaaacctttcccctggccccaaccccaaagactaggcccaacccccgctccgcaggcctctctcctgcagtcccaggtgataacagtagtctcactccaagcatctttgaaatccaattacatccccattcttcctcgtccatagtggtttctggctgcagacactggcaatccctgtgcccaccacaccttcctgcaggggcacaaacacagacacacaggcgcactcttaagtgctcactcacacctggccaccaaggaggtgttgctgcccctgcttgtggagggcgaccagggcagatggagcccctgctgctcccaggttcctgtgggagtctggaggagtgaccctcccacccctgcaacagccgctggctgcttcctggctccatccccaaccccactcccatccccacccccctggggccttgagaggaacacttcaccaaggtaagaatcacaataataatgtcaataataggaatcagcatttccagtttgcaaacctttttcatcgaatcacctcacttgactctcacaagttctatgaggcagatatttttatatccgtgcaggcgagggtcgtatagctacttaggagcagagccaaggtcctagccgacttatctcactctcacctagaataatgatgactcctcattgttaccgtgcaccaagcatctattcttgcctgtcgttaggggcacacttaatgaatgtcaatgttactcctcacagcagcccagtgaggtgagttttttttttatgcccagtgtaaagatcaggtaactcagaagagttgagggcagaatggctgcctaagggatgtttctgaactggacacatcactttagaaaagtatataggggccgggcgcggtggctcacgcctgtaatccccgcactttgggaggccgaggcgggcggatcatgaggtcaggagatcgagactatcctgactaacatggtgaaaccccgactctactaaaaatacaaaaaattagccgggtgtggtcgtgggtgcctgtagtcccagctactcgggaggctgaggcaggagaatggcatggacccaggaggcggagcttgcagtgagccgagatcacgccactgcactccagcctgggcgacagaacgagactccatctcaaaataaataaataagtaaataaataaatgaaaagtatatagggaggaagacaataagagcctctaatgggtgctttctggagagcggatgcagggggttatggatagagccagctgcttctcccctggtccccctccaagcactttgcctgttatcttgagcggttactgttgctgctgttgactatttgtgcagtcatctacaagggggctgtgaactctccaaggacagggacactgtcctgttcacccctggggccccagcacatagcaccttgcctggcataagggtgaggcactgtcaggatggcctcgttcacaaaggatggtggggcagccttggcccagcctgagctcccagcctccccagcttccccgttgataaggagactgagagaagacagacacccagagggcaaaggttatccactccaaataccacttaaggtgggaattcttcctctgctgtcctcatcaacccttccctggattctgcttgcatgctgctagtgacagggcactcattcatgacaactaaggcagcctcttccatgttggaaaacttggagtgattgtgacaaaggcctcccactgatgtatgatcaggctggctgggattacaagcacagaccctgctgctagtctttagggttacaccaagcagagcactggcaggtgtccccaagtctgggaggacattgcacatgaatgacgctgggggccctcccttcagcaatccagagccctgagtgccagaaaggcagaagagggagtgacaaatgaattcatcaacccagcttggcccagctctgtaaaggcagtgaggtgagactgagttgttgcagaaattactatagagccttgagtcagatggctccacccaacacaccttaaaaataatcctcatctagagtcacatactttgattgattgattgattcattcattattggctatcactgtctaggtgtttggctgggggcagtgtcagtggcactggggcatcagagtttatctaccttagtaatcaggacagtttatattcactgagcacttactatgaaccaaggactgttctgtttacttccttgccaagggcacagactctcctgcccaatcccagctctggtgaggacagtgggagcctgcatggcacagagtccatgcacagtaaacatgagcagctcctattaactctaaatctctacagcaaccatagccggttcttactattggttgctctaggtgacttactttgtccaaggccacacaggcactaaaaggcagagtcaggatttgaacctaggtgatctggttccagagcctgctctattaaccgttaaggaactggtgcagacagaaccgagacctggagtcagaatgcccacctagctagatgcctgaggcagccactcacctctttctgtcttatttacttgtgaaatggagcatgtcatcagccttgccttccttttcccgcagccccccaccccggttcctggcccactgtgaccatcagatcagatgaaagagatccaggcatttctctaaggagagcacagggtggtgggggttggggtgggagagagcacattattttcccaccataaggggttgaaggagcccagaatttgggggtggggccttgtctgtaggagcctggttctctcaggttgacacgccaccagagagcctccatgacccccaaccctcatcctcaccccagccccccataggatgtgtagagacaaaaggtttgacaactgtagcgccaacaagcgtcctagagccccagataagatcctagcctcctgacagcgcaactgacagcagcatctctgaggctggattttagggtggagtatgaagaaggtggccgtagtgacagtggggtcatgttatttggtcaagtcacaccaagcagggagagagaagggtgggcctaggctggaagcctgaaggctgagtgaactcaaactttaacgaccatggcctgtaaaatgggactaagcacagcgcccttatgggttgctgtgaaaatcaaatgagttaatacttgtaactcctttagcatatggtgtctggcatcagagagtgcgcagcaaacggtgactattgtcgtgactgtgttattacacacttgggtatcaccgccagccaaagcagtcccttccatttcaggcaccggcctgggcccgggagacaccgcaaggctatttaagatggtgtggtttgcccatctacgttgatcgtcccaagaaaggggcaccgtctgcagaacttgccaggaaagtcatcctgggcggcgcggccacgccagagtctccccgcgcggcttcctcccccggcgccttctttcctcgcgcgtgcgccccctgcaggcggcccccgggagagcttcgcgggggagccgtgagcctggtttccccgccaacccccattcccgccgccccggcggccaccctgggggcgaggcagcccggcgcgtgggaggggacggcgcgccattggcttgtgcgcggaaccgagaggagggaccagcgcgggccgccagactcggtaagccccggccgcgcaggcgccgcgcgcagtccagccggcccggccctgccctgccctgccctgtcctgccctgccctgccctgccctgccctgcactgcccggcccggcacgggcggcgcgatgtgaggcgtccgagcccggagcctccgcctggcatcagctccacgtagcccagcgccggcacgcgcgaggcccgtaagttctgctccccgccgccgcttccgagccgcggactttcccctcccgccgcccgccgcctgcgcagcgcaacccagcggggctcctgcggccgacgggaccgcagaggggcggccgggaccccgcgcgcgctaaccgggcgccccgggacatctcggcacccgctgagcccgctgggaccccagggggtcgcctccccagctccccaaggcgccgtcccgcagccccttccgtctcccctgcgcgctctcccctcgccgcccctccctctgactcggtttcccctctcccccggctccgcggtcgccctcctcctggactgcttatttcgtcctcggccactgcctctcgggctcgagctttctgcttcggagcaggagagaaacggagcgaaagcagtttctgtctccccggggtctgactcggtcccccgcgctcggttctctgtcccctccccctcccgccattgttcccggcaggaggagtgcgcggcgcaaacttgcgagttcccccagtctttgcccccgcagggccgcggacggaggtggtggcggagttcccgctgcccacaagtctggcccgaccttctggggtgggggcctgggggcaggggccctgggccggagaacccggggccgcctaacggctcggagctcaccgccgggggacaccggcgctgaggcctgggtctcagaaagtgggtgagtgtctggagcggggacatcagggacagattgcagggggaggggcgaggctgagagagtcccccgtccccaggctggaaaggggcgggcagaaacccaggccgcgccttagcccagttagggggtgggtaggggacgcacaggtggagacgccccccactctccccaaagtcgcgcgatctgcaggaagggtacagtgtggggccactggccgggcgctgggtgggttagggcccctgccgtgggcagaacactcgcacctacccgggggaggctgtgtggaggaagggccagaacgccgcgcccaccccggcgcgccccgctgggcggggcggggcggggcgctcgccttgggtcccctcgctctaccttccttcgccctgacccagtctcgggcttccgcctcttcctggagcccggggggagtgggtttctccgccggagagatggaggctggggcaagagcagcgcggaggccaagaacccccaggctcctccaaagcccagagcggctggccaaggccccctcaccgccccactaccctgcacttcctgattggtttctttcaaacaaacttcttgacggggcgggcctgcggggagaagtcaccggggctgcccaccccaactatgtggtcccttggacctccacccctgacggcctgtggagaggggaccaggatctgcggcccgcagatcccagggacgcgggggtcgttttgttgcagagccaggagggggcactgtccgctccttagcctcagccccagacttcgagaaaggagagaaaagatttttcttgttgggttgttaggaaataagactattctccaggcttctgttgtcccatctgtaaaatgggtcgtcttgttcctgaggccccctctgtccccaccatcccaggaggcccctgccatggccgcttctttcccagtcacatgtcgtcaacttcctccgtgcttccaaatttggagtggagggctaaggccgaaagccccttcacccatgtccagctgtcatgacctgccagttctaggactgcgacctattttctgcacagctctgcctccaggccccttgtggcttctccagctcacacccagcctcccaatttcttttgatagccccacctctgtgggaagaagggcctgcccctcttggggtatgggggaggagggggctggatttaacaggaatgccccatagtcacacagtttggggctgttctttacttttgcttattgaacaaaatgtttgtgagcattacaccaaaaatggcttatggagcaaagtgccagggacagtttcaggcactggggagacagctgtggacaaaataaaaatttttgtcctcatggagctgatgcttaaaagcagggggcagggggaggcaattccctaataaaaacaataagcaaattatatagtgtactgagaggtgaaggggaaaagttgtgttgggggtattgaggccagggaccgggttgtcattttaaatagggtgtcagggaggtctccctgaggaggtaacttttgagctacagccttgagggagatgagggagtgagctgtgtagacagctagagcacagcccatgcaaaggccctgaggctggaatgtgcctgccctgcagctagcagggagtgaggggctgaggaagagtgagtgactgagaagggatgaattcctcccctttcacaggtgagggaagtgaggctcagagacagtatgtcagtcaccccaggacacacaggccaggagaggcagctgcagggcggggtgcctgatgttctgactcctggtccacgatacctccccggcaccctgtgtctcactgtttatcctgctacactggctggacccctcccagggccagcgcagcatcgtcctcctgccccaaagtgacccttgctctctctcatcccacttccttcctatgaccagtcccttctgagcacccaactctgacctggcacatgatccctagaaggggacctgctctgaggcagatttggtcaagggggcaactgaggcaaggaagtagagtcttctagtctaaaaataatgagcagcattattattgaacattaactacaaaacaggcgctgttctggatttttttggtgcatcttctcactggtgagaggttggtgtcattattacaccccatttaacagatgaggaaactgaggcccagggaggcagagtcactggcccaaaggcatacagctcatcagtggtagagccaggatggagcacaagccttttaagtcatgagctagtcctttaaccactaagccagcaccccaggattggggagacactcagtcctggactatggttgtggcccatcttatcctgcgaaaagggcagggacccttccacctgcctcccccaactcacccagaagacaaatcaccgcttgcttttgaagaaacgggctcaaaatgtggagcatcccttcgaggaagctcctgtcctttcctctcccttcctctcccaccctcttctcccctctaagttcctgaacagccacggggtgggggaggggcatggggagagtggggtgcaggtcggagagggaggtgcctgctgcattctcaccagacccctagcccgataggatctggaagtcaggctgtcctgatgacgacaccagctgcccttgagggccctgacatggtcactgggccaaggggcaggctggcctattctcagagtcgaaaaggacaggaattcttcatgttctgcccatgtgaatgaccgtcgagacaggaaaaacctcccagtgacttctgagcggtgatggaggccatcagagggcctgatccccttgcccacagcagcagcttcagacccccgggggaggagcccaggaatgcctccttcttgccacctgctctgccctgacctctcgccctcttcagcacagtaaggaatgttcatatttgtccctaaagctttggaaatgtttctgatgaaaggttgggctttcctctgcctttctggaaattgggccccttcaaaaagaaagagtaggaagataggacctgtgtgccagtccaggctgaggggtggcgggtcttggggatgaggcagcttgagctggggcccagcagggacctggagtgtggccgctgtgaggcagggctgggaggggccctagagaccacattctcattttcttagacaaagaaactgagccccaaagacagggcctggcttaccagtgatggcagaatctgcctgtgacctcagctgtcctgtctccgagcccagtgactcaggacacactgccaccttccagctccaggacaaaccttccactaccagatctcagggcacatgttcctggaggttcttggaaatggggcgtggaacctttctcaactgcagagctgtgtcatggagacgggggttgccactgccacgggactcgcatcctgcgcctgcctctcccggccagttccgctctgtcctcactctttgcagcagcctggacactgagcccagtggtgatgctgagatgatgaggaagacggatgctgcagctccgccctccactggctcaggatctgcttgagagacaagactgactaaggcagccccagcctttggaataatgatgctctcgagggatggcctgatagcaagccagctggagccagccaaggcccatccaccgggtagcctcgcctcagcttcctccttagctgtgggcctccgatgaaacctgcaccccagaggccgctgtgaggatgtcagtagtgcagccgctttcataaagcctcttttgtgtcccatgacttctagattagctctctagcccccggacagccttgtgactcagggaccaccgccccatttacggtggaaggaagggaggctccttcaaagaggagtttgtctgcccaaaggcacgagcctagtagtgcagagccaagatctgaacacaagtcccttagtccctaagcctctccagtacagccattgacaagtggattcactgcctgatggcccaggcaatagattctgggctaggggatctctagactccatcctgcccaaggggccgacggcagccctgggagggaccgcagctggagcggatgacgcaagctctggaccttctattccgtcccgccctccagggagcagagattctttctcctgcctccccttctctctggccgggggcctgaggctctggctctcactgccagcaccccgccccccaactctgtgttgccctgtcccagaccccatttccagctattttgtactaaagcgataacagaacaatgggtctccctgcatccctccccaagtcctgctggagtcgcagggccttaacccaagggaggctggaccccagagaggagtccagatgctggcgaccaccagggactttccgggggagttgccatggggaagatgggttagagctcagttcacgtccaccaaacgcccccccacccccaccaccgcacacattgcacacacacatcagcttctcttaggatgtccagttaaagaacagttaccttggcttgaattccagctctgccacttacctcaagggacactcgaataagtcacatgagccttcgttttctcatgtgtaagatgggggtgataatatggccattctcatagggttgtggtggggatagcaggggattcatggtcttgaagtacttgccccgctcctcccagccccggggtaggtggccctgggggcagtcttccttatgaggggtggaggaacaggtgtgctgcctgcccctatcacagaagctcttgtttggaaaggcagtggctccttggctgaggtgtgcagcagcagtgactcccccttgactcacagggaggcttggccactgatggatgttctgggccccttcctcttccctccctcatcttccccactcccccagccagtcaggtttcctaagccagccctcacgggcatagtcttcatgctggggacagctcggcagtccatctgtttctatagaaaccaggcttcctgggaaagagacagggggttggggaagtcctccaggatctgcatgggaatgacgcctcagtcccatctgatctggccagggcagagcctgggcagccaccttattcatgttattaattgctgtcctttacagagtacacaccagaggccaggctcctcagctgcactttcttatcatcacacatcacaaacctgtgggctttgtacagaagtagtagtctggtttcacagatgaggacatagaggctcagagaggttaagtaactttcctgaggtcacagagcaataaagaggagcagggatttgagcccaagttttcccaatcgttacaaatatgcttaccacctccctgtctgtcatcctcttctgactcttgtatccccaaaaagcccctctcttcctggctggtttagtcttggggactttgcttgttcccgcctcgcccctgggaagcatgtggaggtgctcttccctggcctcagattccacagcagatggggaggtgggagggactgcagggagtcagatcttggctgaagagggcctcttagctcctcccgactcattcattcaatcacaaatgcctgttgaactcctcctgtgcccggagttgtcccaggctcagagaacaagacccaaagaaatccttgccctggggcactcccctgcgagtgatgccacagctttctgaggaggtggggcaatgtcagaggccagtgttctcatccagtcctctaaccttcacggctgtccagaccccccactgccaggtcctctgccaagagcatttgcaccccatctcctggagtcttcagcaccccatgagtaaggcaagtaaggcgctgtggtgtgatccccattgtattgagggctgagactgctcgcttaaggccacctgaccaacagagagtggccacttttgaacccagttctgcctaattggaaagccctttcctgccctatgccaccagcttccatgtggcctggggcacagcctcccctcagcccgccacgtctaacctgtgggcttctgagtgtgctggttgggcttagcctgacagctgctcattccacctgtgttgacaaagtgcctgctgtgcaccccagcctcacggggagatacacggaggagcacagtacaagccataccttcagactggttggtcttggggagtcaaactgccgtgaaatgaccaggagtagaggctataagtggccagtggctgcagacactgagacccgtgagagtccagaggaggatgaggacccagtgccctgggagggccctgggaagaggggctgtgtgcaagatagcctggaggaacaaggagcatggtggggggacagagtgtcccagggaccttctcacttgtgtaaagggtcagcaatgagaaccactgttgaaaggtttgctggctgatcgggaatgtgggcgagagcagctggcagggcagaagggaaaggttcaggatcccaggcctgggccctaggagccatgtcctcccttcttgccagacaggtgatgtgggtggaggagtggctgtccttgctgcccctgcccccagcctcctgcagcctggctcctgggggaaacccccgggggcccttcagaaggcagtggggcagagcaggaagcttcacagcactgatggcaggctttttccactgtgcacggctgagtggagaaagggaagtggaaggagggccagactcctccctgggcagggcactttccccatgggtgcccacgtgcactccttctttctctctccaccagcacgtctgcgaggtgagcgttctcactacccccatttcacaagaggggaaactgaggctaggagaggtgtagtgacttgcacaaagccatgcagctggcaagagggcagagccaagactcaaacccaggtcccctgcccccaaagccggggtttggccatagtgcacggtggagtcttctgtcctcacttaggcctgaaataaacacctggagtggccctgaaggggaggaaaggtcaaggggagacctcaggggtgtgtgcagcttgcctcgccagtggggcaggtgaggggctgctgggtggatctgatcattgcagggcccagtcctgggggtgaagtaggggtggagcgccgttctcagagcagttatctgtgctggaaggtgggtgtggggccctcctccctggaggtcaagattccattttctctgtggggccacatgggccctttgtgagtgatgccctccctgctagggtgggcttgggaggtgggcacagtggttcccaccagctcagatgtctgatggcagtgcccgtggatgaagattgtcccacccatgagtaattctgtccaggacactgtagtgcccactcttcccagccccagcaggtgggcactgacacgtcccacagccgttgatttgcagcagctgttgttgactccgtcctgggatgcagaggggaatgctctgtgtgtgtatgtgtgtgtgtgtgtgtgtgtgtgtgtatggtgtgtgtgtgtggtgtttgtgtggtgtttgtggtttgtgtggtgtgtgtgtatggttgtgtgtggtgtgttgtgggggtgtgtgtgtgtggtgtctatggtgtgtaatgtgtggtgtgggtgtggtgtgtggtatgtggtgtgtgtgatgtgtgtggtgggtgtgtgtagtgtgtgggtgtgtgtggtgtgtggtaggtgtgtggtgggtgtgtgtgcgtggtgggtatgtgtggtgtgtgtgtgttttgtgtgtgcattgtgtatggtgggtgtgtgtgatgtatgtgtggtgggtttgtgtggcgtgtgtgtgcacgtattgtgtggtgtgtgtagtttgtatggtgtgtgtgtggtatgtgtgtggtgtgtgtggtgtgtatgtgtgtggtgtgtggtggatgtgtgtgtggttgtgtggtgggtttgtgtggtgtgtgtgtgcatatgtgtgtggtgtgtgtggtggtttgtacggtgtgtgtgtgtggtgtgtgtgtggcgtgagtatggtgtgtatatgtggtgtgtgtgtgtgtgtactgtgtgtgcagtgtgcgtgtgtgtgcatgtgttggtggagaggggtcagcaggcagaggaaagcaatgcatccaatgcctggaagcttctgcccctcggaggtgggccgtggacacagcctgggcctggtgggcagtggctgagcgccagccttgtgcccggggactgagatctggggctttgcccagtggggcggagaagttaagaagtgttagttagatccatttcctactcctccatggcctccatcctggtgccactgccacatgggaggcctggggagggtggcagtgtctgtgtctgataattgcctgtcttcactggggacttgctgtgggccaggcacttccccatggcttcatggagattacagcttttattctcacagtatctctataagataggacaccttattttcccaactacacctgggaagactgaggcacgtagaggttaagtgactgacctgcccacgggcacacagccaggcagtgatggatctgggattcaaatccagggagcgtcctcagcagttaagcacttacccattaggccttctggcttgagcagtgagctggctctttctaaagcactgtctgtccattattttgtttctcctgagaccagctgtaggggaaaagtgaggttggctgttttcgtttcacagatgaggaccccggagctcagagaggaaaagtaacttgctctaatcagtggctagcagatcagcgccccctcccccggccaaggctgggagctctttcaggatagggggcctgtcccaccacccatgtaccttgctcacagtagacctcactaagtgcggattcctcaggcaaatgtgcaggtgttttgctgagtgctctgagcttttctttttgccccgggctccctaggaagtgggaatgatggctccatttcacagatgaggaaaccgagactcagagcacaaggccacacagcaggaagaggtaaggcaggactgagggaggcagcacgtctggcctgggagaggggttaaccagccaggaggagctcgtagaagggctgaaataaagaccgaccttaccgagtgttggtgaggatgtggaggaactggaacactactgcattgccagggacacgcagtggcatggctgctctgggaaacagtttgatgctttctctgaaagtccaacagggatgtaccacacagctcagcaattccacccctggcatttacatagagaaatgaaaacttacggtcccacagaaacgcgggtttgtagcagctctattcataatcatcaacaactggaaacaacccacatggccttcagtgaccgaatggataaacaagctgttacacgtaccccagggaatactgctctccaataaaaaggagcggactcttgatacacacagtgacttggaggaatctcaaaggcattctgctcaatgacaggagccagcctcaaaaggttctacgctttatcattccacttacatggcatatttgaaaacacaaaagccatagtgtcagagaatagatcagtggttgccagggtggaggagtgaggggagggtgtggccagcgccagggagtttttggggtgatggaactgctcgttgtcttgatctggagctggtggctacaaaaatctatacgtgtgctaacattcaaataactgcacaactgaagcccatcaattttgctgtatgtattaaaagataaaaggccatggggaggctggaagaggaagggcgtgggccaggcaacatccttggctgaggaacaggtgaaggacccggttctcaccagtggcttagtgactttcagggcagcctcgcctggccacgggagggacgtggctaattgtagcttctatctgggttcaccagaaggcagtggctagcagctgaggtgtcaggacggcgtcctgggccctccaggagccgggtgatgaaaggttaggccctggcttccctggcagggtagggttggcctcctgtcctgatggctggcacacaccgaagcattaaccgggagtctcttgtgtgccgggtgtgggactgccgtcacagttaccacccgccgctgtctcctttcaccatggggcctgtgtgtggggaggagaaaggcgtatccactcctttttgtggatgaggaactaaagccagggggcgtaggagggtagtttggcctggaaatgacatcacactcactaaagaccgccaatagcaacttttgcagtttttttcccaatgcgacatggtatactgcctccctagttgatccggtctacagccacattattcacagaccccacagtttgaaactgtgttctgatatttgttcgggtgctttattttaagacaccaggaggctcaaaaatgggaggtgacccggggacatccccgcactctgcctctggcagccctggctggggcaggagggtgagatttgcctggggccacagggcactgagacagcagggtcccctgctagagggcccagtggcttctgaccctgtctgtagatggggatggcttttctgccttgccagagggtgggtgcaagtgggaatgagattctggaagtggtccgaggtaggaagtggcacgaccgttattcaccttggttggcattgaaaccccgggagcttggtttcctcatttgcagcgtggccgtcaatagcgcccatcttgcagggcagctgtgattagagaagccagggccaccccggagccagcctctgaggcttcacctcaccccgtttacactgctgtctcctctgcatagatttggctgactgaggacgcgacaggtactcagcttctttctgcatctcagtcgcccagcacaggggctggcacgcagtaggtgctcccaacctggtccaagatgttgctggcggtgggggagtggggggctggggaggatcatgggcagacctggggtgccgggaggggctggtggggggctgatggccgggagggcaaggcctgagcagggaatctagaccaccttagtgtccccgtcaacacccctggcagccttctctggctctgctgggtatgagggcaccccctccccttctttggtcttggcaggtttgaaggggggtggcagggagacgggagaggggctcaccggcttgcaggattgggcagaagtttggtgggggcccaaaccccagaactcagaagcccctgccccaggcttggacagaccctccccttttctaaacctcatttgccccatgaatccaggctcctttcctccccatccccccaggaagcttggatgtggccgccatccagacccaaatgccctctcctgggccctgtgcctccagggctggctctaaggcaccatgcaacctgtcagatggggtgtgctgtgtccacctacagcagaccagctcccagagcctcaggggcctggagagcatttcctcaacccatttgacaaggaagccagctgtactccccctactgccctgggctcgtggggaggcctcagcaggcctggtgtggggtgtggccttccgctagtcaggccccttcccctagggtctggaagctgggtaggaactgtggcctgaggccggtgtctcccctcagcccttctgcagaggccgggctggaggagaagatggcggccaagcagcccccgcctctgatgaagaagcacagccagacggacctcgtgagccgcctgaagacccgcaagatcctcggcgtgggcggggaggatgacgacggggaggtgcatcgctccaaggtggggtgcagagcaggggcctccggcacccactggggaggccaggctgacccaccattaggggagaaggttagcccaggcccaggtagccgcaggagttctaggacttagctgattttcctagaaatgtaacagcaatgccaggggaataacgagatcattagaattaagtgcctattacgtgcccggttttccagcagttgctttttaaatcttcttgttggcactagaagatgcagatactgtaaaatcattcacccattttatagatgaggaaacaaaggctcagagaggttaggcaacttgcccaaggccacaccggtaagtggcaggaccaggcttcaagtctgcatttggcagagccctgagctttcatacgtcaccatcatattttcagcttcttttaaatcctagtgtcaaggggaagcaggagagggggtggcctcatgtgaccctccccacctgggggaacctttggccaagctgaggtgcccaggctggtccctgggtgtgcagggctctgggaggatgagcgagtgggggcgctgagagctgccctcaccctggttgcctctgaccccctctgtccacagatcagccaggtcttaggcaatgaaatcaagtttaccattcgggagcctttggggctcaggtgagcatttacctgactttttgggggaggggaaggcctgcggcggtggggcagaatgcataagacctcacctcatttggcctggtccctggattttattttgtctcattaccttccccaaagctgccatccctggggatctgggctggagaggggagggtcccctggggcagggctgtgatcttctttccacgcctcccagggtctggcagttcgtctctgctgtgctcttctccggcattgccatcatggtgagcccccacccccagcccctgagatctggccccgtgtggctccctcagcccttctctggctcaccagaggtgcctcctccatcctggcccctcgtgcaggggcccatctgtcaggctctggggctgcctccgagaacctgactcctacactgccacgcctgtgccttctccaggagcacactagatcccatggtttgtggcctgactccttctcccaggaaccctggagttttctgtcctggcatgggggcgggtggggacaattgggtccagaccctggactgcccccaaggatgctgatcctgctcctggcggggaaggaagacgtctgtgggaagcatcagctgtcaccccccaccctctcccaagcgggacctctgagcccctctcgctgcccgcaggcgcttgccttccctgaccagctctatgatgcggtctttgatggagcccaggtgaccagcaagacccccatccgcctctacggcggtgccctcctcagtgagtactgctggggcgggccctgggggaggcgacgggcagctgggagacccagcggggctgaggagagcacgggggtccgtgcccgggcaccccttcctttcttcggccagatgctgcgcccacaccccggcctctgatgaagctctctgctggggatgtgctgccatcttgtggccattggtggaatacacccagtgggttggagcttgcagtcgccaccatctgcaaggagcgctcataagtgtgtgcactgcctctgggcgttgtggtacagagatggaggaagcccaggcccagcctctaggaattcacagcctagaggagaggcagatcaattcagtgtctgcaaaacccctcgcaccccccctattttatccccagagccacttctgtttgaaccacttctgtttcctctctaacctgagatgcacacgttaggatttggaattacaatttttaaagctcagcataggtaatatgcctctatttctacgaaatattctatggctccctattgcctacagaataaaggctgagctcctctggagttagggttgctggaataaaataaatgcacacccagtggcatgtctggtaccagcagacactgggtgggcggggcctgctagaggccaagtcagtggtcttctgctaaaaagtatggttcatccccctcccccaggggacttccttaaagcgagtccttaccgggctcaggttttctgtctgggagtccgtgtaaaagaaaacccaatcataggaccaggtaacccattaactcatgaactccatcaacacagcatcctcctgacagaaccggacatgggcaggggccaggggctcagtcctccccctttataaagagatcgagtctcaatgcggggaagtgactcgcccagtgtcacatagggccttggaatgacaggagcaggctgaagcagcagcattgagtctggaggggacaggatcggggacagacagctttgatttgagaaatgtgaataggggcggaggcgtggagtccaggaccccagctgtcttgcagcagtggccagaggaagcaggagcagtcctcctgccctgctgggagggagtcagctgtcccacccccagcccccttttcatcccccgccccaggcatctccctgatcatgtggaacgctctctacacggctgagaaggtcatcattcgatggaccctgctcaccgaagcttgctatttcggggtccagttcttgggtgagtcctgaggtgggcagtgagggaggctgatgggccgcttcgcccctgacctgcctgctctagccacctgggtgtgtgggaagtgatgaaaacctgtctgtggggggctagggaggggatagagggataaggactcacctggctgtgtttacttgtgtgcctgcacacctgtgcacacatgcctaacacacgtgcctgtagcttcccaaatccacacacttgtatctatggccttgcacacacatgtacctgcggcccccccacacccactgcccactgtacccagcacgtgtgtaataacacgcattcaattttgcccacctgctgtgccccagttcctgccacatgggagacatcagagcagaaacatctgtggggttggcaggggcagggggcaggtcctgtgcttcccacctgggaggatcctgggctcagagcaaagtcagggagacggccacaccagcgctccgggctaggggggcagcgctgggacacatcccctcctctgaccctgtggccttgctggactctctcccacagtggtcactgccacgctagctgagacgggcctcatgtccctggggatcctgctgctcctggtcagccgcctcctttttgtcgtcatcagcatttactactattaccaagtcggccgaagacccaagaaggcctagttgcccgctgggcctggggccctgcccatgcctgggccagagtggcgctggggcctcggcttccctttggctcctggaaggcaggagggtcccctgccctgccccagtcctgccccagggaggcagggggtggggggccttcctttcctcctgggcaccccgtgtgctgtgatctcctgggctttcaggcttgacatgctggtctggggagagacagggcctctgctgccctgttcttcaccctcacagtgatacctcctttccttgggtctcttggcctccagaccccctcaatagacactgactaaagtcaagctggagtcatgagggtagtgggctaagtcgagggtccagcctcttctgccaggaagcccttcttgcttttgagagaggctgtgaccaccccccatccttctccctacactcccagccaacctagtgcccaagcagctaaacttggcttccttctaatcctggaaaaccctgtacccctcctcctcaatctggccctctccacatgcacaccctgaaaacacacacagacacacaacacacacacatacacacccctgaacacacacacagacacacatacacccatgatgtgagcaaacacacacacgtgcgccttcatagcccagccaagggcatgcaggcagggtgtgctgcctgagatggcacctccctttcagccattcttcaagaatgggccacacacagctagaagtcctctcccagctagaagtcctgtccccactctcctggcctgacaagatgagctctcctgggaccttgctctagggcactctgcctctaccctaggacactggaatgccctgggagccccctccctgcaaccagcctgagttcagccccacggacaaagggacacacagcccccaatggagaccattgtaagtggtggggctgggagaggaggaacagaaggaaagccatagcgctctcttgccccttggcatgtaccccaaggcctgatggccactgggctcagcctgtcccccactcctgcctgcttcccggtgagctgccccccacacgtgcagcccgggctgcctccagggtctggctgagtgggatcaggtggccctccaactcagcacaggaaataagtagaaacatttcagcaggccacctcccctcatcttccccgccctgtccagcgccctggcaaaggctgacaactggctgtcttggggccgaacagcccctgccctgcctctgagggcccaccagcctgtgctgcatacccaccgcccagcttctccctgagggcccaccagcctgtgctgcatacccaccacccagcttctccctgagggcccaccagcctgtgctgtacaccccgttagtccctgatcccaaccttctccctcctgccagcacaccgatgcacacaccggaagtggcgagcccaagccctggggacaggtgtagggagaaaagcagccccaggcctcagactcgcttcccatcctggcatagagtgggggatggctggagggtgtctataggtacagcccgctctggctgctgccaggtgggcccctgccaggggtcctcacccctgtccaccctgtgcctggctgtccctgcacccagatacagcaacatggcctgtacccagcagagtggtggcaccaccatggttacagcggatgccccgagactctgcttggtaaacgtggcagagcagaatgggaggctggaccctgaggaagggcccctctcctggcatctgtctcttgctacctaagcctgtgcctctccctaaagagctgcctccctgctgccgagccctggtctggccacgagccactactgcctcccacaggcaccactgcctcccgctgctgcccacaggtggtgccgccaatgggcagtgccctcaggccgaagcctcaatcccccatctgagccaggcctaatcctctaatagtgatggttggtttgtcctcccataactgcaggtggattccacctggggaatgaggctgcgtgtcgggcgtctgctggccctgagacatccagtcttccacactcaactgtgggatgggagggtggcgtggccttaccccatgaggctgtccaggctctggcacacagctgtgctcacaaaatactgggtggcttggttagagctaattgtagtggagcctgcaggtgagggtgagggagggggctgcaggtcaggtaagatctggaagacagacgtacagcttggagggcagggggactctaaggcaaggagatttacagttgggaaggaggcagtggcagaggggtgagggacaggggcccttaagtccagcgaggaaagctcggtgtgggcccgctctacgctccgtttggggtgacctggaacgcctcttctcccagctccctccagccatcagcagcctcttgtcaagcttctgcctcgccccagtctatccccaaccccaaatcaagaccacctttcttcacggtcactatttattctttgttcctttttctttttgtaagaaacattcacaaaaaccagtgcaaaaccatcagtgtgggcgtcctgttttatattacaaaacttcctctggatatatcatataaaaggggggtctcacaggagagaaacgtgataaattagctctgcaatctacggcaaggaacatagtttttaaaatagactttcaacatatgacccatgggggaaggaggagggggcttctggggagacggcgggtgctggggcctcggctggtttgggaaatcctgtccgggccccttaagcatggatagagacatagacaagggaggctgtggacaggcctgagcaccaaggccagaaattaacagggaccctggggaggggccctcacccccagcccataaagagctattccctttctctaagaggcagtagcttcagagcaggaaagtggctttcgatacaggcagggtttgtgatgagcggtgtagtcttcttgttccttgccctgttagtggggtccgaggaagtctctgttatgggctgttgtatttcggggtgaaaagaaacaaagaggtatccctgcccacccctcccccacaaccccagccaccaccagaacctgctgtgggttgtatctggaccaagccagctaaaccctgtttctccctgtgctctggagggaggctcaagcctgatttgggctgagctttctttgccttgcctccaaggaatggcctcaggcagtcttgcaaatagctaccagcctgagcgaatgccaacaggagcagaaactgcctgtcttccctttccagcctaagagggtggccagtggctggctggcgagctgaatcagggctgattgagggttccttggcacatttgtagaaagctgctgaggggcagtcttgtgtctgcccttgaacccaccttagccagatttcccttcatgaccagccctttctcttgggtcctccctctgacttctgtgggccccagaagcctgggatgcccctggattagagccataaagctgtgcaatttgcctcagtcctgcccagcatgggttttttgttttttgtttttgtttttgtgtgtcatcctcagaccagccatttgcctcttccaaaaagctggggctaagcatgtgggtggttcaagaggggcagcccccaggccccaggctgggccgcggtaccagtggcaggtccccctgggtctcaggagcttagcttctacggagctcaggtgtcatttatggggttgccagagcaagctgttaaagggcgaatttggtaagactgagctcagagacctggtgggagggcaaggactggcgggcacagcaggaggagattagaggagggtccacctgaatctttgcagcaggcacagagcttctggctgcatctcagaagggggcagacgcacaggccagggaacacggggctctaggctgtggctccgagtgtccctggtgactggaaagcctgaggggaggctggaagctgatacaggatgccggtggcttgtgagacagaatgagctctttcttcctgaagagggacagaggggagagaagagagcagacatcacactgctccttccatccctgcccgtggcagacatcactaatcaaacttacggtgcctggcagacatcactcatcaggattgcactgccgtctcccactgagcccagaccaaacctcagatccccagcacagcctccagcagccacccctgatctatcagggtaggagcatcttgcaatccagttgccaacactcgtctagagtttgagaactgaatacttgtgggtgtgcatctgcgagtctccctgcccaagcctggagggaatactaagaaatgtgcggacagtgaagagacaggaaaccttgttgcagcagaaatggcctcgatgccttcgggattctttagcctggagagaagagggctcaggggagtcaatgtgtgacctcaacactccaggaaggagagtgggcaagtgggatgccatggacagagccacagaaaaacagaaacctcttctgtgtattaagctgatgctaaagtcagagcagtccaaaggcaggaggctgccttgggaggtagtaagctctctgtccctggaggtatgcaagagggtggagaagtcttggcaaggatgttgaagaagatatccaagcctcagttctgggtgtggagagggagacccagatgatcttggggatttcttccactcttggagctggggagttggggaaggacagggaagggggtggcatgtgggagaggcgggcagtgtggacaagggaatgtgatgtgcacctctgtgtgttcctggggactgagagagaggtgtggggaggtaggagcgagggcgcggtgggaagtcatggaatggtgttttcttagctgtagagcagggaggaggcagttcctggctgacttgccctctcttgtctgggggaaccgggatgctgaggccaggggtgcatgtgggcagcagagctgacagagtcctggatgcagtgacagcagcctggagacaactcagcttcttttcagaactgtcacgcctgtgctgtgtgtctgtggatggtcactgtcctctctgggcctttgagattatttggtccaacagatggggaaagcaaggatcctaccagctgggccattcttggatgccgtgttagcagctcactcttggccccggcctgaaggggggaacagtccatcctccagtggaccagggattgcgctgtgggttccgagtcctcaaagacatggcagctgaatctccgtgcagcccctgggctttgatgacttctctgagatttgcttttgcctccttgttgcctaaatcctcactttcttggcatcaggtcctggtgcagtgaggagagagggcccagggtctggctggaccaaagagggcgctgggcctggtgttcctttggtctctagagcagcctgcatcctgggccaggtgctggggtctctggagaacccacggcacctgccctgagtccaggcgaggatacatcagtccatatttttgtcttcattttgttttgttaaaaaaatagctctattcccctggcccttctcctggccatctctgatggcctcatcttctcccctggggccaagaggacagcggggaggggcacgggaggacattgggtgctgggcagtggtgggtggggcgagtcttcaggcttcaggccataccctctactggatgccccggaagaggcacatggcaaagatcatggcgaaaagctgcaaaaaaagaaaaagagcaggaactggcttatcaggctgggccctttgtgggctgcctggcccactccaggggaaggggagtgaatgcctgtcactcttagcacactcctcccctaaggattcctgacattcccctggggccagcccttctcaccagcccctacctggcttcctttatgtggtggagtcatggaccaggaagactttagaaacgagtgttgggttcaaatccagctccctgacatagcagggttgtccttaggcaaagcacttccctacactgggcctgagtatgtatccagagcttgccatgtgccaggcacagttttttttttcttttttgagacagagtctcactctgttgcccaggctggagtgcagtggcacgatctcagctcactgcaacctctgcctcccaggttcaagcaattctcctgcctcagcctcctgagtagctgggactacaggcatgcgtcaccacgcccagctgatttttatatttttagtagagacagggtttcaccatgttggccaggatggtctccatctcttgacctcgtgatctgcctgcctcggcctcccaaagtgctaggatttacaggcgtgagccacagcgcccagccaaggaacagttttaagtgctttattgggaggtatgtaacctacctgaggtcacagagccaccagcaggggagcttgggtttcagtcccaggcattgtgaccccagagcccatgcttacaacccctgcaggctcgcctccagctcacaggaaggtggtgagatttaagtgtaatgcaattacctaatgatgtaatgtgcctcttatctagaagttgctcagtaaaaggttaccaggactgctatgaataggcaggcagctgcagcccttcccggagttatgagctccatccctgaacacctgtctgagggcctggggtggtggggcagggagaccctagctcagggactctgaccagatttgctgatgttctcacggccagagctcattgcaagtagctgagggaacagtccctagaccacaggtcatggccaaatcaccaggaggctcactggggtggggaggggctaccgggacggggccatgtaaaggtctccgtcttgagcaggattctgcctcccatggggctggccagccaggctcatgggctgggctgggagtgaggcagcagatcaagtatatgaatgctgcttcctgagccccagtagcatgctgtccccgtcatctgtaatccctctgtgccctgggagcagggtgatcagcccattttgcagatgaagaaactgtgacttagacatcctgcatttggagagaggcagagctgggagccggactctagggcccatgctattccttcatgggacacgtccctgagatttccctgggcttgctgcggatttatcttgttcattgttgcccgccatgaggggacttgttcaactataacagtgctggcgaagaatagggctcagtgtgtgcttgttgaatacatgaatgaataatcaatgacccctccctctccgccatctgcagtagcctccacgaaactgcactccgtggcgctgcaggcacagtgggaaaccaggcaaggcgaagttcatggtgccaggtgcccaggctgctggagggggaagctgaggattgggctgcctgacttccttcccccgcaggccgaggactgactgaggccccagagtgccccttcctgggtttggtcagatgtgggcaacgctctgtccagcccccaggagcagcaagtcggagatcccagatgatggagatcccagaggacagaaacgggaggcggccgctcctccctttggctgaggcgccacctagtggtgattgcaaacggtctgcaggagcttacctttcaaggggactctggggccctcagataaaggaggctaaggccaccgttgtggatgaataaggccctgtaggccctgaacaccccacagagaaaaggcctgatctcaaaccacgggctgcagcctgtccttcaaggcagccgtgctgatgcctctgcaagcgtgaaatctctctggaccatggagctggggcggaggtggggatgaggatggaagagtgagagggagtggggatgacactcagggcctgcccatccccatttctgggacactggctcccatgtttcatctccagagttcaagaatgactctcaggcagcacagacacagccgggcttaccaccccatagcacccacagtgggggccccttgggtcccaggtgaaggaaatgaagaggaaaggaggctggggggatctgcctaggctccacgtgaggcttcatcctggggagcggcagaagtgggggcctttacttacctcgatggccagtaccccgatggcaagggctccggccaagtagacgtaggtctcgaaggtgttgaggatcaccgtgtaacagccctgggagggagggatgagaggtcaagctatggccagggttgagagtcctggagtcagagtccagcatgtggactagggttcatggcaggtgtccccagagctctcaccctatcacacggctgctgagacaggacagtggggagggggtgcagggcaggagacccagaaacagcgacttggcagcattgcaccaaagaccctctttgccacccggcccctaaggtgggacagagaactgacagcgtgcaggccatgtctaatgttgcaactacagtgattggaatattgggaaatttcccataaatatttggacttcctgctgctctggagaaatcagaagaaccagcaaggggagctattccttttcacatcagcagctgctgccttcgggtgccaacaggtggtccctggggatccacagcactccacccctctcccccgcacaattccctattgtttcacacccactcgctctactgttcctcgtgacctgcctggctgcagaaggtgttttggttttcggccacttccccaaggaaacacagcccagccttcaaatccctgctcgcatgccacctccttcgggcagctttctgaaccagcccagtccacaggccctggacttaattcccatgatcttactgctttcttaagcaatcctagagatacataaactgagacagagacagagatcgagatcgagatcgagatagatagatagagataggaaaaagcaagctagtgccaagccaggagctgccagtccatggctgctgccccctctgaccccaagcacctcacacctctgtcattttcatgttcataactctcccctcccccatgctgaccacagagactgatgcatggtacttgctttgaatgacacgtattttcaaagtgggagaactttccttcctttataggagcctgcatattctttgggcccaggctgagaacctgcaagggaacaaatccccagatgggggtggagagatcatgcccagccctttttgggtgacggttgctatttctgggctctgttgagaccggggattcttgggtgctgacatgctcacttctcttgtccatcgtgcagaagcccagcccctttggccaaaagtaggactgaggctgcacccaggcaggtggacagcagggcctgatctgggactagtggccaggtggtgtcctagtacctgcctggaggctgaccaggagctgggcagggaagtcccccagaagccctccctggagccccatggagcaaacaggacatacccagatagaaacagaccccaccggcacgacgatctgggtccatgatactctcaggactgagtgtgcatgggaataatcggggaagtggttggcaatgcagatgccaagacctcgccccacaacactggatcagtgggtctggtgtggagcccaggtatcagcattataggacgatacccaaggtaatttctagtgatcaggctgtggccaggctttgaaagacctcaagcccagagatgacaaggagaaaaggtcttaattgaaccttcaggccttgtctctgctgtggcactgggagcccagttaagggctgtatgactgggatggagccctaagggcaacccaggggttcctaccccaggccaggccaggccaggacatcagtgtggctgggggtccgttcagggctggccctccattcagtgaggcccagggtccatcctggatctgccagcagacccatgttggagccccaaatcctttgttaagcgagttttttaaaaattatactttaagttctagggtacatgtgcacaacgtgcaggtttgttacatatgtatccatgtgccatgttggtgtgctgcacccattaactcgtcatttacattaggtatatctcctaatgctatccctcccccctcccatgtgaagcgattttgaagcattagaaccctaaaatgcagaactataacagcagaaaaactaacctgctctgcgagcaaggaaagagaggtgagttgtatagttttgggatcagccctggcaggggatgcctcggccctcccatcatcccctcagtgttccacgtgcctgccagccacagggacataatcccacctcctgcagccccaacacacacactgggtttgtgaactctttgaggggtttcccggacagggaacagcaatggcccaggagagtggtatctggcaatggtccttagggcctggttgcctagggtcccagccagcgctgccactggcttgctgtgcgaccttgggctatttacttcctctccctatgcctcagttgccccatctgtacaatggggccatgtagattacctcatgggattgctgtgaggataaaatgagatactgaaggtaaggcactaggaagagtgttggcaagtagcaagctctcaatctcaatgcctgttaggattaccaaggattaccgtccgtctctctgtgccgctctcttagcatatcctgagtggtggaaagtgtctgagcatagagttgggtgtcactgcaatataatcacacacacacacacacacacacacacacacaaccccacacaaccccagtaaggggacaggagaagcagcacatctcttccagagcatgaaattgactttgacatgcctcacccggggaaactggcaagaagccggggaccttgtccagcagagggaagctgagccctgctgtgtggcacctgggccttgacagctcatcttcccctatcaggctttggcaccaaagacccttcaggcccctggactcaaccaagcagcccaggttgcccaatggaagcttcccaggaacagagacacccctggggaggttggggcatggacaggatgccaccacccactctgaatgagtgtctgctctcttgataactttgctagggcctcgtgggctctttctcacttgatctcattacagccctcggggaggaggggtcttacctgcattttacccacaagaaaagggagggaggagcagtggctaacttgtttaagatcacacacgaggaagggaagccaggatttacactgaggattccaaattcccggtctttcctctgtgcttaagggaaagggggctggcatgagcggctgggttctccctcctatgggccaggccctggctgtagcccagagcttacatctacacacctggagattgcttcaccaccacccaccatctccaccccgtgacggtttcccctgtcaccacccggtgagacacatggcggggagcctctccccagcctgccaccacagactatgagtcttctaaccatgtgggctgttgccagtgccatcctccctctctgctgggtgggcacatcccccaccccctgctgccacccacagtcaccacccacctaatctgatgaggggcagccaggcctggttgccaccacaatgggtcacccacacgcaatgcttcccacacgtacatctccagcaccgacccctccagctccaccccatacacccagctgcccactggacacctctgctcagctgttccaaaggcttctttttttcttttttttgagatggagtctcactgtgctgcccaggctgaagcacagtggcatgacctcagctcaccgcaacctccgcctcccgggttcaagtgattctcctgcctcagcctcccaagtagctgggattataggcacatgccaccacgccaggctaatttttgtatttttagtagagacggggtttctccgtgttggctgggctggtctcgaactcctgacatcaggtgatccgcccgcctcggcctcccaaagtgttgggattacaggcgtgagccaacgtgcctggcctccaaaggtttcttagacgcaacatgccccagactgaatgcaagatcgtccccaaaccagaagccagtcactcagcacctcctcctgcccctcctccaatgaggacccatcacgaaggctggtagattttgcctcctgaacatttctcagatccacacacctctctgtctttaccgccatcaccctggtcttacctgctgtcctttctcactggcaccagtataaaagccccctgtctacccaggtccaccaccaatgtggaccagggggccacagagcaactaggatgtccctgtggccacgccatgcatccctgcacacctcacccccaccccaacccccacagtgaactcaactcttcccagatccttgccatgggcctgccagcaaagtcagaaatgtatcctagggccggacatggtggttcatgcctgtaatcccagcacttggggaggccaagagggtggatcatttgaggtcaggagtttgagaccagcctggacaacatggtgaaatgccggtctctaccaaaaaatacaaaaattagctgggtatggtggcatgtgcctgtagtcccagctacttgagaggttgaggtgggagaaacacttgaaccctggaggtggaggttgcagtgagccaggattgtgccattgcactccagcctgagcgacagagcgagactcagtctcaaaaaaaaaaaaaaaatgcatcctgggctttaagcaagagggctttggaggaaaagacaaatagagacagttccacagcagcagatttttaacgggacgaaatgcctaggagggacatgaatgtctcagcaaagaaaccccaggagccagtctcagaccctcaggaacaacagagtcactggaaagaatgaatgtggctgtgcagggacctctctgatgagctctgattttgaagacatgcccaggagaggaaaggagacatcctaacggaggatgagtccagaaatgggaagcacatctgatgcggggaatgcggcccatgggaagcctcctgaaaacttacaagtagcattaaaaggttctaagtttggctgttggcaacgggcatctcaaacaacagctccttcaccaagttacaaattcactggtctttcacataaaccccacgctatggtggccgctgtatgccatggaactgtacgtggcccaggctccttctctctggatgctctgccatcctaggggccacctccctctgccaagtcctagccagagaaaaaaggaggggtgggcacagcactttctcttaaggatgtgactcaagttgcacaaatcacctctgctcacctcccgttagccagaactcggttacatggtctagctgcaaggcaggctgggaagtgcagcctctagctggtggtcatggggtgtgataaccattcccttcccaagagagtaggggtgaatggatcgtggggggcagccagcagcctctgccaacatatggaatctgaggtccagcgagggtgtcttggcgaaggcaacacagcagttaacagcccacccctgcctgccatggaagcctgaaactcccctccccgccctgcagctgctccccacggcaggtctctctgccccacgtccacagtggcctcaactcagggccctcatttctctattgagcctctttcccccaatgcaggaaggcagggtgatgagggacagagagaacgtggccctcagggcctcaggaatccatggggatgtgccagggccagaggggctgagttcctggggcagagctgaggctggaaagggcccgccagagccccaggacccaggcctctgctcactgtcacctcctctgggactttgcaagttctgccttgagcccccacccaaggcccattctagcccctcatctggttttatttcttcgcagcaatcatgaccatgtgaaatgattacttctcattagtttgctgcttgttcatcttgcgcgtcctctaatgagatcgtgagcctcgcaggaacaggggccttgtctcctgtcccctgctgtgtctcttgcatctggaactctccatgagaccctcgttaaagtcctactcaagcaagggggctggggcccaggcttagatcaccctcgtcctctccctccctctcctcctgcctagcctggtcacacacccacactg

SEQ ID NO: 1217 - DNA, 5029 bp, Homo sapiens
ccccgggagagcttcgcgggggagccgtgagcctggtttccccgccaacccccattcccgccgccccggcggccaccctgggggcgaggcagcccggcgcgtgggaggggacggcgcgccattggcttgtgcgcggaaccgagaggagggaccagcgcgggccgccagactcgcccttctgcagaggccgggctggaggagaagatggcggccaagcagcccccgcctctgatgaagaagcacagccagacggacctcgtgagccgcctgaagacccgcaagatcctcggcgtgggcggggaggatgacgacggggaggtgcatcgctccaagatcagccaggtcttaggcaatgaaatcaagtttaccattcgggagcctttggggctcagggtctggcagttcgtctctgctgtgctcttctccggcattgccatcatggcgcttgccttccctgaccagctctatgatgcggtctttgatggagcccaggtgaccagcaagacccccatccgcctctacggcggtgccctcctcagcatctccctgatcatgtggaacgctctctacacggctgagaaggtcatcattcgatggaccctgctcaccgaagcttgctatttcggggtccagttcttggtggtcactgccacgctagctgagacgggcctcatgtccctggggatcctgctgctcctggtcagccgcctcctttttgtcgtcatcagcatttactactattaccaagtcggccgaagacccaagaaggcctagttgcccgctgggcctggggccctgcccatgcctgggccagagtggcgctggggcctcggcttccctttggctcctggaaggcaggagggtcccctgccctgccccagtcctgccccagggaggcagggggtggggggccttcctttcctcctgggcaccccgtgtgctgtgatctcctgggctttcaggcttgacatgctggtctggggagagacagggcctctgctgccctgttcttcaccctcacagtgatacctcctttccttgggtctcttggcctccagaccccctcaatagacactgactaaagtcaagctggagtcatgagggtagtgggctaagtcgagggtccagcctcttctgccaggaagcccttcttgcttttgagagaggctgtgaccaccccccatccttctccctacactcccagccaacctagtgcccaagcagctaaacttggcttccttctaatcctggaaaaccctgtacccctcctcctcaatctggccctctccacatgcacaccctgaaaacacacacagacacacaacacacacacatacacacccctgaacacacacacagacacacatacacccatgatgtgagcaaacacacacacgtgcgccttcatagcccagccaagggcatgcaggcagggtgtgctgcctgagatggcacctccctttcagccattcttcaagaatgggccacacacagctagaagtcctctcccagctagaagtcctgtccccactctcctggcctgacaagatgagctctcctgggaccttgctctagggcactctgcctctaccctaggacactggaatgccctgggagccccctccctgcaaccagcctgagttcagccccacggacaaagggacacacagcccccaatggagaccattgtaagtggtggggctgggagaggaggaacagaaggaaagccatagcgctctcttgccccttggcatgtaccccaaggcctgatggccactgggctcagcctgtcccccactcctgcctgcttcccggtgagctgccccccacacgtgcagcccgggctgcctccagggtctggctgagtgggatcaggtggccctccaactcagcacaggaaataagtagaaacatttcagcaggccacctcccctcatcttccccgccctgtccagcgccctggcaaaggctgacaactggctgtcttggggccgaacagcccctgccctgcctctgagggcccaccagcctgtgctgcatacccaccgcccagcttctccctgagggcccaccagcctgtgctgcatacccaccacccagcttctccctgagggcccaccagcctgtgctgtacaccccgttagtccctgatcccaaccttctccctcctgccagcacaccgatgcacacaccggaagtggcgagcccaagccctggggacaggtgtagggagaaaagcagccccaggcctcagactcgcttcccatcctggcatagagtgggggatggctggagggtgtctataggtacagcccgctctggctgctgccaggtgggcccctgccaggggtcctcacccctgtccaccctgtgcctggctgtccctgcacccagatacagcaacatggcctgtacccagcagagtggtggcaccaccatggttacagcggatgccccgagactctgcttggtaaacgtggcagagcagaatgggaggctggaccctgaggaagggcccctctcctggcatctgtctcttgctacctaagcctgtgcctctccctaaagagctgcctccctgctgccgagccctggtctggccacgagccactactgcctcccacaggcaccactgcctcccgctgctgcccacaggtggtgccgccaatgggcagtgccctcaggccgaagcctcaatcccccatctgagccaggcctaatcctctaatagtgatggttggtttgtcctcccataactgcaggtggattccacctggggaatgaggctgcgtgtcgggcgtctgctggccctgagacatccagtcttccacactcaactgtgggatgggagggtggcgtggccttaccccatgaggctgtccaggctctggcacacagctgtgctcacaaaatactgggtggcttggttagagctaattgtagtggagcctgcaggtgagggtgagggagggggctgcaggtcaggtaagatctggaagacagacgtacagcttggagggcagggggactctaaggcaaggagatttacagttgggaaggaggcagtggcagaggggtgagggacaggggcccttaagtccagcgaggaaagctcggtgtgggcccgctctacgctccgtttggggtgacctggaacgcctcttctcccagctccctccagccatcagcagcctcttgtcaagcttctgcctcgccccagtctatccccaaccccaaatcaagaccacctttcttcacggtcactatttattctttgttcctttttctttttgtaagaaacattcacaaaaaccagtgcaaaaccatcagtgtgggcgtcctgttttatattacaaaacttcctctggatatatcatataaaaggggggtctcacaggagagaaacgtgataaattagctctgcaatctacggcaaggaacatagtttttaaaatagactttcaacatatgacccatgggggaaggaggagggggcttctggggagacggcgggtgctggggcctcggctggtttgggaaatcctgtccgggccccttaagcatggatagagacatagacaagggaggctgtggacaggcctgagcaccaaggccagaaattaacagggaccctggggaggggccctcacccccagcccataaagagctattccctttctctaagaggcagtagcttcagagcaggaaagtggctttcgatacaggcagggtttgtgatgagcggtgtagtcttcttgttccttgccctgttagtggggtccgaggaagtctctgttatgggctgttgtatttcggggtgaaaagaaacaaagaggtatccctgcccacccctcccccacaaccccagccaccaccagaacctgctgtgggttgtatctggaccaagccagctaaaccctgtttctccctgtgctctggagggaggctcaagcctgatttgggctgagctttctttgccttgcctccaaggaatggcctcaggcagtcttgcaaatagctaccagcctgagcgaatgccaacaggagcagaaactgcctgtcttccctttccagcctaagagggtggccagtggctggctggcgagctgaatcagggctgattgagggttccttggcacatttgtagaaagctgctgaggggcagtcttgtgtctgcccttgaacccaccttagccagatttcccttcatgaccagccctttctcttgggtcctccctctgacttctgtgggccccagaagcctgggatgcccctggattagagccataaagctgtgcaatttgcctcagtcctgcccagcatgggttttttgttttttgtttttgtttttgtgtgtcatcctcagaccagccatttgcctcttccaaaaagctggggctaagcatgtgggtggttcaagaggggcagcccccaggccccaggctgggccgcggtaccagtggcaggtccccctgggtctcaggagcttagcttctacggagctcaggtgtcatttatggggttgccagagcaagctgttaaagggcgaatttggtaagactgagctcagagacctggtgggagggcaaggactggcgggcacagcaggaggagattagaggagggtccacctgaatctttgcagcaggcacagagcttctggctgcatctcagaagggggcagacgcacaggccagggaacacggggctctaggctgtggctccgagtgtccctggtgactggaaagcctgaggggaggctggaagctgatacaggatgccggtggcttgtgagacagaatgagctctttcttcctgaagagggacagaggggagagaagagagcagacatcacactgctccttccatccctgcccgtggcagacatcactaatcaaacttacggtgcctggcagacatcactcatcaggattgcactgccgtctcccactgagcccagaccaaacctcagatccccagcacagcctccagcagccacccctgatctatcagggtaggagcatcttgc

SEQ ID NO: 1218 - protein, 247 aa, Homo sapiens
AWFPRQPPFPPPRRPPWGRGSPARGRGRRAIGLCAEPRGGTSAGRQTRPSAEAGLEEKMAAKQPPPLMKKHSQTDLVSRLKTRKILGVGGEDDDGEVHRSKISQVLGNEIKFTIREPLGLRVWQFVSAVLFSGIAIMALAFPDQLYDAVFDGAQVTSKTPIRLYGGALLSISLIMWNALYTAEKVIIRWTLLTEACYFGVQFLVVTATLAETGLMSLGILLLLVSRLLFVVISIYYYYQVGRRPKKA

SEQ ID NO: 1219 - DNA, 69515 bp, Mus musculus
  misc_feature (1)...(69515): n = A,T,C or G
gtgtagtggtccagacctgtaattccaaaactctgtaggctgaagcaggagaccatgaagtcaagccaacctgggctatcaggtgagtctgttctgcaaaaccactaaaagaaatcaatgtagttgcaatatattttctgtgcaaagaacaatattctgctcaaaggactgtggcagcaaaaaaatttttgagagtcacgcctgcctaaataccacccatagtcaacaggtagaaagttccaaccaaccacaagatgacttgtctagccattctgcaatccggccattgtccatgtcactaaacaaatctgggatttgtctttctgtctataaatgggttttctccccagaggaacaatcatttcaagaaaaataagtcaagtagttatcagtatctggatgtgtttcaaatttaatctgttgactgctaccatcgcctagtaacccactgccccactcctctacttcacatctagtcttgaaacaaggtagtgtaagttaccagccatttttcagagacttttgcctatttgtatttttatgctccaaagtgagatttgcttcttattgtgtaattgtaccgtagtggctattcctggttgtcaacttgactatatttggaatgaactacaatccagaattggaaggctcaccagtgaccctaatctggaggctgggatatagaagtttctgacctggatcttggtatgaagatcttgaggcatagtggctatggattccagaagattaagacagggagatcactgagttcaaggtcatctgggattaaagatgtggtggtacacacctttaatctgggctacaccttctgctggagtccatataaagacattggaagaggggaatctcactctcactccttcccctgcttgctgtgtgggactgagtaactgctagatccttggacttccattcacagctactactgaaccattgttgggaattggactgcagactgcaagtcatcaataaattcctttactatatagacactatctataagttctgggactctagagaaccctgactaatacatgtacttatatgaggttgttgaaacaagtaagctcattggtgtggagtagaaatgtgttttccagggtaggacacagaaggaaatgaggaggaggtgttcattggccacagtgtcttagttatgaaagtgtctaagttctacatgtctgcggggcgtcactgtgtctgtgggttcactgttctctgtacttatcattttaagagggaagacttacaataaatgttcttcccacgacgacaacaaaagggaaattttttatgtaggagaaaatagcatggaattttatatgggagaagagatcaaaataacacaattgtggcctacctaaaatgcatatatcacacatggctatgtggaatactgccaaacacatttgagtgtaaatcaccacatttaagatggtgtgtcttttgaagtgctgggctgagagacatagctcaggcattaagaatacatactgatcttgcagaggaccagcacccacatcagtcagcaggtcacaactgcccttaactccaggggatctgatgcattcttctggcttcttctggcctctttgggcacttaaactctcatgcacataacttcacacacgcatacaattaaaaaataaaaacaaatatcaaaatatatacactaaacatgtaaaaacagtttctcccaacatttctgtccttaatctaccataagataatatgaaagaaaacaggctttgtcttgtgtattggcagactaacaagcaatacagttattgttggctaataccacccccctttttttgaaaaggcaaatctgtgtgaaatccattgcaactttactcagtaatgcaatacaatttacgtttctattggtgcaaatgactgaaaatcagaatgtggctgtgatctcctgtgaatcatagaaattagaattttctaaaactaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaggtctaaccctgtgttctagctcagtatttgaatgtttaaataaatctatcaattaaatataagaagtctaaagtagaattgatgattaataatttttaagtatatgatggttgtcctgatttcatttctgttgccatgacaaaatgtcttgacaaaaagaatggtctcatttttttttaaattttaatttatgtgtgtgtgcatgtgacctcattcatgcgggtgagtttgggtatctttcccagtcatgctctaccttatattttgaggcagagcctcttacttagcctgaaaatagcctgttctactagactgagtgcagtgagcactccattactaattgggattactgttgtatattcccatgtggctagtgtaaatcaggatgtgttacaaaatcttaaaaaattaatgtcactcactttgttgtggctattaggaaaaaaaaactcttaaaactacttaatgtggttaatgctgtttctacgtaaatagaattgacttagatgttctacttaggttctcagaagtaaaattttgagggttttaaggaaaaatttcaggagttaaaaccatcagttgtctacactgaatcctttctgtgtttaggacaacacagatctcaagttaatgtagagaaaatgctgtcttatacatgcatcaggaatcttacagggttatgctatcccctaactagagaaaggcagcatggaggagtggagggctcataggatcatagtgcagaagagccagctccattgttcctagggccacttcaggcaggtgaggggacttgtaatctacctgttagactgtctataaaccagctgtgtgtgtgtgtgtgtgcgtgtgtgtgtgtgtgtaaatgagtcaatctgagacttgattttggtaagaggcctaaaccacagacagcctctgagctttttttccttctttctttcagcagcgagatgccatcaaatagaactaatgctctcaggtttctagaagagactccacaaatcacatcagtgtgataggttgtaggccagaaagttctctggagaaatgtcagactttataaaggcaatgccaactagtgggcctataaattctttccattaaaacagtaacacattacttctacctcaagcatataaaccatataaatcaagataatgatttttaattactgaagatgttaaaaattattcttcgtaataattcctcatgattgaagaaaactttgctcatagactgagctacttggcctgtgtaagctggaaagtacagttatgtaacacaagtcaaagtgagggccttatgtggacatgcatctcataaatgttaaaagaaaaattaaggaagcaaacaaggcagaatagacatctgggaaatggactcctatatgcttattgttctctgaagagtagtcaggtcagctccctattaggaaaaaggaaagtgtagaggtaggatcaggtcttcatccttggctagatggccagtttgggttactcggaaccctatactttgttacctcctttcaacctagctaggctggcctcagaccatccggccactgagacggagccacctgctgtgctgcttctcatccctctcctttgttgtgccactacctgcctgaggccgaacctgcccgaggccgaaccggttctccgagattttccggagttagcaaggaactgtgatcgaactgtgatcttcgctagttcctactaaaaggttgatctgactacttcaaaggaactttgggtgactgggaatgggcctcccctcttctttataaagcgtgttcccggacattaaagttgaaccttgatcagactatttgttttggttccattctttctctcgtcgcctagattccctcttttcttccagattccaagatgccttccaggctcgaacccggacatgtgagccactggccggcctcaacaatacttaaaagccaaaatcagacattttaaatacagaggcttcattggtctgatactcacacggaaagactgttaaggctggtaacaaaggcagggacatagtcatttccaaataggaatagagccaaaggctccttgactctcaggtaacttaactatgcagccttaacagtctcctgagatgtgtccagactctgtcacttctatcaactattcctatcatttgtattactttcttggacagacttaaaagactgctgtcttccatttcctgccaaagcccttgtactagagctacttaggaagacaggcacgttcaagccccagatctgttcagttattgtaatttctgagattgccatgaaatccaattcattagctttcaagagacaatccaatattgttctgataaaaatcatatatatgacatttacacacatttaacaaaatctgatatatgtgggtgtgtcttgcctgcaggtttgccatcacaatgcttatggagacctgaacagggcttgaatcctctggagctgtagttacagatggttgggagtttccctttgggtgctggaaaatgagtatgagtcctctagaagagcagtcattgctgcttatctctttagctccatattcatttgattaaacaactattatctaatctaaagtagatgagttacatgggctggcccaaaaccaaaatgacttagtcatttaaaaaatgatagacaattaaaaatattgacaagaacaactgtttttgtgtgttactttttttttttcttgctgtgaacaaacactttaaacaaacgcctttaggaaaaacgtatcatatggcttaagagacagtcatcatggtggggaaggaacagcatatgtgaggtagctggttcactacctagtgaggaaacagagacaaacactggttcttggcttgttttctctttatttaatctgggacttgagcccaggtgatggtgccaaccacatctggatatgcatcctttcttcagttaaactttttgagaaactcccttccagacatattaaaggtgtatttactaggtaattcaaagttgacaatgagccctcagtgtccttttcctaggtttcaagttctcatgttcagaagacccctcaggaatatacaggggttgagagtccatcaaaaactatgttgcaggcaccaagaagataaaagttaatgtaatttgaacaaatgtgccatagatctggtgaagttatatgcaagttgccttctgccctgtcaaaacttgtattctatttatatttacactctgtgttactatccatactatgagggtttttttttttgttttgatttgtttttttcatttgtttgtttggttgcttgtttttgttttttctgttttaagaaagcctgagccacatgatattctggtcccatatgacaatcattcctcactgttagaattccttgtcctttttcctttgtcatggcttgtagaaaatgagggccgtggggatagtgctggacatttcctggaacttatgagtaatgcctaatccagcaagagagaaaggtgaacacttcagagggcagttttaatcttttggaccaagaaacagttttgtgcatgtctaaatggagacactgtctggccataacagtaagggtcacatgggttgaccagggtgaggtaggactgtccacagggttatgaatgtggtgggggaggcagtgtaaaacattcaaggattaaacatctcccaactgcttttctcagaatggcctacatcttcaaaaacaaaacatctaaacattccactactttttttaaacttacaaagatgttaagacacgaattttttagtgtttcttgtttagaattaaagaaactggagatgcagagaagacagctaaactgcaccagtatgttaaagatgaaaatttggagttagcttataaaaatacaagtcaatgtgctaaactgaacaaagacccagggtacgggatatttaaaaatacttttctcttggatcagcaccaaaaaatatccttagtttctgtattacctgtgtcctgcaaaattatttctgataaaaaccacacactgcagaaatctccacagatgtacccaaatacctctcaaatacatgtgacatcaaggtcgggcagcttacttggaagaaagctgtgatgcgcacaacagaacttctgtagtgagacatcttttctctgtacatgggaatattttacatctcacacatgggaggcactggtactttgaaacttaaaattactagagtcattaagacggaggtgaagagtttgtacagccttccgcaatttcaaagaggtagtgatagatgcttgtcctcctggcgatatcagaagcagtttcttgtgagttgttcttcagctctggtttgatgtaacgattcatcaggaggagttccagagtgtctctgctgtctctgttcccagcagcaaggtgcaaaggggtcaaaaggcctttcgtttgggcgttgatgtctgcatcatgctgaagtaagaaagaggccaccttggtattattccacttacaagcactatgcagtggtgtccagccatccacagtcactgcatgaacatctgcccccttagccaccagctcacgaacaacatctatatgcccactgtaggctgctcggtgaagaggggtatactcatcttcatccctagtgttcacttcagcggccttctcagagagtagtctctgcactgtagcaagctattggaaaaaagagaactttaaacgttcaacttgaaaaagacaatgaacaaagataattacaccatccagtggctttagactttaagattcccttttaggggaggagggtaactgattaatagtgagcaagttaaagctcattacactcaggagcaacgcgggaatctgattctctgattatcaccctaagctatcacattatcctactctaataaatgcctactgtcccatacctgggccctagatgaacaaagggcttatctatatagtttatatgtcatctctaaagcaagcctaattttcctgtatcagattgtatcaatagacatggtatatgaaccagaaaataaaaaatgaaactacttttaacagcagaataaagcgatgttgaagccagctagagactaaggagcacatcttcttctcatgttgctgtgcaccatgtctgggctggtctatggaccagacagaggacactgtgctctgggattgaaaagctatcatacactgcaaaacacttctggttttgacttactaacatggatatgggagaacttagtaaagttaagtacaaatggtcaagtgggaagaactgagtctgagagtgttttggatgacatttgcctcctcgcaagactgtggggagtaaacaagtgcagtaagacacttggtggagttgcagctaagttagtctccatcttacttgttctcagtaatgctgacgtgtagaaggatcctagtaatttaattagaggactgtttataattacccccaaacatctagagccagcttataacataatgtgcactttcatatacactacttcatgtggcactcctataaatgagaaaaatattaagctaccatttttaaagacaagaaattaaagggtcaaaaatgttggaatgtgccaaaaggtaaagataagatgtttaggagtaggtctttgggctccaaaccaaatgcttttccaactatgtaatggtttcttttttttacccgatttttttcagcagcccaaagaagcaatttgcttggatctttttccatctttttttcttgcaattggtaccactcttcgtttttttcctcttgctcttcatcttcatcagaattgcctacccagagactctgagtaccagtgggaatcaggtgtccatgagttttcaacaattcaagctggttaaactgttcagaaaagtccacagagttttccaggtctggtttttcatcatcctttttttctttttccatttttactactcttttaaataaaaagcatttcaagtactagggcgcaatctttaaggagatgaattatgtctgcattgtttgattctttctaacctgaaaacacaaacacaacagttgttagcacagcagtaactagatattattaacagcacggatacaaccttacaaacaagccagataaattctatgtcataaggctttggtgttttctcatatccattaagtttactaaatataagatttcagagatttctgctatctatgatcatttatagtctttaccttttagaaatgctttcttctactaagtaaatggctacaactatcttaattttaatctattaatttaggtatgttaaaactgatggagtcctgacagtgagtacacaggaggaccatagttcacccagtcctaaaagattagtcttctgataaactgccatattaatttatacactgacatcaacttcaagagttacctagcacataagccttaaagaaaatgagaagttactttgaaaaccatcaatcttttaaccatatttgttgaatttggcagttttttgttgctattgttagtgttaccacttctttctgttgacccaattagaatctaatgtttattatttcaggtgctatgtcttatattgttttgctattaagcttttaaggataggccatctttaacacagattattatgccatttgtatgtaacctgcattaagaactatttgtatcattaaacttaagacctatcatttaatcttgctctgaatggcctctaagaggaacttagttatacacactcctcatagatttgttctacttaatttcaagtttaatattccattgtccaattaagcttcatcactagtgacaagagtatcagaatcatgaccaatgacttcttagggcctataaactccattaagggatttgttaaggttttggcagcattgtgtttttcttttttcttttttaaaagaactatcagaactattttcttaacattttcaatatttcctttcacttcaaactcattttttaaaaagctactatacaccaattcattaagcgcttaacagatgtcactaaccaaaatatggcacagatcgcagccccccttcccacacctgaaaactccttcatattaattcttaacttattgtcttggtatgcttaattaaaaaatcaaacccaaatgtatctcgactctgggtataaagctcgatgcatactattatggaggaataggatgcatttcctaatttaaagggaaccctccattttgagagagatagcaactgttccagttctcatctcattgggtggagccccccatttcagaggcctgcgctcgggtactgacagatcactgtcgctgcggtacacgggcccttctgaggtcctgagggggtctgctctaactcaaggctccaaatcatttctactgcactttcttcaaggttctctgaaaacacaaaaccgaggcttctggggcgatcgtcaggggaagcagggaagaaaggtctttggtctagcaggcgaggccttccgaatcgcaaagcgaagactctgccacgatgctacctgcgaggtggccggccgcccacagccgcccgccccaccgctccggacacgcgcctcacctttcacagagagaacctcaccgagaacttcctttccgggttcgccccttcgctgctcaggattggctcctgtgaggtgacggagccattctgtagccaatgagaatctagacattctgtgatgtcacgtcatcaatggatctcgcgagaagtacggatgccgctctcccgcgcctaattcaggtttctgggagcggttttcttgtggttctggagactcccgcccccttttcctgaggtagagatggcttgtggcctccctggtcgactctgacaagtccatgttgggtaacttaggctttgctacggtcttgtagcgtgcgggtccggggcgaacggaagccccgagtgcgtggggccgttagggaagacgggccgggtgggcatggagggatgcgggctctgcgttccgcctcggagtccgcctcggagtcccgcgggtgggaggtctcctgtagtggcagcgccgccttcgccgagctggggatgcgaggtgttccacttagaccatgtgttggttatttattctgtctttaaatgtgggctgccccataaaacccatgttagtgttaagagtatggggtggcctctgattcaaagtcctgcgcggagcagcttaaattatgcacgtagaaagttacgtttcatttttcctgtccaggggtttactacacaccaatctcatgaagaagatagtagagaaatagtagtgatagtgcaattaggacttcacttcaggatgtggctttctgttcttaggtcatgaaacaattatagtaagtgttgaagacgtacataggactttctcaaaatcactagcgcttgttcaaaaagtctaccctgcaactgagctcatgttagtgaaatatgtgcaacctttataatatgtgcattttggtatttatttttagagtttggattcgagtggtttttctgacatacctgaacacttggagaggaacctggtacagaggaactctactataaaaatgagccccacagatccactgtaagcctgacatattaattgtgatgaccttacgagaaaagtgatattttaatataaacagcaacagaatttaataatggatagagtatcccccaaaacgtctgtcatgcataattaaaagcacatacttatgcttattagcaataaataaataaataatgaggtggagcaatagatgaatgtgttgcagtaattacatggccatgcagggaggctcatgctctctggctttgtcttagtctcgagtctataaatagtcctttagagtaagttaccctagttgaagtgaatttgaacaaaatggaaagaaataaaaggactatagaagtcaggtggcagaagaaaatccttgaacacgagtggtgtcttccactctggtttcaagttcttggtcaaaattagctgtttaatgttaggaagatcagcagttctctggcttgcctggttttattttcatttgcataactagactaataatactcctttccagttaattttgaggtctgaatgagagtggaagggtacagctgtgggagctgagaagtttgtgggttacccagggcttcgtgcatacaattgtggatgtttctgatctgtggagttatatacaaaagtgaactaactatacgagtgaaaatagcctaacttttactgccttagtcttgtttctgcaactggttgtgtgatgaacgagttactatctctgtgtctggccttattttttagagatagtgaccatgcttgcctctttctctgcagggactgagatataaagaactaaacttaatgctaagtataaatgggtgttaataattcttaagctgctgatttacctgaaagtacctttgtttgggtttaaagaattctgttctgttatttggccacatttattgttgaaaactatgtaaacagcagagtcaggcagacgccatcagggattggaatgtaagcaactagtatattagtataaaatctattcttacactcagaggaagactattaaataactttcctggaaaagtgtacagtcagatacttaacaagagagcaaacaaagccttttggatttttgtggagctatctagggaacagacctgactacataaagctggttatatgaagcttataaatttcagagcagacggaacacttccagtgtcactcacagtggctctgtgttgaacttgtgattagaaagctgtgatgctaacgatctgttgagtactgcagactttcatgctgaggctataaacaggattttgcgttacagttttgttattgcttatcttctgcttgtttgaatatctttttaatggattgcattgaattgtgttctcttctttatacagtgacgatgaagacacatttaaaatcctggttgccactgatattcatcttggatttatggagaaagatgcagttagaggaaatgatacatttgtgacatttgatgaaatcttaagacttgccctggaaaatgaagtgagtttggggtatatttgtgcatgctctaatgtacttccttggtaacaggctcttttccattaagttagagttaattatataacctcatgcattcggcatttcttggctaaataccaatatactaaaagcctggttaaaattttgagttctttgtgttcacaattggagcagaaactgttgtgacaagtaactttcaaaattagaaacacagggtgtttaatgatgtacaaacctgttacaacttctacctgaaataaaaagatggcagttagttttcaaagaacatatatccagaatgtgagacagcagttcccaagcagtcaagtacaaggtcatttgtggtaagcccgcacaatttcctgggactttggaggtagaggagattggtgtttatatgaaaccagtcaaggaggtgacatttaacacgtgtgttgaaagagaagcagcctttactgataggtggcacagagaatgtatggtcagtgtgaagcagaattgaaggcacagggataagacaacactcgaggatggtagggactggtttggcttgcccgtgggccatttgtgtgctcaaagagggctgagaatgtagcactgttggtagactgcttgcgtgccaggtacaaggccctgggattgctccatagcagtacatgacacttgagtgcagtggtacacctgtaatcccaacaccaaggaggtagaagctgggcgtttaaggtcatcctcaattgccatactgacttccaggctagcttgaactacattaaaaaaaaaaaaaaaaaaaaaaagccagagggctagcactgaaagttttggtgtgtagagctgcagtcattagactcagtctgtgctcagtgcagaagaaagtctagcagcctggtactgtagcaggagttggagactattttaatgcttttaaaatctgcagttctgggtgtggaaaagaatgaatatgagaggtgtaacaagtagaaagtgtacgtgtgttaatttttaggatttgaacgaaagtcagatgtgttgagcctgggtacctgatggtggcattggtttaaaacatctaactgaaggagaatctgtccgggaaggtgttgaactctaacttaactagaatagagttggagattgcactggggactgtcccagcaggtgggtgagtgtctgcagagcccaggagagagcaggagaatagacatagacgccctgccttcccagcagtttcccttcagtttatgtgcgagacccctagtgccctctgcatctctagccctcactgtcttgctcaggctcataccagtacccatagagcctctgcttcacttgtcctgcagtctagtggctccctgttggcctttctgcttcatactttgccttctgtgtattcagcgtcacagccaaagccaactgttgacactgaacagctgtgtagttacctttttgaagagctattttcccctgtacctataagcactctgtgacattacactgcttttcttcagatcctgtcatcatgctcagactctcctcagcagccttcctttgaatctagattcaaatgcatatacaaggctataccttgcccttgatcctgcctgggctctggatcctttacaatattacccgtttccttccagggctcaggatcatttgttgccctgcctggtccctggtgggttcttgtctgggaccttgcaggtcaacctttctgatttaccacctgactttgggcagggtgacttctcgtttcagtttattttttaaggggtgggatcgggggttattgaggtgattccgtatctcatgctgtcttcaaacttatatgtgactaaagacaaccttgaaattctgatcctctgcctcttaaatactgggttataagcacctgtcaccgtgcacagccaagtttacctttttgaagagattttttcccccctcatacctctaagcactcagtgacattacactgcttttcttctcccgacctcatattaaattggtatataatttgtttttttagtgattatctgtgttcccctgtggatagtaaaatctgttgtttagacatgtattcttgtgtgatgcctaagaaaacttagttctgtatcaagaacccactaatagctgatgatctttgccctaaaactcccactggcttctagtagcctgcattctccccagagtgatgttgctgctatgagatagaatgaaagagtgggtgctggctgttggtggcacaaacctgacgttccagctaactgctggctctgcctgcctactgtaaagcacttacctctgtggggaggggacaaagcactgttctctgtgtgtcatgggagtgagagacagctacaaggagtaaagcaggtttcccacacagccgcagattccactgaagcaagatgattgtaatggccacctttaaatatccttcttctagccctctaaggcttgacatgttctcagtttcattctaaggttgttatccttctggaagcaataagaaattaatttcattttaatctaaatgaagctcaagtctttggtctttcccagtggattcaaactgtaacttgcaccttgaaaaggatataggaagctgtaggaagcttagaaattgattgagtatgctggctttatattctgtcaagctcgattctttctcttaggggagtaaaatttaaagtcaaaggaggcctgttttctttccacagaaccctgagtgtgatcttttgtaactctttgggtttgggaacacctccctctgagcctggctgttactatttttgtctatttctaccctttgtttcctaattcccttctctgcacacctcacactggattggatcttccaagtgcatattatatttgccctttagcatttttatttactctactgtttttggaatctaaattctaatttttaagttctcttgtatgtagactcttgccatccagctattcttactttattactttgttgcttgattctttccctgcctgagacagggtttttctatgtagccatggctgttctggatctcactctatagactaggctggccttgtctacagtcttcctgtgtacattgcatattggtatgtgagttcatctgaacatgtgaggccagaggtttgtgttggctatcttcttcaatttctttctgccctacttttgtgagagtctctcattgaacctggaaagttatttactaaagttcccttgactagtacagcaatcgagatctatgtttcagtgtcttctgataattaaaaacgaatcatctttgctctgtttcctctatctccattcctttgtgctgtgattgagccaagggcctaccatagggggtcatacatttcaggtcaaaccacgggttaccctttcccctctttaaagttgaatagtatcctcacttcactgtgttgctaaggctggtgttaaagtagaaggtttagtgaccacatgaggctgggcaaccctttttctatcatgtctagattttaaacaatttttgccttaaacttactaattttagtactgttttctgttgattaggtggattttattttgttaggtggtgatcttttccatgaaaacaagccctcgaggaaaaccctgcacagctgcttggagctgcttaggaagtactgtatgggtgaccgccctgtgcagtttgaggtcatcagtgatcagtcagtcaactttggttttagtaagtaagtacatttacatttgagagatggtttttttgggtgtgatgtctttgttgctgctggcaaaattcccttacaaagcaactttaaaagaaaagggtttatttagcttataatcccacattacagtccatcattttaggaaagccaacataggaactttaggcagctagttttatccacaatcaagagcagagcgattgaaaacatacatgtttactgttctgctagctttctttctttctctctctctctctctctctttctttttttttttttttttgtttttgttttcgagacagggtttctctgtgtaaccctagctgttctggaactcactctgtagaccaggctgaccttgaactcagaaatccacctgcctctgcctcccaagtgctgggattaaaggcatgtgccaccactgcctggctcagctagttttttgtagtctcatacagtccaaaactaaaacttagggaatggtgttccttacagtaggctgtggcttcccctatcagttactgtaaacaagaccatttcccacagacatgcttaggcctgtaggcagtccttcactgagactcttcccaggtgattagattatgtcatatgataaaaccaacatgtcatctactagttcttttgccttcattctgggcagttttgcagtagtgcatttctttgaattttctgtatatcatttcattaatttgtatttctgaactaatgttgggattgggtttatttctagatctttcattcttttttgtatcttctggtttgttgttgttgttgttttctattttaaacttggcatctttatgttttttgacatgaattgtgcaagttacctgtatattctagttactgagccattttgtaggcaggtatattttctctaatcagttgcctttagccgtatttatggtttgtggttgttgccagatgtagttttgatgagtcaaatacaggattctttctgtctaggatcattgctcttggtcttagaatatatgtaagattttttttttaaagtaaatcttcaatgttggggatgaacctagggccttgtgcatattaagcatctattttcccactgcctttgttttctttgtaaacatgtaaggacaccatgttgcttttgagtgaaatgtgttcttagtcttatgtgctgtcattatgtttctgtttcttgtctttgatgactctggtactggtcagcatttgtagtcatcttgaccttggtattaggctaagatggcttcaggtttctccagtgcaaagctggttttctgtccattgttcttggttagaggtgagtccctaagtccagcctacactcaatgggagaggattaaagtccacctctggttggggtggaggtgaaagcctttaaccccagcactcaggaggcagaggcagtcggatctgtgtgagttcaagttcagcctagtttatagagagggttccaggatagctagggctgttaacacagagaaaccctgtctcaaacaaacaaacaaacaaacaacaacaaaaaaataaaatccatgcacccctgctggagggaggaagatcaaagtttccatggctatctgttaaacttcctgtcaccttgtacctccctaaccccgtctcatttcacagcatctttctctattattcctgttggcctcggactcagtctctctttcctcagtgcctttgcgagctatgattatacgtgtgcactcccatgcctgcctatgttttctctgaagtagctttctttaggcatatgtgagtgatgtggtcttgatctttttagtgctgttgaatctgttgtcagtttaactgctgggaagcctggtgcttaggaacattggctacatggatgcctggatgtggttatgcctgacatctcatcctcttagaggccagtgtgggcatgcaccaagttcaaggtctgtggcttacgtagtgagagcctgtctccccaacttccaaaagagcatggattctggatggtgtcagttcaaatcctggctctgtcatttaatagtcacgtgactaagtcgttcacttactcattgtctctcagttccattgtttttaaagggacagaattatgcaggtacatgataatggagatttgagttagcaggaaaactcctaagatattttgacctgaagaaattgtgtaggggactgaggcactcctaaatgctcttcagcctttaactataggttgggctctgcttccctgcttaggtttcagcatacacttggcttttcatttgcttatatagtggtgctggggttgatccaagccctcgcatgccaggctcactgactgctgagctgtgtccccaggctttcatcctgcattttaatccaaggattgtttctcagcaatttcaggagttcgttttgtttttgtttttgttttgttttgtttttgagacagggtctccctatgtacttttggctgacctggatctcactgtgtagaccaggctggacctgaaccctatacctgacttaatgtcaggaaattctttattacctttttaaaagaatagctttcccttgctttttctgaacgtttttaacttttaatatttttgtaaatttaaattattttatttattttcattctagtcattgtcccccttcagtgccccctcccacagttcctcatcccattccttctccccgttgcctccaagaaggtgttttcgctcccactaggcctcccccttagctggggcctcaaggctctcaaggattaagtgcatcatctcccactgaggccagaccaagtagacctctgctatatttgtgccagtggcctctgactggcccatatatgctcctggttggtggcttactctctgggagctccctggggtctgggttaattgagactgctggtcttcctatggggttgctctcgatttcagcttcttcaatccttgtaattcaactatagaggtccctgacttcagtccaatggttgggtgtaagtgtctgcttctgtctccgtcagctgctggtagggcctctctaaggacagccatgccaggctgcccatctgtaagcacatcatagcatcagtaatagtgttaggtcttggtgtcccccccgtgagatggaacccaagttgggccagtcattggacctcctttccataagtctcttctccatttttgcccctgaagttcttttagacagggagatttctgggtcaggaattttgactgtgggttagtagccctgtccctctacttgagaccctgtctatctactggaggtggactcttccagttccctttccccagtgttgggcattttggctaaggtcctcttttaagacataaaagactaggaactctctttttttatatgaacactaacttcactttcatctctgcattgtattctggttaatttccccttctggtttccttaggtcgtacaggaaaaatggacaaacacagaagggaaattctgaaagaagactgaattagcaaagatcaagtagcctgatcagattataagtaatttaaaatgtggctcatgaattgtcagagaggtagaagagactaggaacttcaaaaagcctcacatcacaggccattagtttttggtggggggtggggggtgggaatagctattattcattgagagttctctaagaaattgattaaatattaaagaaagtctctgtataggggctttgtaaaaacatccatctctttccttgcggtagagtgtacttttacaaaggttttcaatcttagaggtctatcaacttcccagttaccagctagccacaagtcatacaaactgtttttggtttggttttgaatttatttgagatgccatctacaaaacccaggagctagaaaaaaagaatgatatatttgtccttttaaaaataaatatatttatggcaaaggaatcctggaacaaccttaaaagtcatagttcactaaggaagagcacatgcagcccagcacacatcaaggctggattcccagtgactgcttccttaagttgatttaaaaatccactagtttttaaagcataggtgaagagcatacgtagtgtacagaaatgacaatagcactaatgtctaccaagagcagctgcctcctttgtaaggtgaatcgagactgaagtgttcttctcatagacactggtataggcagacacatctcagtgcacattagttacctaagactctcaggtgtttgtgccagtctccatgccaactggtgagtttcttggaacatggcatgggcattggtatttctcaaaagacaccctaccacctcacccccccaccccccaccccgcactaattagagtttagtgagaattcagacccactggtgtttcaagggttgatggaaaccctgctgctgaggttgggagaatgatacatccttacttggaaggctatgggagggacctacctaaactctggacaggacatttacactagaactcatgcaacatacaaaaagctctctgtggaaagatttcaaaatagattaagcaggggcagaaagccatagtgttctaacgtatgtaggaagggaaaaaatgtgctttttaatacatacatagatagaaatcgctcaccccactgtcacagagacgaggaacctggtgtctagggaaggatgggcagggcctgaactgtgtatggagcgacaatggagctggtgatgggttatgaaacttggtggttggattccaacctgcacatatcctttttcccccgccccaaactataaggagaagccttatacaaaaggttgaaaatttgagaagcatattaacttgtcagttattagttgtctctgttttatacaattcatgtactttaagattttttcaagctttttaatttaactgagtttatttccagcactgagctggggttgtctgcagatatatgtttgtagctacctagtgcagtacctcttggaaggaaagttttgaggaaatagcttttatcccttacagaaactttcactgttttcttttaaggtttccatgggtgaactaccaggatggcaatctcaacatttccattccagtatttagtatccacggcaaccatgatgatcccacgggggtaattacaattctgttggaatcttaaaaatgacattgaatgctatcagtacaatgcatctaccttttttctagtaattagcagtcaaattgagttatgaattcaaattaatttcttttcatttatgattttatatttctttgttggtttgtttgttttttaatatggaataagaattgttacatgagagagccatgcacttttttttttttttgcagtactgaaggaagagaggaggtctgacacatgccaggcgacagctactggtttccctttttattttgagacaagatctcattaagtcgcccaggctggccttgagcttgtgattctgcttcggcctttaaggacctgcaattacagcccctgatacagggcttgctggagccttgctttttggaatttgctaacagtgagttgctaggagtggagtgactgcccacatagtgcctcttagcttacttgagctcctggattctcactgtaaaaagtgacctttttttttttagtattttaaatctagattcaattattttattccctgtttgatatggaagcaagactggcagtcctaatagaaagtatgtttgtgtcttctcctgacatgtaggtcattagtctagtttatggtcatataccccccaaaacaccaacaaacaaacaaacaaaccatcttataagacaccactttatattacaatgtcttgtttcacagctgattttttatattttttagtggccagggtgtcatgttagtgatgaggtgctagctttgcacctgctgtgtgctttcggctgctgtaggtgatgtgtagttagaagaaggtagtgtcttcatcactggatttagttttgggaagacactgtcataatctgtttttgtaattacaagttgaatgtcctttatccaaaattattaagccaaaagcgctgcaaaatcttaaagttagactcagaagtttttggttttagatcctgtttggttttgggttttcaccttgggattctcacctgttaaggtctgcacaggtgttctaaagtcaaggaaacccaagttctgaaaacacaacattctgtgagtaagacacacttgtgtacagggtgtgcttttgatgtgggtgtgctgctcacccagaccactcatttctgcagacacactcatgctctttgaaactttgacacaggcagatgccctctgtgccctggatgttttaagctgtgctgggtttgtgaatcactttggacggtcaatgtcggtggagaaggttgacattagtccggttctgctgcagaaaggaagcacaaaactcgctctgtacggcttaggtaggtgattgacttcggtcagatgtgatccctttgtccacgccagtggagaattgtgtgtgtggttggcaaatacagtgttagagatagtttggacccatagggcttccaaagggggggaaattggacaaatttgattatttcttattgatttctataaaagatggtggagttttctggtaaaaatgttcttagtatttctaaggactgatagctcttcaaacctaatggcagttttagtagaaaataaaacacgcaaacaaaaactttgcactgttttggaccttttatttagagtcacatttacaaagctggatggatgataagtgcagactaggtagcggaactgcattttgtgtcacagaagtccgtgagaggtcagagcatactattcagtatggtaacactggcctttgtagtggggagagtgaaatctggctgttgtgagttgtgacacactagatatcagagacagacgaagacctgttattaacaggttatatatgttaaagttaattttgtaacttaccagttttaatgtgaccagaagaaaattgtttatgtagctgttgcattagtggctcacattatgtccctgttctacaactgacatcttactgttaaagcagattcggaaatgtgctttatcccgggtgtgctactatgtgcttgtaatctctgcactgtggaggtgaagaggggagagtccttgcggttcactgggcagcaatgtagtggagtcaggaaactgtaggccaatgggagattcagtcttcaaaacaacatggctggcacctcagaaccatactcaagattgacctctcatctccctcatctccacctacacctcctgcttccctgcaccacactgtgttcttttcaccgttttctgtttgtttagtttgtttgtcttttggtttctttgagacggtctcactatgtagctctagttgtcctagaactcactatgtaaaaaccaggctggcctcaaacccaccgtcctctgcctcctgagtgggattaaagaaagcttttttttttttttttttttgctagaccttattgtacatgaatgaaaaactaagtattatttttaaagaacacatttttaaaattctgtgtattttgtatctcaggtatttttgaggctagaaataatgtgtacagcccattcattttgtctgaatctgagataggagacagactttaaaaagccattggcagtttcagtgtctgcaatatttgctatgtctccagaaaaatggcttgctctctttcttatcaactgtgtcttggctgttacctgggacacccacccctcttcggtgacctttttgtctcccagattatcccatcttgttctgttctggtgtccttaactggtgtcggctccagcctaaacccaaagcaagttctccacactctcagannnnnnnnnnnnnnnnnnnncgcctactgtccctgtgtccctcacagtgctcacgcctgtgggtgttggggcagaagtggggtcgctgtttccctcacatccataatctgcttctctacatacgctgctttagggaagccgttgccattgcggcatgcccttccctcagcctctgccttcagttgtgccaaccttccagtgctttagcatgtaggcttccccaccagcactctgggcccatgtgctgggcagggcctgtcccagctccacctcacagttcccatagtacatccagacatctctatccatccagtcattggcttctcttctgtggtcagcatgtgaagtggcaaaccgtctccagctccaatttattattttgttacttgttttcttggtatcttctactagaccaaggcaagtctcttagtataaaaagaattatttaaaaccattaaattactaaaaagtgtaaacttggtatatgtaatagtattatactttaaaatacagtttaaaaatctcatcctttttaaacatccattatttctgtgcatgttattggtatatcatagttgaaaagcacatttacttcacattcatggtgagaggacgaggggtgatgttagacatctcatctctctcgtgggctgtaagcacagggagttcctttatttctcctttcacattatcctgattgctaaatggaaagcgtgttttgaattcaactgagtgctgttgtgaataaacctgggataatagatcccatttatacattgattccagaattcagatagatagctgaacaggaaaatatacttttgagaaatgtgttattgaggagtaaaaccctatttaccttctaaacccactgtaggaaaacagttttaaaatagtgtcgtgtccctccacaggctccattccagatgaaaggctctatcggatgtttgtgaataaaaaagtaacaatgttgagaccaaaggaagatgagaactcatggtttaacttatttgtgattcatcagaacaggtaaaaatactctgaatatttttaagtgaagcacctaggttcccaagacctatttgcgcaggcctttaagtaaaggcctgactccttcaccatcaccaggatgatggattcaagtggggctctccgttttgtgtgacttcaggctgaacctagttcacaagtattagtacttgtgaacgaacgtttgcctggaatgggtgagacatgaagataaatgtacagacattgatgcagcagcatggaatgtcaccatctcatctgtttctcttgtccctaagaaacgttagccattccatgtccttcactgtgactgtgttatccttataaggaacttactgtagtaggaatcgcccgtgtgtatgttatagacctcaaggctttactgttacattactgaatttcatccttcccagtgcttagacgtggtcctcacttactgatctgcagttgtatttttctcctgtcagtgaacatttatttccaattttttgatgaaatgatcacttcctccacctctctctctctctctctctctctctctctctctctctgtgtgtgtgtgtgtgtgtgtgtattatgtgaatgcattttcagaaacatagctggatgagctgtctttttctagtatgtaggtcatttattctcctggtagagtccatgatgactgaggaagagaaaccagagtaagcatgctgtctcctatgacccctacatgggaaggagtgaggcaaagtgctcagagtgattgcaggaagctgataggagagagagccagagctgggaagtcttggagaagacaccaagggatctgggcctgactgtgatgcgtttgagtgcaggcttaggctaagtgctaggtcagtgcaagtcttcaggaagcagacatatgagtctgagactgtctccagtgtgttttggtatgtatgacttccatgaacctctacaccactgctgaccactgacttccttttctgcctcgactgcatcacacagggaaaggtggaggggaaactcattattccaaaaggttgatctataatgaaaggtgggaagccctgctgcaagtggtgatgtgtgcatctcactgcagaagatggtggtgctcatgtctactcacagggtgagctgcttgctcctccaggcagctcccggtttctattttgaaattagtatttggggaagatgcttgaataccttgtttcccattgtacttttgtggactaacttgagcctgccgagtgtttatggccagcagtgagttagcactgtggtataagacttatactgtttgttggttctttccatattagtccttggctttccttgtaggaaagaccagaccttcctcattaattcacctctttatggttatatcattaaggccttgaggagatggaaaggagggagaggaagggaggagagagagtatttgtgtgtttatgtttctctgtttatttgttgagcatggccttagattcttgacctcacaagatgctgcagttcaggcttgtgttttcctgtccttgccttggagtcaaccacttctccaataagttctgattgcttctattggtagtacttagaactaacatatgtgagctctaggtgtgcttgttgatgctagatctcttatatatcagtgaacagagttaatgtatagtaacgcatgtaaatgtctcagctgcatgtgtgtgcacaaaaaacccacaacccataagttcctgctgattttaatttaatccagatctactgtgtgtgtgtgtgtgtgtgtgtgtgagagagagagagagagacagacagacagacagacccaggccctgagagagagagacagacagacagacagacccaggcccttacacatgctagtaggcagtgctctgacactgaccagcattcacagtcccatttgttactggtgtctattatatgcagtgcacagaagcgtttgatcctcctcgcctgcatctctgtgaggagcacactctcactagagtccagtgtctggatttcagttcctggccttccacatctggtcaggatgccagtctcaaggctgttctgctccattcctccctcccttttcaccactgtgtgtgtgattcttacagacagattaatttctctcccttctcattcttacacacatctgctgttatgacatctgtaggagttctggaaaacaggattgctcatttaggtgtgtgtccttcaacctttgcactttatttctgcttctttatgacgaccagcttggctcttgctgcagaaggagagagactgaagtggcgagagattattttgcagtcttgcagcaggctgccagcatccttatccctttgttccagaaaagattgtgtgctctgtgaaggcacagtggcattgtgttgcgtttgagtcatacacacaacataagaaacacatagccctgctgctcccctagctcattgtccaccttccctgagctctggagtttagcttcatatcttgctgtactgtgactcctcagagcttattctcaatgcagaattcccaggcttgcccttccctgcagggcactctgtcccctcatatggaccccctcctcaagaggcctactaattcagagcccagctttcagttgaagtcattgtgtttcagtgtgctgaaaactcttaatttaattggttatcttattcctatttataattaataaatgaaacatgttaaaggcactgcaaacatttagtagtttgatattttatcatgaagtttagatttaattcattttttcctcctttttggggtatgtaatcaggttcaatttagatttgaggtggacagagctcttgttttccctacttggtcacagtacagaactctgtataaactctgctgtctccttacagtgcagacccggaggcttcctgcttcccatcatgcctctggcttgattgtatcctgaaagtttgtaaggctgtgctttggaattcgatacaatcaccaacccttcgggagtgtctgacaggaatggagaaaaaagatttgtgtaagcttgagaaggaagttcccttgctgctctgaacttatgttctgctttaaatcttggtgtaggagtaagcatggaaacaccaacttcattccagagcagtttttggatgacttcatcgacctcgttatctggggccatgaacatgagtgtaaaattggcccaatcaaaaatgagcagcagctcttctatgtgtctcagcccggaagctcagtggtgacgtccctttcccctggagaagctgtgaagaagtgagtcctttaatattctaagtcagtttttcagaaacccttgctatgtctgagcatcccacactagtgctgttggctgcagaggacagcttgtttagattttattaaatttcatttattactgtgtgtgtatgtgtgtgtgtgagagagagagacacgtgtgtgagggtgtgcatgtgctgtggtgaggacagctttgtggaatcaagactctcctttcactttgcttgggttctggagtcaaacacaggtttgcatgcaagagctttacccactgagccatctcacccgccctgaggtcactttgtgtatgaaggttggttgttgtagttgctctgttttaaaggttggttggtttgttttctttcattttaattgcctcatttattcctaggcaaataacaaatgaaaaacaaacaaatgctgctttaagagaggagtacagatgcctgtagttcactttgaaatacatccaaaaaataaagtggaggataatagggaatggtgtgcaggtggctgaatagataatttcataaatacttctccatggcatccgggagtcgggtaaaatgggctcactactaaagttcttactttgctgtgcatccttttttttttttttttttttttttttttttcccacaataaaatgggaaaaaaggtttttctgtaaattccatgatcttgaatggtttctgtttagcttgtctggacatcgtcttgctcagttactaagggagagtagggttggaccagttcattgccaaggtgctttgtagctcctagattctcttgttccctctccctctctgacagggaacacaagggtgaccatcacagagagcagtcgtgtaagcctccatggtctcagtctactaacagggctgttgctacagccatttgtggtaagacttcccagtttagccttgtctcactggcaacactcctagagttgatgttcctgagtttgcttctttcagccttaagttttgtaacctcgaagggtcgctctcctagaatttccactcaggtgtgattagatttagatttggacagcttaaatggcagttggcaagatccttaggaggtgtcatgaccctaaaggtctgacttgactcacttctgttttggcagggtagtaaggccatggctatactgatgtgctcaagccttttgactgagagaatgtttggttgttggtgattttgctgccttttaggaaaattcaagactaatatttaaaaataaaattcagattagctactatgtagacatttacaaattttaacaaaatctatatataagcagattcccatagtaacttagttgagcattttctggttataaatgtactgttgtagcatatctaatttcttttgtgtccgtgttaggggatggcttttaagatggtctccatgtagcttaggctggccttgaactgatggttctctttcaaattgcccccacgtactaggatcaaagagtgtgctgccatgcctagctttcttttctatatatatatatatattttttttaattagatattttctttattttacatttcaaatgttatcccctttccgagtttcccctccgaaaatcccctatcctctgcctctccccctgctccccaacccacacactcccgcttcctggccttggcattcccctacacttgggcatagaaccttcacaggaccaagggcctctcctcccattgatggctgactaggccatcctctgctacacatgcagctagagccaagagtccctccatgtgatttctttgattggtggtttagtcccagggagctctggagttactggttagttcatattgttcatgcctagctttctaatgcagtctaagttgctgacattttgtgagctgggctttggtagaaagttttacgggcagctctgctcaggccctgatggttatggtaccaacagtacaaagagcatggcaacgagctgtgtgcttgcgtggctctctctgtctggcatggtctgcatagtctttattatactatagtcagggttgtccctttgtgaaactgtatttgttcagataggagagatagagggaatgatggaggagttcactttattcttaggaagaatgttattttttactattaaaaaattaaaattaaattggcagaaacatctatttttaacagtattgttttataagcaaatattttataagaactaagaaaagatggagccttttatttacaaacagggtcccaactagcctctaacttgtcatcctcctgcctcagtctcctgggtgttaggaatcacaggcatgtgcccccaagccttgttgatagctttgactatgcttgttcatcttcctgagggtgcccactagatgtctgagctcttgtcttctgtgcagacatgtaggcttgctgcgcattaaagggagaaagatgaacatgcagaagctgcctctccgcaccgtgcggcggttcttcatagaagacgtggttctggctaaccacccaaacctgttcaaccctgacaatcctaaggtgacccaggccatccagagcttctgtctggagaaggtaactgtttccaaaggcaacagtggagtctgctttgtttgaaaactcactgcccctcggttacagggctgagcagtgtagaaggaagctgtctgtttattgctcacgaagctgcactgctggtgctcaggacatgagatcatctttcatttctttctttcttttatttatttatttctgaagaaatttgttctttgacaatttcatacatgtatataatgtccccttctctcccttttcccttgactcccatatgaagtctttttcatatttgtgtcttcattttatgactcattgagtttaaaacagggccatctgtgtgcccctgggtttggaacctattggtgcctggtcttgtgcaagatccatgcaacctcgtgaatttatgactgtagtggttatgccatgcctggatgaggctccacagccattctctcccctggctcttccttctgccttggctttctcagtgtcctccgagcctgagaggggaacacatacttggacttgtagggctgagtgtccaactgcaaagccttttcttacatagaagaatgatggatatagagaagtcatcagttaactctcctagaaccttctattttttttttcaaagatttgacttattgtatgtacatgagtacactgtagctgccttcagacacaccaggaaagggcatcacatcccattagagatggttgggagccaccacgtgggtgctgggaattaaactcaggacctctggaagagcagttggttctctttaccactgagccatctctccagaacttttaaagagcacacacatccaatctcctcactttgatctgcgtttgataatggctcaccttccttgtgaaagcagatgctgactttggagatgagaagacactgtggttctaatttccattacacattcctcccaccctaaaaactactccaaatagaatcttagcctccttttctgttatagaccttgtagaccgctgccacccctcagcctgtgcagaggttctggctctcctgctgtagtcaagctgcacatttttatcatataggctgcagcttgatagccatgattgctggcattatttagtccacactctgccagctttgactttacctcttattctcatgtaaagtaggaagtgggggtgatggtggtgatcactgatgcctgcatactgactgcctgtcccaagatgcagcgcctgtgtatggaaaggttctacctcctgctttccatcttcctctgttacttcctcctctctcctcctccttattgtttctaggaattgaatccagggctttacagatgctatacaatttctctaccattgagtgccttagccttctaatccattctctcccccacaaactagaccttagattacacaactggccattgtcacaggtgaagaagcaacaggtggcttgcgtaactgaaaagctttagtgtgtgcatgttccaaggtgactgctgtcacagactcaagcttactagggctataggcctgtctctaccagctctgttttccttgttactcttcactatcagaaagatgtcagctgtggccaaggtacatattgtctttgcagctgaaaaaactgttaccccactagctccaaatatccctaaatagttttattggtgaccatttcctgagttcaggcaggtaggaaatccctgtgttgactttgtatgatgtatctacagcagccagcccaaggtttctcaggcttggcacagctggcattttgaccaggtaattctctgctgtgggagcagctggggttctgtgccttacaggatctgccactaactgccattagtcagggtatactattgctgtaatgggcactgcaaccaaaagcagcttagggaggaaagggttatttggcttgtatgtcctcaatcacaatctttttgggaagctaaaacaggaactcaagtcaggcaggagcagaggccagggaggaggcttgctttccatgacttgctaagtctgcttgcttgcttgcttgcttgctttctttctttctttctttctttctttctttctttctttctttctttctttctttctttctttcttttttttaaatggcttaagtaggcatgtatcaagccttttggaagagatttattggctgttagtgaattctgggcacctttttattgtcctggtagtctcctcatccctaagggttttgcatcgtctgagaagggtaagccatttttcacaggctccggtaggcacccacagtgttatcaaagagttgagtgttgggaaagtgtccagctttgtccaaaaggaagtagaagcaccggcctttgactttcagaggcagcatagcaggaacttcacctctgtgagccatgcaggaaatctggttcaagggaactgtgaaacaggtacccaagccaaagggggcataggtggtcaatgtcaactgctgccctcctgcaaggagcatgactgaccgcacagatcggagtgagtagagaacccaggaccactagcctagggtgacactaccctcagtgggctgggccatccctaccagtaactaagaaaatgtcctttagcccagatctgatgaatgcatttcctcatgtgaagttctctcctctcagatgactctagctgtgtcaagttgatgtaaaaactagccagcacatccctttctctacagtcacgatacaacagactgtgaaatgtttcaagggttgaaatcacctctgcttgagctctgctgcagttcctgtacctaaaatctggtcttctcttccctttccctttccctttccctttccctttccctttccctttccctttccctttccctttccctttccctttccctttccctttccctttccctttctctcttcctcttcctcttctctctctctctttctctctctctctcttttttaagacaggtttttggtttgaggccctgactagcctggaacttgagtgtgctgtgaacctcctgcctgtacctcccaagtgcctagattactggaatgccccacccttaggagagacataagaatccagacaggaagagtggttattggcaacagtgatttaagctgtgcgtaatttggtcatttctgatatctctttgatatggtccttaattatattgttatcttcatgcctgtgaggacaaggtttacttgttaagttttggttttttttgttttttttgtttttttgtattttaaacttattttggtttttgaaacagagtcttgctttgttgctaaattggcttggagctcactggggcctcaaatgctcagccttttttctgcccctggaatgtgggttccaggtgtgcaggtgccaccatgcccagcttcctacctttctgtttagcacttgtgctactgcctgccgcatgggtgccatgtgcatgctggctgactgggagttgactgagcagatctcctaaagctctcttccatccaggagtgcagtcactagcaccagtggctgtcgactgtaatacactcagagttcactttcttgattgtgctaaccacatttcaagtaccctatgtccacatgtgcttcaaggcagtagccccagatactacacaggtagatattatttctgaggaacaggcatggtgctgcattcctgtaatcccagtacttggcaggtggaggcaggcaaatcagggcagcattataaaatctcacacttggaaaagactagattggcaaacagctgcagccattgggaagatgtgttggaaataaaatctgccttcttggcccttagcttagctttctcaggaacagtgtaggataagtgcttttgtttgtggatctctgagattttataagcttgatctggtacatagtggaaacactcatcttgtttacttgagcttttccaaggtagacaatccaagatcctatagattcctgcagagtctacgtgactccactgaaaattggtttaaattaaggagggtaacccatgttgaaacttgagtaggaaattggaacagagtcaatattgtagactttcttgtgaaggagttatgattgagatggacaaattactcagaatgtttgtaaaataaactgttaagggacgaggttggtagggccacaagctttaaatgatgcagtcagcgagatggagaccagggtggctgaggatctgtctgtgcagaactttgcaggaatataaactatttcagccagtttgcacgaagtttaattctttggcatttttattctgagattgaagaaatgcttgacagtgctgagcgggaacgactggggaatcctcagcagccggggaagcctcttatccgactacgggtaagcgctgtgtgcattaaccaacccttgttaggctttataataatgcacacctaacatactttcctgaaaattagtaaggtaagtgcttagagcaatgggaagaggcaaaaatgggaagctggaagctgtgggcttggtctaatctcaggtgaactttattgattggtagtatattcatatttctgtcatttctaatctgtccttgctcagccctcttgctcccctgtgggcaccttggtcttgctgaagctgctgggaggaattgcatgtattcagtctctgtgagtctgtcccagcactccctgcggcctggtgctgtaggtggggcctgtggtgctcctgccatgctgattcactcctgctgtcctttctgtccacagtacaaatgcttgtatgtaacgtgtgcccattactattttggttactgtgagccgcactgtcctgtgagtcagcccatccttcccactctgacagaatacagggtggagtatcttcatttgtcccactgcttctccctctgcaccagccctgctgagtgtttatcttccgtgtcctaagacagatagagcctacagtcactgtcatcaagttctgatggagcaggtgaccggtaattttgagttcgcttcaggtttcgccactgaattccctcagttactctgagctatctccagctcctcctgtctcttagccatcttttcattctaagcctctggctttaacagcatttggtagtagtgagtcttgaattttttttttttttttttttttttttttttgtaagtcctgtgctcaggaagtatggccttaaagccagcagccttggcatccccagtgttaaaatgtggaattccaggtcccacattgaccctgttgccttctgacaagatcccaagagatttgtgtgcgcattaccgcttgagaagtcctgggatatacctgaggggctgagaatttgatagtgctcagtccaggaggttggtgctttactggtcagagtagtcacagtctcacactatacagaccaaaaactcggtgagtgcacagatcaggagagccactgtgtccccagtctgtggacaaagcctggaaatgctcgttgtaatgtaagagaaggaatagacggtggcagcaggataagctagctcagcagcaagggggaagggcaagtgagctcttactgcgagatgccacccacaacagttaaggcaatcaagacaaatggtttcagagggttaaagtctgctggtggatcagaggcagcaggagataggcaccgtggctggtatggaagccgagggctcacatttttagccataagcatgaaagagagtgcaggtcagcagtagatgatgctttttactctcaaagcctacctgtgagaaggccatgcgccctaagcctcagacgatgggggaacctcattcaaacgaccgtaagtagccattgctcagaacccacagacatgacatttttcactgtctggattttcctggcattgtctttgtccagtctgcagctgtctccctgggacccaggtgaataagctgagttacgtaaggagcatgttttgttaaggatttatccctctattttgaaagttgagaaactgacttaaaagatgcaccttgtttctggctgataccatgctgtgtgcctaggctatcgttccatcctgagatgccatttccttgttctgttgaacaggaagtctgtttatgtaaacatcacctgagtattattctgccaataggacaaatagtttaacatcatcacggttattacacacagaacataagtttggaaatgtaaaaatattgagcttttagactgacataaatattatacatgcagactatagaggccaaaaaaaaaaaaaatgtgtatttctcaaaaattggcacactgtttcctggtttaatagtttattctgtctttccaggtggactatagtggaggctttgaacctttcaacgttcttcgttttagccagaagtttgtggatcgagtcgctaacccaaaagatgtcatccactttttcaggcacagggaacaaaagggaaaaacaggtaaactggttattttagaaagttaaggaatttaactggcagtatttgtataaaccagtctttggtaagataaatacaaaatagacgattttagtatttgtaatgttagattaaaaaaaaaggtaagtgaatattttatcttctgaacatttagggtattttcttgtttacttgcttttagaggcagttttgctatgtagcccaatctggcctcacactggatcttgccttagtgtgctgagtgctgggactgcaggcatgtaccgatccacccagctacattctggttttttaaagttgtgacaattaatgtaggcttggggaaaggcgttgtctgcgagtgacagcgctcatggcttgagacacgtggttttcactatccgtgtttatttcctaccacagatgaacggtcagagtgcaagctctcaccttttgcagtattaagtattttaacttagtgtatacagtgctttagaaagacttcagacttttgaagtaaaaaatgttctgtagtttggtattttgatgattaatagttcatttccagttaaattttacagactcctagtgccctgttaactatgtttaagtcagcaactaaaataatgttttttcataagaagtatccattatgtttgttatagagtgcccttccctttatagctagtaagagaattttcagcagtggtagaaattaagaatgatgggattaggagagggggctcagtcgttagagcactgcctgctcttccagaggacccaggttcctttcccagcaatcacatggtggctcacaatgtctgtaactccagtttcaggagatctgatgctttcctctagcctctaggcactgcatatacatggtgcctagatacacattcaggcaaacattcatacacattagatgaaaataaaatagaatttaaaaaagtagaaagttaagaatgctatgaatttaacctgaagccatgattcagatactattgggaacaaaataaagggggcggccctggggaaaagtgggggaggaaaaatatgccacatccggccagagttcttgtactccggacaggtggatgcagggggactgccaggcgcttttccacttggccccaggtgagcatgcctgacccatgcggcagggggtgggggtggggtaggggtggggggtgggtggagaaaggggcagctcccgactggggattccccccccctcggagctaccttgctaaagccccagggttgcaggagagagggaataggggagaagtttccaacactgaccagagtgtgcagtgggccttgatggagcagagactctctgtggtttaagagctttattatagaaatgcagggagaaagagagaaggtagaaagggggtggggggaggctagagagaaagaggagaggagaggacaaagagaaaaggaagaagatagagaagtgagaggtcgtggtgggggctgagcaccacttgttatggtcttcactgttgctaggtaactggggaggagtttagcctgacggtcagaagcttgggccattgcttatgtgactagtgaccatgcttctcttgtgggggctgtggaaggtggtaccttaggcaggggccagagttccaggagcatgagggaacgcctaccacgtcatgtaggtgaattatgaccatcagggtcagacctcagctccactggagaccagcctgcaattccccacaagatactgaaggatagagatcagaaagccatgtgcaagagccttgttttggctgtgagttttaatcagttacttcttaactcggtttgagttttatctccagcagactttggttgggtaatacttttttatttagacttgagttgcttggtggaaatgatgtcacctatatgtgccttaactgaaagtttcttatttgggccactcttatactttaatatgtgtgtgccattgtataaatgagtatcagctccactgttaaaattcctcatttatgaaaccaaaattgtgttttaaatggctaacagtgtctggcagatgcagagcaggcattgcatttgtaaagttgtactaaaccctctgccttgggactcctaaaggtatcgtccacctggcaagacacactgagctagccggtggctctgccatccagtcatttcctaggcttgccctcatggaaaatggctttcctctggtttatcatctctattcttcgctctgtgttcagatgatggcctttgagggctgcatttggagtctgcctcctcagtgtgcctcgtcctctgtagcacctcacactgccattgtgtgctctctctcgtggtcaggagcctttccttttcacattctgttcatggcaccatattcaattagcccatgaaggtgtcagcagagcaaatgtggggcctgttgctgacctccttcccagtgggcattgttaactgcccggcacagggacttagccagaagtacattaatctaatttcctgttagtgttctcagagaatgctgacaggtgctcacagttgaaacttaatacagtctgtctgtaagaggcactgccaggctgggcagtggtggtacacacctttaatcccagcacttaggagtcagaggcaggcagatttctgagtttgaggccagcctggtctacagagtgagttccaggacagcgagggctacacagagaaaccctgtctcgaaaaaaacaaaaaacaaaaaacaaaacaaacaaacaaaaaaaaacagaaaggaaaaaggaaaaaaaaaaagagagagaggcaatgtcagtaaaactgtcttcctttattttgaactggggtgtgtggtgtgatgtcagcagcacttttcgatactgccctgattagttctgggacctggaagttctgcccaccacttttctattataagtgcagatggccacatagtggaacgctctgttattgtgagtgtgttttaactctcatacttcctgaaaggaaggctctggggacaatcttagcagtggcaagagccatggtcctttaagatgaggaaaactaatgtggactgtgtggaaaaagaagcaaatctaaaataaccccagggccattagcaaatacagctttcttttttccttaaaattcatgaggaaccactgaggagttggtgagagtttgactattttaatgtgttatagaagctgctggtttttttctggtctcctttctgtaggagaagagatcaactttgggatgctcatcacaaaacctgcttcagaaggagcaacgcttagagtagaagacctcgtaaagcagtatttccaaactgcagagaaggtaactcttcagagctcactgtcttagggtttcactggagggaggagacaccatggccagggcaactcttataaaggaaaatgtttaattggggctggcttacagtttcagaggtttagtccattatcaccatggtagaatgcaggcagacttgctgctagaggaactaagagctcttggtctacaggcagctgaagggggctgtctttcacactggatggagcttgaacatcggaaacctcaaagcccacccacagtaacgcccttcctccaacagtgccgctccgtgtggttcaggcactcacacacaggagtctgtggggccttccctagccatcaacaaaactcatggtttcttaagaacgggtgacacagcagattttagtgtggactgtataattcacaagtaagtgactctttggcgcatctgtgatgtaaccagtgtgaggtagtttgtatccaagtattgggtgaacattgttaatacaattaacagaagtcatgttcctcctctattgctgctgtaagtcttgatcttatcttatgtttgaatgtagcttttttttttacttagttactttcatgatacagtcatatgatactgaagctacttggacttctctagttgtattatgtatttttttcttttaaagatttattcattgttatatgtaagtacactgtagctgtcttcagacacaccagaagagggcatcagatctcattatggatggttgtgagccaccatgtggttgctgggatttgaactcaggaccttcggaagagcagtcggcgctcttaaccactgagccatctcgccagctccattatgtatttttaaaagtacaaatctgttacctggcagttgtataggtcagagatagcactggtctttctgagctcagatcaaggtatcagcaggtccatattcctttctggaaatcgtaagggagtgtgtaattcttaaccttccccagctactagcgctccctatgtaccttcacttagtctccatgtgcagagccagcagtattgaatccctggccattttctaagttctctccccctgcctgtcacttgttctttctggaaccctgtgattctatggggctgcctggacagcccgtgacaacctgagtagtttatagctggatgatgaacagccttaatatcatctgtggccttgaactccttcaccatatagcatagtcagagcttccagagtgagctggggacatctttacagccatcatcttgcctaacccaatggtttatcctcatctctagcaatcattggtggcctctctggtattggcagccattcaggtctctgcagctagctgtacctgtctttgtctcccctcccttttcttctggcccctttaatattaacatgctgtctgctgatcccacacccggcagcttatcctttcccatagcagattgtggtttcatccttaggtagtcactggatgaggaacagataggacttgtgcatcaaacacaatgtgttgtttttcacagaatgttcagctctcgctgctgacagaaagagggatgggcgaagcagttcaagagtttgtggacaaggaagagaaagatgccatcgaggaattagtgaagtaccagctggagaaaacacagcggtttcttaaggagcgccatattgatgctctggaagacaagattgatgaggaggtgagctgctgtctgacagcctttaagagttgtcctcaggtttggtttggttttgggcccacgactgtttaagtatatgatttgtttggtttcctcatctataaagttaaggggataaaatgacgaatatataaggcagtgtctaggcagaagccagtagagtctgacatgtgactggtgctgagtggattctgtcctagagagagcgtctttcagagcttccaggaaggcttcagaatgaagctcgtagcgcagaattgcttctctttcagttttttcattagttttgactgagcttttgatctcacctaaagcatgctttccctttgcataccaaggagggacgagaaaaacttgcattggagtacattgccatgtcaacaggaaaagggtttaactgtggagaaagtgtgcgtacgtgtacagaagaaaaggctaacattttcagtgtagtattcaaaggctcatggaaaactttagaaaatattaaacatttcagtagagccataaacaaaagacatgaaaaaggagttcacaagaactatacatggctaataagctcaggaaggtgatatttaaccacagtcaaccaagggcattgactttaaatggattttgtttgtcaaatttaacgcaagaaaattggcagtcagtgcactgttggaggtgtactgaagcagcttcctaacaacagtaaggcttggtcctccggggtgtcccgaggaaatagtaagtaaagcagacattcatacacagcataaccgctgccagtgctgtgctcagtgggggacactaggaaacggttgcttctttgaacactgccccctaatctagaagtctaaggacttctcttaaggattatgtgagaataagctattaggtatcgtgattttggccaggtgcaatggcatgcccataactccagagctgagaaggtagacggaggaggatgggggtcaaggtcatcctcactacataatgagttccaggccagcctgggctacagaaaaccctgtcttaaataaacacaaagtatgtgtttgaaagccatggaaaagtatgttgagtataacgttacaggcaaaccggactgtaaggatgcagagatgcacacagtgactttatagtttcatatcatgaatgagtgtcaatagatactttgaggttccaaacacactggcaagtatcttggttacagatctgtattccatgaggttaccttctctatagaacaaaacactatttcatagatgcagtcccttacctctcatcttagtgtgtttagcatggccctcctaaagcctgctgtgttaggtgtaaataggatcattcattgcccagtgctgttcagtcagagcagctccatggactcagtgccactcactctgtgactctagatgtgttgaggcagttggtttgtctttacacagtgtgtgtttctgtctttgtgtctctgtatcatggtagccaagagcatggcctctagactatcgaggctcaaaatcagaagccttatctgtgtgttgattcttgaattctctaagctctcagtaccttatctgtaaaatggagtaatactcctccacggttgtaaggattaaaacagtgtcttccagtttgcctcctacctgatgtaatcttcttgctccacatgctgttctgtgtgaacagcatttttggtacccaaagcaccatgccttactccgtcaacctttttttttctgagagaggatctctctctctctgtgtaaccttggctactcactacttgctatgtagaccaggttggcctagtactcaatgggatccagctgcttctgcctcctgagtgctgggattaaagatgtgtaccactgtgcctggctctcatactggcttttgatccacagttccactgctcttgtcaaggtttccagtgagtccttttgccagcactcctgtcagggacctgctgtgactgctgccaaacttctcgagacacttttatcttacaggtcttaaaggactcccacacattgggcatgctttcttccctccttgatggagtattccctttcctggtaactttcatctctccatcctctcaagctggacttcccagagtttagtccttagacccatctatctgcatccccactttctagcttcacccagcttcatggctttggtggtgaccctccctcacgagttcctccaaagccttcctttctcagctgcagacttgcacagtgtatggcctgttcctcgagtatgaagcacagatctcccaagcaaaactcccattttctgccctgctcttctaggagagttctatgggcactttaggctttgatttgcatggactgaaaaccatcaagttgcccgtgagtctgtcctctgtcacctgattctgatggtgctctgctggtagaatatacagtgtctgactttctctgttgtggtctaggtccgacgtttccgagaaagcagacagagaaataccaacgaagaagatgatgaagttcgagaggtaattgacagctgcagcatactgtgtttgtaggttggtgtgtgccagtgggtacagttagacagactgcccaagggtatgttgtgtctagaagtgaacactctgactaacattggctgattggagctcaggtcacctccggggacaagtgtgtgactgtcactgcttttctcctttctgctcttgttaaaatgtatttgcacatgtgatgagcacagattcagagagaaatcctcagtattgaaaataacatgatatttctgagttaaaatgtcggaatcctcttgagtctcttcaagtgtcaagagaggtagatttgaagctgtttactgacgttccggacttctgacggttatggtcacctcaacattgaaatgtgcacgtttgttttctggttgtgtgttctgtgttttgatcattgtcactgttttgtggttatttcacatattaatgactcccgaggctttgtctgaatggttttcatggttgttatgagtatccttctaggagtacaagtgtagaagagtatggacaggtatggtctttgaccacaggagtctcctcattaagctcattagtctttttaaaaggataagagctgggctgagggcatggctcaggggtcaggtgccttctcagcatccttatcaccaccaaaacagcaaaaaaggaattgtgcatattttatatggaaatggaacgtttcgtgttcaaacttcaaagcttaaaactttgctatatttttaaaacatttgcaggtaacaggatttcctgggctttttagtcgattttctgttgctgtatcaaagtgcctgagaccatgtaattcataaaggatagaaaaatgtttgagctcatagtactagaagctgggaaggccagagagcatggtgccagcatctagttagagtcttcctggagggctctgacttgtcaaatctcatggcttggtggggagtgagcgacctggctttctttcagaacagagccattgcctgcctgtgtaacttttgagtccattgatctcgtgaatagattaatccactcatgaggcctttcctcatgcagtggccactccatactcttgataggtgtggctttctgcataaagtttacagcatatggagtctggaaaatatattaaatcatagcaataaacagctccagaatgctgtgggtgctgacagggttttcagcctcagagtcctactcaacttgagtaatagagttgacatttctcaagatgtaatacacagctttgtcagaatttctgagccttgaatatgaatcctattactatacattagttatttttacagacaaattaaaaaatgcataccatagagctacttgttcacatggggaaaactcagaatttttttaggcacaagttgacttggaaacctaggactaagaccagccagtaaagattgggtttgtcggctgccatgatctccgtcctgtgcactgctttctcttatggtcctataaacacttagcacttagttctaagcacttagttcttagtctgacacgctcctttttttttcctagcttacaaattcttaggtcctttctgaatttagacggggttggtacaccctttcaaaatgtgatgccactcctaacccagagtgaagggattcacagggtggaaggaagggcttacaaatcatacatacaaggattggtgtccacatggcatttaaaaatggcttcttaaattcaacagtaacagcaacttgaaaatggacaaaagccttggcttgtcatcttttcagaggttttcaagtgctctgtcagcacttaaggattctaagtattcacaatgcagagacttgacaccacacacattagagaagcaactgtgagacccagggagagaatgagaatgtgaacagagcagaacaagggtcgggattggcacctattgtgcagcctggagctccataattcctggtctaagtgggacctgatgccctggggtacaaagcaacatggccactcctagaaagagaaagcacaggcttaagtaaacagcaaagggattggaggtggagcctcaaatgaatactcagctgttagtgctcctagagtaagactgacagtagccaagtcagacacagcaggtcactggatgagcaaaatgtggtatcttcctgcagggaaatgttaccacatcattacagtctaacacatgctccagtgttcatggaatctgaacacacactgagtgggagagagccagattccaatggactaatgtaatatttcatctgtatgtggtactgtgttattctgtcacagggatggaggagaactggggttcccagggacttgggagtagagaatgggtagagtttcagtttaggatggagaataagtcctatagccagtaacttaaagctgttgtgcagaaatagtaaattagaacattgtttgactgtaacatttgagaaaaggaaaataaagatggtatttagacaaacaaaaatagaccatttggaaatggtggtttattacttacaaataagcatcacagtgggacagggcttaagtgctgttacccatggctgctgctatagaggtgctgtgctagcttgccttctcatccctggggtctgagtacacatttccatcatccctcagcttcttccgatactagaggtttgatctttaggaatctcaagggatgctgtgtttgatgcttctctttttgagcagtgaatgaacattccccacaccctgctcctagaactgaggactgaacccaggtccttgcacttgctaggcaagtgttataccattgagctaaattctctatctctatgaacagttttttaatgtatgtaaagcattcatgtgacgtaccaacttatagtgggctagagggtaactcctacttctctgtgtgctctcttcctcctcctctttctctttccatccaccctcaaatttagtcatgtaaagcagtggtgtcgcacgcctttaatcccagcactcgggaggcagaggcaggcggatttctgagttcgaggccagcctggtctacagagtgagttccaggacagccagggctacacagagaaatcctgtcttggaaaaaaaaaaaatgtagtcatgtagaagtctccacctattcctgaagcctgttgcttaaataaggggtagtggggagttaaggcttttggcgtctagagaggggaaatgtggggcctcgtccttgtgttctgttcatgtgaggtatattagtatgtatgggtccctgacctgctatcactctgcagatcctgtcacctgcatgccagccttgcaggtattccttggctctgctgtattcatgaataccggatggttgtcttctctgtatatgttcagtgctgtctctgccttaggctggctgtggtgcttgttctgggctacagcactactgcaatggcagtgagcttgttctttggaaatttagctcagctcaactgtaaagctttcttggtatctggatgatgtttgggatttttacctgtttgttatgttgttttgtttttaactttgtgtgtatgggtgttttgcctgcatttacgtctgtgccacatgcttgcctagtatccaaacagaccagaagagggagttgaacttcctgaaaatggagatggttgtgagctgcctgtgggtgttaggaatctaaccaaaatcctctgcaccaacagctggtgctcttaaccttgagccatctttccagctccagagtagtatttttaagcaattttcacaaaatagtcttggatgattagactgttggtggcatctgtttttttccttggggctctaggttgttttcaggacctgcattacaactcatttattttctacttatgtgcatatgtgtgtatgtgtttgtgtgtggacatgtatgcagaggacagtcttgaatgtttttcttagatgctgctactttacatgtgtttatttgtgcacgtggggccagagatcaatgtggggtgtcttcctctatggctttctcccttattttttgagacagggtctctcactgaacctggagcttactgattagactaagctgcaggctcacatgctgcagagattgtctgcctcttcccagcgccgtgatagtagacgcatgagtggcacccagacgtttagtgtgggttctggacccacactcaggtcctcatgcttgtacagcaagcgctttacccatcaaaccggctccctagccactcctgcccgccccgagacagcacatcttgctggccatgagcctagtgatcctgcctttttgggctcccgagtgttggaattataagttgggatcactgtacgtgcctttcacatgggtgctgggcttgaactcacatccttatgcttccaaagcaagcactctgtctactgagctatctcctcaacttttccctagctttttggaaactgaattaacctacctcctttgtacctcatatcctacagcttcagtcctcatccactcctagcttgcctacttgctacccatctcatttagtgctccccacctctcttgatgccagtggtcctgttagagcttgaggagtccctggtctcctgctatcagaccgctttataacttgccttatgtctgctgtggggctgtgcctcagcattgtgactccccactgttcggctttccccagatgcctgtatttactcttcagaagcggggaggaggggtgggggtggggggtggaattgttttctagttttattaaaacctgtttggggtttcttctctcttttatgttttgacagatctcagtgaagaggtcagggcacatttgctttcattctatttttaatttaaaaaaaaaatccgtttagagttagtgtttggctaaatctcaaatttgtcttttgtaaatgatttcttataaaataaagaaagtagatatgcttagttctaagattctttctcagtctttttttctttttctttctcttttttttttttttttttatgtaagtacactgtagacacactagaagaggacattagatcccattacagatggttgtgagccaccatgtggttgctgggaattaaactctggacctctggaagtgcagtcagtgctctttaccactgagccatctctccagctcctttctcagtctttttataactatatatatatatatatatatattgttatatatattgttatatatatatatattgttatatatatataaaacaagataacaacttattatccatgtgtttctggatataaaatttattttagaggaaattgccatatttaaaaatcagaaagaaaataaatgcaccctaaaatgtcatggttttttctttctctttttaattaagagctcattctaaaaaagaagctcatgactgtcttttacaaacattgtgtgggatgctgagtgatcttcagcctcttctttggttctagaagtgctgagtacaaacccgagttttcttggagaccctcgtaagaggtctcctgcgggtggcagcacaggtaaggtaaggcagtgtgagacactcctcccacatctgtatagcacactgagttagttagtgggttgatatgactgaatgagaggtgggtatgatgctgtctgctgatgtgccatctctgctgcccaggccatgagcagagcccgggccctcagatcacagtcagagacctccacctcagcctttagtgctgaggacctgagctttgatacatcggagcagacagcaaatgactctgatgacagcctgtcagcagtgccgagcagaggccgaggccgaggccgagggcgaagaggagccagagggcagagctcggcacctagaggaggctctcagagaggccgaggtcagcacccatctttgtctttcaacaatgcaaacttgcaagctacaagagaagggccaagttgtgtcctttggtcagaattgaattaggaggttttgtttctaaaacagttgttatttttgtgatgtgtaacagctacctgtagtagaacttggacagtttgtaactggctgtgtgcagccatagggttttagttgtttttaagttataattaagagcctcactgtatacttctcctgtatatattctctcatgtatggaggaataatgattgacaaatgtgaatgaaggaagtggctagcaaatcacaattctagatcagagaaatattgctactatcaggagataaagtacttacatgttagtctctctgagcttgtttaagagtgaaaaggacactaaacagcttaccttctaaaggctgtcacagcactgctgtcatcactggtactgtagttctggatggtccagatgacagagcattgccatccagtgatttcctagtatagtccataaatctttcagtaggaattgttcttcattgaatatttgtccatggagggctgggtacatggctctggggttaaaagcactagctgttcttctagatgacctgggttcaattcccagcacctacatggcagctcacaactgtctataacttcagttccaggggatcctatgcttgtttctgctctacaggatcctgcatacatgtgaggccataaacttgcatcatcacacatacacataaaaatttaaaaaatgtaaaaagaatattttatcctagggaacctgagctggtaacataaagaatgacttactataagagctttgaagagccaggcatggtagtgcacactcagatttctgtgagcttggtctacatagtaagttcccatgcagctagagctacatggtgagacctgtctcggaaaaacaaacaaatcaaaaaagagctctgaagaatcagtctgtggttgttttatcatctttacacttacagcttgtgtcctaaagcgtaaccgaggaccagggtgactaaggacagtctgaaatctgacgctcagactctgttttgtatgtgctgctggctttctgtgcactgtttgttagtgagctctcccttctgcattgtgcagagggaggttcctgaccactgtgattcctcttgcagacactgggctggagatcactactcgaggcaggagctcaaaggccacctcatcaacatctagaaacatgtccattatagacggtgagtacagagctgtagcttatattttccatcccaggaaggttgaaggcgcctccctggtaactgcactcactgtagtagcagccattgagatgtcaggctaaaacactctggagaaatagttcttaggcttggagaggcagctttgcagtgtgcgtgggggactgagctgagctgagctgagtaattccatggataaaacaagtagatcccaatgtctggtgcatcaggaggcaccttcaagagcttattactataaaaaataggaaatggtggactacaaaaacagagtgttgaagtgtgtatgcttccctgccaaagccccagtgagctcagcatgatactaggctcagtggctaaaccagtgcctcagcccagcctgccctttctcattcagggttaatggttttgtgtgaaacattccttgataccagtgtgtatactcaccttaattaaaggaactcttcctgttttcattgttggaaggtatcagctgttacctttccttaaagtaaaacctctttttccctcagcttactctctgtggtcttacttgtggtggtggtggtggtggtggtggtggtcgtggtggtggttatcctgtttaggactcattgggctgtgtagaggtatgtgcactggtgtgtcatgacactctgctgtgctcttgaacttctgtctgggttgacatgtccccacccatcctttttttttgttttgttttgtttgtttgtttgtttgtttgtttgtttgagacagggtttctctggctgtcctggaactcactctgtagaccaggctggcctcaaactcagaaatccgcctgcctctgccttccaagtgctgggattaaaggattgcgccaccacttgccggtttcccacccatcctcttgtcacctcctcactcccattagtttcctttgttcccaaaacgtggactgagttttttttttttttttaaagatttatttatttttactatatgtaagtacactgtagctgtcttcagacactccagaagagggtgtcagatctcattacagatggttgtgaggcaccatgtggttgctgggatttgaactctggaccttcggaagagcagtcgggtgctcttacccactgagccatctcaccagccctgagttttttttttttttagtgtgaatacacaaaatgattttattatagtacgtttcaagagattttcctttttctatttttatcttttcatgtttttttcaattatttcttttattttttgagttacaataattacaccattattgtcacttgagtagccaacagctgctgaaattaggagttgacagctagagtttttccactgaagttattcagcagaggatggtgactgagcagagaaaagacaccttgtggccactgccttcccacgtgccttacttccctgagtcactccattcgttttcatgctgattctgtgtgagagtgcctgctgcctgccaggcacttgccaaagcaatttgcattaagcacctctttaccctttcaacagttttctgtgtgaaatattggcactgctttacaggtgtggaaagtgagacttgaataagccaagcaacttggcagtggctgctagctaaaaagtcagagtgggtccagttctagaagcagacccctgacctaccaaggcacggggccttcctgacaaaacagtgtcttctgataaaagttgccttctttcataagcactccttcattgctggctgtccacagggagcaaaagaaagtttccttgatttccagtacctcaggatttaggaatcatgagtaagtgccgacagcattctctgaaagcacggcgctctctggctttctgttcatgtgacctgcttcttctccattgtagaaagtagggtgaggcctgtgagtgagagggcagatgagacctgggcttctgcctttcatcttcctctcagacatcaccagatcggacacagaaacctgaggcgggaaatgggagcagtgataaagttgggctgtgtagaaagattgctgaaggctccagactagggatgttaggcgtctgactatttaactgtctccctttgcccagtttagagtggaggttgtcttggaaaagctacatctgatgctagcaattgatcatacataggagaaagcaaacactgccgaggtgtttgaatctattgcacagtttgatattaaatggcagagaagaggcaaggttagcaaaagcttaggtgtctgtaaagcaaaaatgtgagggtttacagaaagctttatcagggagtcaaggatgtatgatttgcagaattcccctctggtgtgttctcatgtgcccagtgtggctacagagagaatagagatggctgcggaaaccccaggatgtctggtcatctgggaaggctaggagtgctactgtagtttacttggctgagtgacaggactacatctttcaggcctgttttataaatattttaatatgagtgtatgtatgaattctgcttgctactatatttgaacaagctgggaaaccatgagagttctagccagactgtgggcttcaactgtatatagtcttacatcctttcagactccaagagtatacaaatggttttccaattgatcgttccaggattttgcaggtaggattttaaaatccttgagcttaggaagtgaatacatttttttagttactttaagaactatgtaacaggcatttcatctttttcatactagctttcagatctacccgacaacagccttctagaaatgtagcccctaagaattactcagaggtaagtaaagtgatttgacttgatttgaataatgtgctttgtgtgttaggacttcctaatagggatgtggtgtgaacatcagcatcggggggaacttgatggttattcagactcttgaagccaacaacaaagctccctggttctcttcaagtgcattcgttccatgtatctggtagcattttaaaagacagccgtactgacctagagccctgacttctaaaccccaactcagaaagtatattcctcgtgtggtgggaggcatgttcctcacgtggaggtgttccttcatacttctgtgaactaaagactgagaagactagaggctcgggatccttgtgtcctgttaaagatttgccgtgcagtggtggcgcacgcctttaattccagcacttgggaggcagaggcaggtggagttttaagttcgaggccagcctggtctacaaagtgagttccaggacagccagggctatacagagaaaccctgtctcgaaaaaccaaaaaaaaaaaaaaaaaaaaaaaaaaaaaaaaaagatttaacatgggcctttctgccacttgggattctacaagcaaattcaggatagttctgacttactgtctcactgttataatccataatcttaagtcccaggtcaggactcttcnnnnnnnnnnnnnnnnnnnnctaagttcgaggccagcctggtctacaaagtgagttccaggtacagccagggctatacagagaaaccctgtctcgaaaaaccaaaaaaaaaaaaaaaaaaaaaaaaaaaaaaaaaagatttaacatgggcctttctgccacttgggattctacaagcaaattcaggatagttctgacttactgtctcactgttataatccatgaatcttaagtcccaggtcaggactcttcctgtgctgggcagtcctgcttggtaaaggtatatcctgtgcactgcaggatgtgtagcagagcctgtgacctcgcatgatgctcttttggaattttgtccttggcttcttcctcattaacagtttagtaggtgaaaacatagcacatacccatcaagggtcaagataatacaaaacacatggtagaattgtatatatatctctgtcggctcttaacaccaaatatctacctatctgctgcttcccatgtaatccaataccttttaaataagttaaaattggagctgattttttcttttaaaaatggaactaataggtgattttggtagtacagatcaacaattttcacactcagtgggcagaaacctgaagattacaagtttgaaagtagcctgtgctactcaagaaaagaaaacttgaagtgaaagcactgacagtctgttgccctatcagagcctgggcagaacctcggcagggctgcgctgcactgcactgcacgagtcactcagcctcctgtgtattttagaggctacagcttgggaactgccaggaaagacaggccttggataagaataacatttgtaaaggagagggaccttggtgggggtgggggtgggggtcagtctgcctttaccttcttccttgaggtctgaagatcaaacccagggcctcactgctaggcaggtcctctaccactgagccacatgcacttctggatttgtgttaatcacaagtgtttatgtgatttgctggacacatatgtgcatgtgtcttgagattctgttatttaatttgtctgtcaagatgaactgttgctttgtttcttcccttctgtagaccattgaggtggatgactctgacgaagatgacatttttcctaccaattccagggctgatcaaaggtaggctagggacaccctttgaaaacaaaaatataattatgcggaattctatggcaatacattgttctatactagagaagataaatagaattcttttcatctagcaattatgtagagaaatgaaaaacagatatgattcagcgttgctggacgtatttcctctgaaaaacagtctctgattcatgtccgcttgtctttattacccagtccccttcaagatggaaaatgcttttcttttctttttggtttttcgagacagggtttctctgtgtagtcctggctgtcctggaactcactctgtagactagactggcctcgaacgcagaaatctgcctgcctctgcctcccaagtgctgggattaaaggcgtgtgccaccactgcctggctgaaaatgtttttcttaattctggatttcagatttatttttcactacattattctctgccgtatatacacagtactttactaaataggagaagtggctgaactttggagtacatatgtggctgtctggacttcctctgttccttttgtaaacttactctggattacttatatggcaagctggacctattctagagtaataattggcttactttggtgtatttactaaatttatttaaaatcactgttttcttttatgtattaacattttgggcaaatactgtttactttaaacttaatgacaatttctacttaagaacataattgagggtcccaggatgatggcacagtagtggagtgtacttggtgttcctgtggataaactaggatttggttcctagtacctcacagccatttgtaacttcagttccaaaagtatctgtctggcctctgggcattgtagataccttgtcacatacatacctgtagacaaaacactcaaatacataaaataaaaatcgttttaaaaagaaataatctatagcccccttttgttttttaacactttcagttttgacattctactaggtctggtggtgtataacagatctgataggctgcaacttcggtgacttaattatgctataaggggttgaccacatacaactaactacattaaggatgagtaaagtagctcataactgtgtgcaaaacgttgtgatttaggctcttgattgtgagtctcatgaaaaagagcaaacaggatatggcaggagaaacctggagagtgccgagcttgccccccactcctgagcggctgcaggtggaagggaaagcactgcagcactgtagctgtggcgggagctgctcctacagcagggcacgagccagcacttggtggtgctctcacaccatggcttagtgctcaagcagattagcacatagctctttaaagaacaaacatttccccatttgacagatgaggaaatttaggtgcatagggggtagcatagataggaaatggttttggctttttttctattagaaaatatttactataaaaacattcaataactgaaaaacagacagtgctgctcttagggttcctcagaaacagagcccataggatgcatacatatggcgtgtatgtaatatattatctctgagtacacatagatacacgaaattatatattagagggagctatgtattgtctgtactcagtggttattatggaattgaatgcttgtgtaatgttcacattcattgtctttggtttttctttcttcctcaggtggtcgggcacaacatctagcaaacggatgtcccagagccagacagccaaaggggtagactttgaatcagatgaggtgatcatcatgtcactggctttttcttacctaactgtctatgagatgtaaatggagaccactggctaggctctgcaagttatatttttaggctctctggtagccttgctgtgacctgtaagtgagtgccctcggtgcaattgcctataaaggcctttcaaagcacactgttcactcaactctcacttctcccattaatggatcaaagctggggcttttaatctttttttaatttagcttctgtcgttcatatttggagagttggatgatgctggtgtagaagcatttcaggttgacttggtgaaatgttccctgcacactgtgcctttcctgtctgttggctgaatttccaagagggcggatagagtgataagtctaagtgaagccattggtacacactcagtgggtgaagtgactgctgcacaagcctggtggcccaagtgggagtcctgaggcccacaaaggtagcatggaggagtggactccatgaagttgtcccagcagagcacacactgcatgtgagggcacacatgtacacagtagtattagtaataataataatgtcaatgaggaaactgaacgaataggatagaaatgtcttggatagtttctgtccttgctttcctacacctcatttgctttgattaatgtttgtgactgggaaaatgtatgtgttgtgtgttatagatatgtgcagtgacagacaagtcctgcctggcagatttttactctaatgcacagagaactgacttgggcctttatatttcacagttaaagggatagatgtgataaatgtgacttgctaataccattttaattgtaagagtttctttcttagctcagagacgatgagtggtcactgacatagcataacgtttgtgtcatttcaggatgatgacgatgaccctttcatgagcagtagttgcccaagaagaaaccgaagataatgtttttaatggaacttagaaattgcatgatgcaggaagaaatcaaagcaccacatactgacttcacagctgaagatgtttaagtctgggcttatattttatcgttttctgaacggtgactcccttaagccatttcctagcccaatgataaggagattgcagctcttcttagcctttaacctggttgttattgtctggggctgctctgccatatcgagaacattaacttcctgacagaactgtgttttctgcttgtaagaacttggctaaaatcccattcttaaatgatgattagagaaaacccctccgttgttcatttctgcttcatgatcagaggctgtcagcctctgtgccacagctagcagttgatgggaaagcttacagacttgagtggcatgtgctgtaaccatctcctagatctccagaaagccaggccctcctgtgtggggggcacccagcaccctgcttgttatcaagtgtggatatcagagcttgctagaggaccgtctactaggaccagaagggtcttatatttaaataattagtagaaggtttttgttaagaacattttggctgttttggttttgatttttattcatgttatagcagagattcagatcctgtgcccattgggcaggactcattttcttgatggctctgtcagtaatgacaagctctttttctttctcgtatacttgtcaggaagaaaaggctaatagaatttttctgttttcttaaaaataccggaaagcttttttaggcaaagcagcatctgaccttgtggttagttcaggctgccatactgcagcagtacagcttnnnnnnnnnnnnnnnnnnnnnnnagtggatgatcccagaactgaccgaaacagcacacttatatttttttacttgttttaggaaggaaataaataaaaatgttatcccttctgagataagataaataatctcattccctgtcccacactctaaaaacttctgctggtcttaattttataaggcaagtgtgttcagtcactctgataaaatctgaaccctctagcatgacaacatgatgttcttcatagttgtagacaccagtgcttgggctaaacagtgcctgtctggaacttgccaagtttttgaagcccagcacctgacggtaccaccaatcaccaagtggtttaagttagaactataattcagtgctaatgagctgcttagaacaagctttgtaactgatgtgagcacagggttgtcagcagggaacattgacagcacaaggcctggtcctgtgagatcccttcgggtagttctccccaccctccatctcaatcacattaaacttgaagtggattgaatggagatgaagtgaggggctctgtgagatggaggctagtgggaggtggtactccctgacccactgaggtatagccagcattaggtggtgccttgtctgtgtgccagtgagatgatcctaggtgagtgacagtgaggttggtcactaaagtccctgagagtctcctggaaaggttagtgaggcttttcctccattaaaaaatctcagctagccgggcacggtggtgcgcacctttaatcccagcacttgggaggcagaggcaggcagatttctgagttccaggacagcctggtctacaaagagagttccaggacagccaggcctatacagagaaacactgtctcgaaaaataaaaagcaaaacaaaacaaaaaatctcagctagagtataaaatgatgctgctagctgctaggggaagtgagtccctggcagtgtggaaatctaccatgtgagcagcatgcagtataacctggcagtatgggaagtacaaaggggaaatagtgttgattgaaggtcattgtgtaatcagtgtaccacaaagttctctggggtttgtttagacagatctgacattggttctttggtgacagttttcaggcctgtgagtgtcagctggatgaagtcttgggacctggaacaagttgttctttagtgacaggtttctgagagggagtgcacaggttcggaaaataaagattataggaacgctgggctcaggaagtcttgcagagctgactttatgccaggcaggtttctttagaagtacatcttacatggtgtgttgtgaggaaatagggcacaggcagaaagttaccatacaacgggatgaagtcccaggaagctaatcaagccatgttgcacaaggtaccatggtagctcaagggcatcatagactgagcacatagtggccttggaactgatgaattcagtctcttcagagggaaaagataagttctcaggaaccaaaatcttaactccatcaaggccccagcccagagcttgccaagtgtgcgttgtgtgaggacgacacaggactgagctctcttgtcctctcatgggccatcttgagaaggccaggattcggcctgactcccaacagccttccagatgatttttgagcgccccatttgctcttaaggatgtgatagctccacgatgaatggagacctttgtcctttagcttaccaaagagtccatctctgcatcccgtgagtacgcgtggagagcgagcgcactgtacctccagctgcttgcctggcaagcctctgaacagcaagcagagtttaatttaggagcacgtgaatgttatctttataaaccttcaaagttgctggtgacagtaactatagaaaagccatgccttaacctgtgcagggagtcctcttgggcaggagccagtggcacgagctcgccatgcctgaggagcatgcatggctgcagttcagagctcgcactctggttctgctgctgtatgcacttagacggttacagcagataatctccgcacagtcttgtgcagtgactgagaatctagtcagcaaagctgtaactatcctccatcatacgtgtaggctgcgtattttacctgtccctacccattacataggatggctcatgtgatacgttttacatgtaaagattcaaggagaatcaacagttcaatgtctacgtaaaggaaaaaacaaacaaacaaacaaaaaacttttactagaaaaatgaagtaaaaatgatttcctggttagccgggcctgttggcgcatgcctttaatcccagcacttgggaggcagaggcaggcggatttctgagttcgaggccagcctggtctacagagtgagttccaggacagccagagctacacagacaaaccctgtcttgaaaaacctaaataaataaataaataaaaataaaaataataatagtcatctcctggcataaagtgatatttccccaaactgagcgggtgtcttttttgtctctgtcagacatttaattccaattagtagtttgaggatttttaagagctgacattaaaatattacaaaagaattatctaataaagatttgttttttttttgaattttgaacgtttttggtttgaacagcttgcttggacctgattacaccacacttcatttgttgtttgtaaaattgggcacatgattggctgtggccattagagtgtccttcagatcactagctctcctgctagatctcattaagttctccaaagtccagaaattgaaatcagacccaagtgtatgtgtttggttgcaccctctcttcagctacaagctgtcagcagttaggtacttggttctctgatccttttcacatgacagctaatactctatgctgggttagaacccacccctccagccaagtgttctagagccttcctgcccagctacatggcccccaccccaccccgtaccctctttcttccacatctgcctcgttaccctcaatattaaactggcattgcctattttaaagactagctacactgtttaccaatagatgacttaaatgccacttttcagtttgtttcagatgtgcaggacctggatgtcagaagtgaaggccgtttttaaaggaccctaggccttgtacagttgagtagttgacactgggacattgagtctcacatggggcatcccagactgcacttggttctgccagctgctgtgcagccctggtcgctgcttaagttgctttgtcacaaggcctgtttagtttgaagattgttacaggctatttaaaaagacgtatttcctacaccacagtcttatgccgtctgctaatgtaatgaaagtggtgtgtcagatatcagattgagcatattttctagagctaagaaattataaataaataaggaaatagctaatagggtcagactcagctgtgtttcttttggagatgacctagaaggtgaagtatatgttacattaagagcttatctgaaattaataaaattagtctgtctctcacctgaaaactccagtggcttctcggttgatccctaagctctttttttttttaaagatttatttatttatttattatatgtgagtacactgtagctttcttcacacactccgaaagagggagttagattttgttacagatggttgtgagccaccccaccatgtggttgctgggatttgaactcaggatctttggaagagcagtcgttgctcttaaccactaagccatctctccagtccgacccctaagctttttattggtgttttgactccagatgatatttaaatagctctctctgtgtgtgtgtgtgtgtgtgtgtgtgtgtgtgtgtgtgtgtgttatttctattctatgtgaattggtgttctacctgcctgcatgtatgtccatgtgagtatgtcagatcctctggaactggaattataagacagttgtgagttaccttgtggatgcagggaattgaactcggttctttggaaggctagccagcattcttaactgctgagacatctctccaggcacccagatgatagtttcaaaacatttttactttggttttgttggagttggagctcagggactcccacatgttaagcacagaccctaccactgagtgataattcagcccctaaaatttttgaaatactttacagaaagttggtaataataatgggtttaatccctcatttaaatgtaaggtaaacaggcggtggtggtgcacgcctttaatcccagcactcgggaggcagaggcaggcagatttctgggttcaaggccagcctggtctacagagtgagttccaggacagccagggctacacagagaaactctgtcttggaaagaaaacaaacaaaaaatgaaggtaaaaaaattttccatttaaatatatgtatatatttacataatacttattacccatatatatatgtatatatctacatgtatgtgtatatattacagatttatccatacataggctcatgtatgacttgtgatctttgcagagtagactgcagccctgtacttccttccctttatatggatcgtctcaggatttgtctccttgcggccttggcacagtgggtctgcagtgtacagactgcttaaaagcaggtgtttctaataatttcctcagcatatttttccttctagggtttacttttatttttgtatatgtaaaacattaacataattcttaaattctgcaccgttcagtatgtactcaaatcttccaaatctttctgcccacctactgccatttaacagctctaccataatttgccttttcaatattctttttgccaaaataattagaattattttatcatttgcccttttgtatacaaaagattttgctataactgagcctgttttgtctgagtactatgccctggaaatttcttcatatttcatacaatctccctcacttttgtagctttcaatatacatttgaatttaaatgccagtaatttactttattatcctgggtttgtgcattttgatagttgtgattcttaaaattagagatgctagtgtgttcacatttttggagctacctctgtagagaaagttggagccctttctagaagagtggatgccgatgctgtgttgctcagtgtggccagttacacactgcagcggctacaggtcagtgtgcggctgcctgtgcccctcacccgccacgccttgctggtgctcttggctcttagccagccctggtagctcctcagagcagctgtgtctgtctgtgtttctctcacgtgggcgtgctacatgtgtcaggggccatttctatttctgtggaggattgctcagtcacatattttgcccatttggggaggggaatcttagttacaaaaatgtaatttttatataaaaatatgctgatattgttaatcttattattttacttcttttttcctctctctctctctctctctctctctctctgaaatggcagtggtctaagttcttttgatgatatttttaaaatttttcccacacagagtttaccaactggaggggtaggtcttttaattaccttcgatgatcctttatgtaagaccatgacctcagtggactctaaaggagtggcacctgtctttgttcagtgctggcccctggtcagtgtatgaggcagctgctctgtccccgagcttcgtgctctgctcacttgtatactttattggggctttgttattgttttgttagtttcagatcacagggtaaggcgtttgatcaggcattgcatgcacagagctgcattttgttctcattggttgttcctgcccactgccttccagcgtattccccagtgggtccagtccttcctgagttagcccctgaaagccttcttaacacgtgtgttctgttgccctgtttttctgttccctgaagagctcttcttcccttctctggtattcttttcagtttcatcatctacaccatacatgcacacacatgtatgtatatacacacacatacatatgcacatgcacacacacctttttgttttgttttgttttgttttgttttgttttgttttgagagagggtttctctgtgtagaaaccctggaactcactttgtagaccaggctggcctcgaactcagaaatccacctgcctctgcctcccgagtgctgggattaaaggcgtgcgctaccacgcccggccacacacctttaaatatagcttccaaatacaagagaaaatgcacctgtcttactagtctatttcagtcaacagtgatttccagttatatcagtttctctataaatgtcataatctcatttttctttacagctgaatagtattccattatgtaagtgtgtatttttgttatccatttattctgctgctggccatctaggctaatttcattttctggctactctgactagtgaagtgatgtgcacgaatgttcaggactctgcagtagctctgctttaattgtgagaaacctgcactcatttccacagtgccacactagttcacagccctgcagcagtgccaattgctcctccttcccacacacctatcagcatgtgttatcatcacttgctttcttagtgctggccactctgcctgtgagatggagtcagagagcagttttagtgctcatttccctgatggctaaaggtgccaaccactttttaaagtaccgtttcctttagtagagaactggctatcgactcattaatccaattactgactggatggtttgggatttggggggtgtttacttttcatactgtgctgtaggtatcagtctccgtccagtgtgtttggcaggattttgttctcccacccgtcagctgcctctctgtcctggtgattgtttcctttgagaggcagcttttccattttcatgtaatcacatttaccagttcttggaaatattttctatgcttctagagtccttccaaatgtccttgcctatgcctgtgtgctcagtgctcagaagacattcgtgagttggttctctcctaccacaggagtcctggacactaaactcaggttgtcaggcttgtcaccttgtgacccatctcagcagccactaatgtattgtgttctgtgctgtcagagacatctttttgtttttttgtttttaagatttatttatttattatatgtaagtacactgtagctgtcttcagacacaccagaagagggcatcagatctcgttatggatggttgtgagccaccatgtggttgctgggatttgaactccagacctttggaagagcagtcgggtggtcttacccactgagccatctcaccagcccccagagacatcttttgttcctacatctttacaacttatttccgtagttgcattttgctcagtgtattaacgactactgttcttacatgcggtttaaggagccctgccgtaagatcccaatacttttatatgcctgtgggagtcgatctaaactttgccttttaccttttattgtttaactgggagttggtttttatatgtggtgtgaggtagggatcatgttttatttgtcctattctacatagagatgactagcccatctactgagatggccactctttgctgtgtagtgctggactgtcttggttattattgagttcccgcatacacaccaatcatgatttaaaactctgttccttcctcaaggcctatttgaaattaattactgtagttttataataagtatttaactgagagaccgttctttgctacttacctttttattcttgaaggctgccttgggacttcctggctctttagatttttaaatacatttaataattacatgtactactgtgacctaatgcaacgttttaacaaaaatcttatgtgtttcagctttattaaggttcatagctactgccaattgcagttggtttaatttaaaccttggtcttgttcccaggatttacgagacacttcctttgacagagaaaataattgtgttccccagggccaaagcttgtagaatgggcttagcagcattccatcctgactggactctttccatttcccctaagtgctgccagaccactgacaggctagtgttcatttgcccagttgcaacacaccccagtttagagaactatgtagtttctcatggccaccccttgtctgccttccctcccccagctgtgtgaagcagtacatccttcccttcctcccggaccctggattaggcgcaaaccacaccccaaagcccattttcacagagtgatcctttgccagcagggaaggaaagtaaaatggctgacttctgacctagcagaaaccagcagcaaatgaccttgcaggtgtgatttttaagtggaaaaagggagaggtctatgttagaataggcttattagaataggctaggatgcagtggtttgttttgattgatcaagttaattaagttagcccaaatggggctttttggttgctggacttcagtactttgatagctagtcattgatgatcagccataggagtgagtctggtatgagaatgtgtccaagtatgggagtagatctcggtagctagctttaggcatgtaagctatggtttataagagcgagaaggaggaaggcaaggcctgatggcaccatgtttgccatgctcgggccaaatagagcccttctgtcctccctatttcccttgagcccctgatgtagcaattttctcatttctgatcaactgtctggcacaaaggccttgaccgtataagggtttactgtggcttactgactaagcatatgcggtccatcatggctgaggaagcatgggacaagaactccaggcaggtggtcaccttgcatctgtagtcgggacttggggagatgcaagatgctgctcaactagcattttccacatccccatccagagattacagacctgcacctccacagcagtcgcttcttcccacatggccatgcttcaccaattccactgaggcctgtaacacaacttctcatgactcacaactgaaaacattagtctcaagtcctgaagcaaaccagaatagaaactctgcagaaaataaagccaaagttcctatgagcacaagtcatgcataaaggcagaccctggcctgtgtgaggttagtgaagagtgcctttcggagagaagcatgtcggatggcacaggcttcctattgaacactgggctggaaccacgggtggcctcttcaccaacttctcttgagtgttgaaggcagaagaagcttcagttgatggaaagtctgtaattggtgaggtctgagggattcctggaatagcttaatgtacccgttggctaacaacttacttagtggtgttttcccacagaatgtttctgtgggttgttttctacccaaatcacatttattgtgatattctacaaaacctaaaaactagaggcatgcaggacactgaagagccagcccgccaccatctaggttcactcctgtttatggtgaagcctctgtttctcagggagtgggctgtgccccacctg

SEQ ID NO: 1220 - DNA, 2589 bp, Mus musculus
tacggatgccgctctcccgcgcctaattcaggtttctgggagcggttttcttgtggttctggagactcccgcccccttttcctgagagtttggattcgagtggtttttctgacatacctgaacacttggagaggaacctggtacagaggaactctactataaaaatgagccccacagatccacttgacgatgaagacacatttaaaatcctggttgccactgatattcatcttggatttatggagaaagatgcagttagaggaaatgatacatttgtgacatttgatgaaatcttaagacttgccctggaaaatgaagtggattttattttgttaggtggtgatcttttccatgaaaacaagccctcgaggaaaaccctgcacagctgcttggagctgcttaggaagtactgtatgggtgaccgccctgtgcagtttgaggtcatcagtgatcagtcagtcaactttggttttagtaagtttccatgggtgaactaccaggatggcaatctcaacatttccattccagtatttagtatccacggcaaccatgatgatcccacgggggcagatgccctctgtgccctggatgttttaagctgtgctgggtttgtgaatcactttggacggtcaatgtcggtggagaaggttgacattagtccggttctgctgcagaaaggaagcacaaaactcgctctgtacggcttaggctccattccagatgaaaggctctatcggatgtttgtgaataaaaaagtaacaatgttgagaccaaaggaagatgagaactcatggtttaacttatttgtgattcatcagaacaggagtaagcatggaaacaccaacttcattccagagcagtttttggatgacttcatcgacctcgttatctggggccatgaacatgagtgtaaaattggcccaatcaaaaatgagcagcagctcttctatgtgtctcagcccggaagctcagtggtgacgtccctttcccctggagaagctgtgaagaaacatgtaggcttgctgcgcattaaagggagaaagatgaacatgcagaagctgcctctccgcaccgtgcggcggttcttcatagaagacgtggttctggctaaccacccaaacctgttcaaccctgacaatcctaaggtgacccaggccatccagagcttctgtctggagaagattgaagaaatgcttgacagtgctgagcgggaacgactggggaatcctcagcagccggggaagcctcttatccgactacgggtggactatagtggaggctttgaacctttcaacgttcttcgttttagccagaagtttgtggatcgagtcgctaacccaaaagatgtcatccactttttcaggcacagggaacaaaagggaaaaacaggagaagagatcaactttgggatgctcatcacaaaacctgcttcagaaggagcaacgcttagagtagaagacctcgtaaagcagtatttccaaactgcagagaagaatgttcagctctcgctgctgacagaaagagggatgggcgaagcagttcaagagtttgtggacaaggaagagaaagatgccatcgaggaattagtgaagtaccagctggagaaaacacagcggtttcttaaggagcgccatattgatgctctggaagacaagattgatgaggaggtccgacgtttccgagaaagcagacagagaaataccaacgaagaagatgatgaagttcgagaggccatgagcagagcccgggccctcagatcacagtcagagacctccacctcagcctttagtgctgaggacctgagctttgatacatcggagcagacagcaaatgactctgatgacagcctgtcagcagtgccgagcagaggccgaggccgaggccgagggcgaagaggagccagagggcagagctcggcacctagaggaggctctcagagaggccgagacactgggctggagatcactactcgaggcaggagctcaaaggccacctcatcaacatctagaaacatgtccattatagacgctttcagatctacccgacaacagccttctagaaatgtagcccctaagaattactcagagaccattgaggtggatgactctgacgaagatgacatttttcctaccaattccagggctgatcaaaggtggtcgggcacaacatctagcaaacggatgtcccagagccagacagccaaaggggtagactttgaatcagatgaggatgatgacgatgaccctttcatgagcagtagttgcccaagaagaaaccgaagataatgtttttaatggaacttagaaattgcatgatgcaggaagaaatcaaagcaccacatactgacttcacagctgaagatgtttaagtctgggcttatattttatcgttttctgaacggtgactcccttaagccatttcctagcccaatgataaggagattgcagctcttcttagcctttaacctggttgttattgtctggggctgctctgccatatcgagaacattaacttcctgacagaactgtgttttctgcttgtaagaacttggctaaaatcccattcttaaatgatgattagagaaaaccc

SEQ ID NO: 1221 - protein, 752 aa, Mus musculus
FRFLGAVFLWFWRLPPPFPESLDSSGFSDIPEHLERNLVQRNSTIKMSPTDPLDDEDTFKILVATDIHLGFMEKDAVRGNDTFVTFDEILRLALENEVDFILLGGDLFHENKPSRKTLHSCLELLRKYCMGDRPVQFEVISDQSVNFGFSKFPWVNYQDGNLNISIPVFSIHGNHDDPTGADALCALDVLSCAGFVNHFGRSMSVEKVDISPVLLQKGSTKLALYGLGSIPDERLYRMFVNKKVTMLRPKEDENSWFNLFVIHQNRSKHGNTNFIPEQFLDDFIDLVIWGHEHECKIGPIKNEQQLFYVSQPGSSVVTSLSPGEAVKKHVGLLRIKGRKMNMQKLPLRTVRRFFIEDVVLANHPNLFNPDNPKVTQAIQSFCLEKIEEMLDSAERERLGNPQQPGKPLIRLRVDYSGGFEPFNVLRFSQKFVDRVANPKDVIHFFRHREQKGKTGEEINFGMLITKPASEGATLRVEDLVKQYFQTAEKNVQLSLLTERGMGEAVQEFVDKEEKDAIEELVKYQLEKTQRFLKERHIDALEDKIDEEVRRFRESRQRNTNEEDDEVREAMSRARALRSQSETSTSAFSAEDLSFDTSEQTANDSDDSLSAVPSRGRGRGRGRRGARGQSSAPRGGSQRGRDTGLEITTRGRSSKATSSTSRNMSIIDAFRSTRQQPSRNVAPKNYSETIEVDDSDEDDIFPTNSRADQRWSGTTSSKRMSQSQTAKGVDFESDEDDDDDPFMSSSCPRRNRR

SEQ ID NO: 1222 - DNA, 94330 bp, Homo sapiens
  misc_feature (1)...(94330): n = A,T,C or G
ttttttttttttttttttggagacggagtctcgctctgtcgcccaggctggagtgcagtggcgggatctcggctcactgcaagtatagctagtcttaaaattaggttataaaaatcccgattttaacgttttctttctttttttttttttgacacggagtctcactctgttgcctaggctggagtgcagtggcgcgatcttggctcactgcagcctccgcctcctggtttcaagcaaaagcaattctcctgcctcagcctcccgagtagctaggactacagggtgtgccaccatgcccagctaatttttttgtatttttagtagagacagggtttcaccatgttggccaggatggtcttgatctcttgatcttgtgatctgcccaccttggcctcccaaaatgttggatggtgtgagccaccgtgttttctttttaaatattgctttggctcttatgattttcaactactaggatttttgcttatctatgttcgtgtgccataaaatgcaattctctccttattgcatgagttctcttacatgaggtgtctaaaatagtcatgctcctagaaacagagagtagaatggtggctgccaggatctggggcaagggtaaacgggaagtagttattcaatgagtataaagttttagttatacgagatgaataatttctagagatctgctgtacaatctagaatctctgcagttctagagatctacaagcgttgtgcctatagataaaaaaaatactatgaactaaagttttaacagggcagatctcatgttaagtgttcttcacacaataacaagaaatttgcacataagtatggaatcttacatggaaggggaatataattaatagatttagtggccaagcatggtggctcaagtctgtaatcccagcactttgggaggtcgagaccagcagattacttgaggccaggagtttgagaccagcctggccaacatagtgaaacccagtctctactaaaaacataaaaaattagctgggcatggtagcgcacgcctgtaatcccaactacttgggaggctgaggcatgagaatcactggaacctgggaggcagaggttgcagtgagctgagatcatgccagtgcactctagcctggacaacagtgagagtctgtctcaaaaagaaaaaaaacaaaaattgaaaaataaataaataaatttagttatagcctatgtacaacatatacttcatatgtggataaatggcaagcatatttaaaagtagatacaagtaaccaaattcaaaaaatataaactgcagctttaaaagcaaatgcagttgcttgtgctcctgatagtaattgttatgtcctcaaaccctactataaataaactacataaaaataatattaaagaaaatggaattttggttattatgatagacaaactggtggtatacagataatattcaaaaacaccacaggtaaaaagctgtgacatttgaacatgagctttctgggaacttaagaagatacactaaacatgcaccaaatgatgcattctttaatcaactttacaaatacatatcaaatactagtgtatggtgaagaggaaaggtggtagaatcagatagacaaacctccatcatgcgcacatggcatgacaatgggcaatccgtgtaagttctataaacctgatttccttttatacaatgattatctcagagagttgttgtgaggctcacatggtatcacacacgtgaagcacatacagcatagttggcccacagtgagcactcagttgttagctattaatattgtcacagaggtttggtgtaccacatcttatatatatataagaactttcatgaagatcagatgagactatttcattcataaaagatgactggaggacattgataaacacatagctttttaaaaaaacaatatgatttcgatgtatttcatattgatatttatttttaaagtattaaagaaattgacaaaataaataacaccatatgatttttacatttaaataacaaactagcctacaacaagatagatattatccctgatttacctatgagaaaaccgaggggtttttttttttgcccaaagtgacccacaggtggcactgaggatttgaactcagtttgtctcactcagagtttaatgctctgtgtaaccatccttctgtgcctccagggaatgatttcaggcatgtagatctgtgctttcaatggagtagccattagacaaacatagctgagaacttgaaatgtgactaaatccagatgtgctgtaaaatacaccctgtattttgaagacttactgcaaaaaaaagtaaaacatctcaaaaaattttaaatatatatctcatattttggatgtattgtcatatatatataaaattaatttcacctgtttttaatatggctcttacgattttcaactactaggatttttgcttatctatgtttgtgtgccataaaatgcaattctgtccttattgcatgagtcctcttatatgaggtatctaaaatagtcatgctaaaaacataaaattacatgaggcccatgtttctatgtgttggcactgatttagatcatttccacttaggttctgagaagtaaaattttggagtttcaaagggaaatttccaggaatttaaaacatcaatcagctacacttaatccttcttggtttactctcttctgaacttaataaagatagaccttaaatatcctttagagaaagcatttcatattgaacaaattgagtggtcatctagtaatcctacagatggactggagcatcttatgataaactaattatagcaaagacataatgatttggtgatattattttgtaggcagttgcataaattcctagagccattgcaggtagggtgaagatggtgtatgtgttgatcaggaatcaagagttgatccagagatttcattttggtatgggacataaatctcagtatagtctctgggcttcttctgatcatgattttccagcatagtgttagataacataatagatgtcaaataatacaaataaatgtcttcatattgtagtataaagactctaaatcccaccactgtggtaggctgtgggttggaaggctccctggaaaagcatatttaagattcataaaagcaaaggcaactagttccactttaggcctaagaatgacgctatgaatcttgaacagtcacaaaaattacctcttcctcaagcatatgttaatcaaaattaaacccttagttatgaaaaactcagattttattttttaataagtctttgtatagactttccaagattagagaaaattctgtttgtaaactgagctatttagccggcctaaactggaaagtagaagtaatcctttcaaagcacgattagtgactgccttctgtgcacagagcagtctagtgaatgctctggaaagtataaaggaagcagacaatacaaattctgccctcaggggtgggatttgtcttatgtgtagagtttgctctctagcatcagtgagtgagtgttgaggtctgaaaacaagggaatagacacatcttaggtccttattggaaacaagacttctttggctccatactttaatggaaagtttacatggaatcatgggtacaatccattctcaagtgagaaaggagccatcagctctgtgactttcaggctaagcaacctcattcagcagtctgcttggataaataaggtcttattctatcatcactgcctgtcagctgtatctgtcatttggtgccactaacttaggccagattaaacagaaagcaacctctgccacaaagcatctccctaggaagagatcacaacataaactaaagcactaactctcaagatcctgttgtcacgatgattcagttcatatattatctctgacttttctgagatgatctaataagttctaagcaaaaataaatatttaatctttgattaaataacattattacttagtctagggtgactgggttacgtaggatggcttgaaagagataagccttggtggacatcttaaaaatttaactgaagtaaagagcaactggtttagttcccttcccctggagtgttgtggtgttgagaagacaaaactttgggaacaatcacagaggggctagatagacaatgcaaaattgctgctggagagactgagtgagtagatgttaaataactaagtgcgtgctggatgaataatgttctggatccaagaaagacatacacaggtaaaaaatgaattcatgccttttgtgttgttcaaaacttgtactttatttttctcaaatatttttacttatgctttttgtcattatccacagtgttttttttttaaagcctgagccactttgtggttttagcctcaatataataatcatccccttactcttagactaattccttttcccctgtcactttgcctgtatactctgtaaaaatgaggaccttagaaaatcaacatttcctgtgaacttgagagactatacaagcagtgcccaaatcagtaggattaggcaggtaaaaccagttggatagcagatatattatgatctgttggacaaaggtatagttgtgtgcatgtctacaaggtcatcgtgattcgccattagcttaaggatcatgtaggttgaccagggtgaggtaggactatccacaggattgtgtaaattgtggtaggggatgcagtatacaatattcatgaattaaacacttagctaactgctttcctgaaaatggtctgtgttctaaaagacaaagatctaggttttttgctgttttttactttaacttatgaagattcaagtcactaatatgttacttgctctggtttaaaatgaaagcaactggctatggtaaggtagagaagacagctgaattgtatcagaatatttaagacttttaaattaagttctgagttacctcaccttataaaaatatatgtcaatatactaaatacccaacaaagatccaggatgtgggatatttaaaaatacatttctcttgtatcagcaccaaaaataccagtttctgtacaacccgtgtcaagtttttaagtatacacacattaaaattatttctgataaaaaaatcacaaactccacagaaataattaaagatatatgcaaattactttcaaatacattttgacatcaaagtcaggcaattcacttggaagaatgttataatgaatgtcactgaatttttgtagtaagatgtttgacgtcaactttgattatgggaatacatctcacacacaggaggcactggtatttagaaacttaggaaaattactagaattgttaagactgaggtgaagaatttgtacagccttccacaatttcaaagaggtagtgatagatacttgtcctcctggcaatatcaaatgcagtttcttccaagttgtttttcagccctggtttgacgtaacggttcatcaggaggagttctagggtatccttgctgtctctgttcccagcagcaagatgcaagggggtcaagaggccttttgtttgggcattgatatctgcatcatgctgcagtaagaaagaagccactctggtattattccacttacaagcactgtgcaggggcgtccagccatccacagtcactgcatgaacatcggccccctgtgcaatgagctcctgaacaatatctaagtgtccactgtaggctgctcgatgaagaggggtatactcatcttcatccctagtgttcacgtgagtggccttttcagaaagcagtctccgcactgtggtaagctgagaagaaaaaaaagaaatctttcaactcaactcaaaccaaaacaataactaaaacaaaattgtcttgtggtgttagatttaattaagttgaataaaaacttacttgttagtagatgactttaaaatgaaaataatttaagatctctttttggggaggagaggactactgatttaagaatgaacaagttagtgttaactacactttgttgcttctaagaatgagattctctgaatatcaaaccatacatttactcctggtccaactaaggtttattgcataaaagcttcagtccaatgaataacataggctttctgtttaatattttatgtgttatctgtgaagaaaacataactgcttgatttttctgtaggattatcacaccaatatacacactgtatgaaacttttaaaaataaaacttttaacagaagaataaagtattaataaggaattctagggattcaagagctcaattccttctcaatacaaccttagaaacaaccttttaggttgtaattttcagtttgttctatgggcctctggttaaatgtggcatgctcttgggttaaaaagctatttaaaatgcgagacccttttagttattagtttactaacacagacatggggaaacttagtaaaatgaggtggaagtggccaagcagagggaataggcttttgatgttcattccacttcgatgatcctgggcaaattaatattcctgaatctcaatttcttactctataaaagagaagaatattacttatagggatacatgatgattaaataaaataatgtaataaggtacctggtatagttagtttttaataaatgttagtttccatcctctctttcctaaatgatcctaatgactttatataaatgattttaaaatatagatgattgcttgctatctttatagataattatccttaaacccccaaataatacctagcatgacactttgcagcttaatatgtgctttcatgtacattgtctcatttggtcctcacaatcaagagataggtatgatggccataacagtaaaggcaggtcttctggcttgaacccagtgcttttcctactgtcacacttccctctgtaatttttttttttacccgatttttttcagcagcccaaagaagcaatctgcttgggtctttttccatttttttttcttgcaatcgataccactcttcatttttgtcatcttgctcctcatcttcatcagaattgcctacccaaagactttgagtaccagtaggaataaggtgtccatgtgtttccaacaattcaagttggttaaagtgttcagaaaaatccaaggaattctcttggtctggtattccatcatcatttcctttttctttttccattttttactactattctaaataaaaagcatttcaaatgccaggatataaatctttctagagatgaattatgactgctttgttcatcaagatctgaaaacacaaatacaaaagttattagtaaaacaataattcaggctttatcaactgcatagataagtcttgcaaacatatacaattaaaccctgtctaaactcttgtttttctcatgatatcccttacatacactaaatactgatgctgacagaaaacaacaaactatgatctaatagtggtctaatgcttcttacttttgttgttttcttctaagtcaattatattattataactattatttttaatctactggtttaggtatgatggtgttatgctaacagtgatgaatgcttaaaggttttgaagtataactaatacaatgaagacaggtgcattcaagatttttataaactagacacacagataatatagagcagaaataaaaacttctaattcctaaaaatactatttcgaagaatcagggattcttgaagatggaatagcccccaaaaggacatctgttccaatctgtcatcggtacatatatctttatcacagcatctacactaattatcctatttctactttgataatttcaggcctaggaaaattcactgctttaaaaagtagtcctgtttattgataggcaactatagttcttagttgggtccttgttttcaactgaattttggctgtcattcattccttcattcaactaatatgaatagaatgtctggtatgtgccaacttctgggtactgggattcaataatgagcaagatccatgtcttcacctcaggaagcttactctagtgtaggtgactggcaaagacatcatgtgtctggcaaagacaacatgataagtactactacaagaccttgtctagaaaccatgagtatacaggaggttcataattcccctagtcctaagggattaaagaaggcttcctgaaggaactgatgtttattctgctaagctgccatattaatttttaaaccaatatcagcttaaagggttacacaacatataaaccttaatcaattaaagaaaaggagaataaccaatagataatttacaaatacgaattcccagcctctcaactctatttgttgaaatataatcagtctttcaaggctcttctctgatgttatctctttcattctttcttgatcctctcatttagatcgctttctgctttctactttttttggtgctacatttcacctctaactttgttcttgttttagccccttaaaagattataagctgaaagataaggaccacatttaacttatatttatctcctacttgtctatagaaggcattaagaagtatgtgtagcattacatttaattaaagtcttgtcacttgattttgcctggaatggattctgagaagttccagagttaggcataaccccaagatactgatttcttgatacctaatctcacaagtttaacagtatacaatcttaatgtggtattaaactttattactagtggcaatagcactaaactcaagtttaaatgtattactcatgtccagtaacttttctggtcctgttactttattgtaaaatgtaagaattttactaaagtattcctaaggccaatccggcttttcagtcacccaatcagagacacccttggaatcagagatatccaatcagaattgctctgtgttttattaattctcctggagcttccactttttctttgattctcaaactaattcctgaaccttgcaacacaaaaatgaccatacatcaattcattaaacacttaacagatgctaataaataaaagttcacttgtaattatatcaaatatagtaaccttataccacagatcttaccctctcccccaacatgcttttcctttcaataaaaactccctttatataaattttgagtttacagatccagatacaaaaaattatgtacaaaattttactggtatatttagtttaaaaagccaagcctaggcgcatctacccgacttacagttaagaaacaaaactgatgacttgatgatgatattcctgatattccatcaggaatgtcagggtatgtttcctaacttaaagggcatatcctattttgagagagatccgaactatgtcaactccttacaaacaactcagtgataggcggggctataaaccttactggtgaaggaggttcagatagattaaaacaacttgccctagatcaaggacccttcaatggaactgaaagggcagacgttctaattcaaaagttctacattatttttcgctgcactatacatcttactgctctcagcacaaagcagtgcagatgtgctgaactcaaggacctaggggcgacacctgtagagggtctggcgactgggagggagggagaggggatccagctccggcactctgccaccagccgggagctcacaggcccgtgagctccgcctgcggccttccaaacagccaagagcggagaagcggcttcggtcctacctggggaccacgaagcggcctgacctgcagggctcggcctgtgtccacaggctacccacccccacgggctcaggagttcttagatggcgccggtccatcaaaaagcgaggtccgggacagggaataacaacccacctgacagaagggaaaatcgccgccttgcatctcacttccgggttcgtctcctagcctgctcaggattggctcctgcgtgagggcggggcctcgccgctactttacccgccccctcactgcgtgcggtagccaatgagagccgaactggacttgaagcatctacgttatccataaagtgtcgcgagagaaacggacgccgttctctcccgcggaattcaggtttacggccctgcgggttctcagaggcaagttcagaccgtgttgttttcttttcacggatcctgccctttcttcccgaaaagaagacagccttgggtcgcgattgtggggcttcgaagagtccagcagtggggtaatttaggaatcgcattcgtctcctgtttctgcaggttcccaggcggaagcccagagttaactggaacctcgggaagagcgggccgagtgggcaggggaggggtcctggcgggctcagcgttctgattccgaggttccctgcggtgagggcgtgttgaggcttggaatcccgacggaatctggagctccagatgtggtgggggttgtctcgcggtggcagccactcttccccaaacctggctattttcagtcatcctgctggtgcctaaaggtgttcctccgcagaccacgtgtttgtttatttacactcgctttaaacgcgggcccgttcccttttccaaactagccaggtcctttaaaaaaaatcgtggggtttgaataggaaatacaggattgcctctgttctccagagtaacctatgcgtgcaacttaaaaatatctgcacatctagagttgtttgtgtgttgaaccagaaccgtatgtgaccctttctgcctatttatttagcatacattaatttcccataagagcacgggaaaggaaaataggagtttaatcatcttggtgaaactaggaaacaggatgtacactggagatatattattttctatgctcagttcattaaaaaaaagtatagtgggtgcttagatgaaaatgagacttctaaatttgccagtctaattaagacgtctgtaccttgtgcagcgtaaatcatgttggttaaatacgtgcaggcttttaaaaaatgtgttttatgatgtaattttgtttttagaatttctagaatttggaatcgagtgcattttctgacatttgagtacagtacccaggggttcttggagaagaacctggtcccagaggagcttgactgaccataaaaatgagtactgcagatgcactgtaagcacctgacttctggaatcccttgttatttggggtttctaaagctcgtcaactgtgatcacagtaaaagaaaacttatttaataagcagtaaataaggaacctgtttatgaacagaaatattagtcatcaaaaagggtatttggaatgttttaaatatttatctgtttgttaactggaagctaatatgcagctatagattggagtcttgcagtaatttgatatattgatatagtattgtttatgttcttaggcttcatcttaaattattgaagtgataaatattcttgaattttcctgacaaattcttattagtcaatgcagttctgtttaagatttttagagtaaattcctctagtattaaataagctggaaatgaatttgaatggaatgggaataaataaaaggactgtaaaagttatgtgcactttgggaggccgaggctagcgggatcatctgaggtcaggatttggagaccagcctgaccaacatggtgaaaccccgtctctactaaaaatacaaaattagccaggcgtggtggcgcatgcctgtaatcccagctactcaggaggctgaggcaggagtatcatttgaacccgagaggcggaggttgcagtgagccgagatcgtaaaaaaaaaaagttatgtgggaaagactttagacttggagtcttttaccctagtttcaagtccttggaccctactagctgtgtgaccttgggcaagtcagcagttctctgagccttgcctcaattttgccattggtataattggaataattatacctttttcagattaattttgaggcttaaatgagagaattcatgagaaaatacttcataaattgctacagaaacatgtagtattatgatttgaaaagtattctgacctaccttcttggatatatcagtgagaactgtgtgcatatcatttttgaagtttttgaagagaaatcgtttgtggaaatatcttttgtttgtaaagatttgaattttggagatatatacagagattttttaaaaattcattgtggtttattgaaaatagcctgagttttcatcatgggttttagtcctgtttctgtcactagttatgtgataaagcagttaatttctctgggtttagccttctcatttgtcagagataataatgcctgactctttatctgtgagggttgagatgagatcataaaaataaaagtatttcatacaattaaatttagtgtaagagtattaataactattacattgctacttcacattaaagtacctttgaatattaccaaattcaaattgaaacaattctgtgttggccaactttattaatgaaatctaactctgtagagagtagagtcatgcaagtgtcttcaaggccctgaatgtaaattattgcatattagtataaaattgactcataaacttagaggaaggctttttaaattaacttcgattttcctggaagagtacgaagtcagataaataacaagtttatttatctgaggaaaacaagcaaacttttgggcctgggttacatgagtttgtaaaactggttataacaaggttataaatttttgaagcagttatagaaccttgtaaagatttatgtacatttgttctgtattgaactagtggttaggaaaactgtaatgttaatgataacgttgaatacttcagattttcagatgaactctaaggctaaaaaaaatgattttactctataactgttattatttattttataagtttgtctcaatttgtttgaatatcctttaatgaattattaatatattgaaatgtttcttctttcttaatatagtgatgatgaaaacacatttaaaatattagttgcaacagatattcatcttggatttatggagaaagatgcagtcagaggaaatgatacgtttgtaacactcgatgaaattttaagacttgcccaggaaaatgaagtgagtgtggtttgtatttgtgcactatctaccatattcccttggttaacaagttatttttccttctaaagttagagatttgttttataagctcaggtgcttaccttgcctgcttgaatatcaatatactgaaagctcaaagccgattttgtatgctttgtgtcttaaattcaagtaggagctacttttgtaaatagtctgttaaaatttacaaatgtttttggggtgtttactgaatgcaggatcctgtggcagtgtctattcgaaatgtaaggtgactgtcaaagcttctgctttcagataacgtagaagaaaactggtgtgaaagacaaatatccacaatccacagatgcaaggttgtatgtgataggagccctaagaaaattctaaataacatttcctttgagtttagaggcagaaaaaatcacgtttagattatagcaagatgagtttaatgaagaaggttgtgtttaacttgggctttggaggaagggtagacttttggccagtggggagcatagagaatgtacatccatgtgaagcaggagtgaggaaacccgtgagacagtataaggtatgttaggggccctgtagtcaatttggctcaccagcaggtcatagttagcaagcatgctgagagactagaaggaaggatttgagctgcattaatgaggacttcaaatatcagattgagaaatttgtatccagttcaagagaaagtcttttggcagcggagtataataccatgaattggagaccagttagaggctttttttgaagtattgaccttagggatggaaaagaggaaatgaatgcaagggatactgcaaaaagaggatttgtgtactttggttagttgtagcggggtggggatgagggcaaagggatgacagtgactctgaagtgtgtggagtttgggtgaatagttgtaccaaaaatagaaataggtagataaggaagaggtactgcttcatgtgggaaggtgacaaattctttgtttgatttcgacaaacttagagttggagactgcaatgggacattcagggaaaaatttcagcaggcagttaacacgccagcccaggagagagttggagaataaatgtaaaaattgacttgcaaattaacaccgccagccttgacttttctggagagttctcttaagtttatctgctaggtccttagttcttcctcccaaatatatatggttcctctctactactcttttcacactaataaacttagtccaaaacgatcacatttcacatggcctgcaggaggtccccttccatctttctgcttctattcttttctgctacatctactcagcatagcagccaaagtgaacttttaaaataataaatcagatcatggcactctgttgcctaaaattttccaagtgtccttccattgaatctagtataaaattcaaactacaaggttcgacttgatcttgacccctgccatgaaacttcatctcctactactctctgcctgatttacagtgctacatccacaccggcatgttctactctgaggcccttgcacatctagttctttctgcttggagcacattgatcttggtggggccgacttctgagagttcaagtcttacctttttggagacgtcttccctgatacttccaagcactgttttatcacattactctgctttttttcatagcatatttttaatagcactatctgaaataatttattgaattatttacttgtttattgtctgttgtcttcactagaaggaaaactccatgagagtggaaatcttttgtttgttcatgctgtatcttagtgcttagaaagaatcagaaagcagtgggtatacatattttaaatttcttaattaagtgaggcaatggctggattctttcttttattttaggttcaggggtacatgtgcaggtttgttacataggtaaactcatatgacagggattgttgtacagattattttggcacccaggtattaatcctagtacccattcattatttttcctgatcctctccctcctcctatcatctgctctctggtaggtcccagtgtctgttgttcccctctttgtgtccatgtcttctcatcatttagctcccacttacaagtatttgatttttctgttcctccattagtttgctaaggatgatggcctccagctccatccgtgtccctgcaaaggacattatctggttctttttaatagctgcatagtattccatggtttatatgtaccacattttctttatccagtctaccattgatgggcatttaggttgattccatgtctttgctattgtgaatagtactgcagtgaacatatgtgtgctgtgtctttgtggtagaatgatttatattcctttgggtatataccaagtaatggaattgctgggtcaaatggtagttccatttttagctctttgaagaatcgtcacactgctttccacaatggttgaaccagtttacacccccatcaacagtgtataagtgttcccttttctccgtaatttcaccagcatctgttcttttttgacttttcaataatagaatgtaaggtgcatttttccttccttgaaggcaaaaaaacttgtggccaaaggaggtctgtttcctgccagagaatcctgtatgtgctctttcttttttaactcttgagccctaaaacagaatcttctcctgagtgtaagctacttaattctactttgccctttccttcacttctgcttctactgtttctcttccctgcgtcccttaattgtaactgttccaccccccataaccccaggtagggacttctagatgtgtattatatttactcattctcttgatttgtatttagtatttcttattattgaatctaaagtcttcctgacttttaagtcccttattatgtgggcccatgcccactaaccagtcttagttctgttccctagtttcttggagtctttttttaaaaaaactttttattttgaaacaacatcagtctcacagaaaagttggcaagaatagcgcatagaattccttacccgtcacccaggttttctaacattttgtcacatttgctttatcttctctttacaaatacacacgatttttttcctgaaccatttgagagtaaaccgcatgtataatcatagaaaaccagaaaattagtattgattcagtgctattatataatgttaagatgttgccaattgtccctgtaatgtctgttacagcactttggaggctggttggtggtgtccaggatccagtccaggtttacatattgcatttagttgccatgtctctttgtctcctttaatctggtacattttcctgcatctgccttgcctttgtttttcatgaccctaatattttgaagagtacacaggccagttattttatagaatcttcctcaaattggctataagtggtatttcctcatgattaggttcagattctgcactttcggcaagaataccacagaagtgagtcgtgttcttttcaatatttcctggagtcactgccagccagtttaaaaaatttttttaaatgtttgaatgatggcaaaatatattaaatacataacataaaatttcccttgttaaccatttttaagtgtatagtacagtagtgttaaatatgttcatattgctgtgcaaccaatctccagaattactctcatcttgcaaaaatgacacccattaagcaacaacttcttttcgccccagtatgtttttcatttggtttgttgtttttgttttgtttcttccatgcctttgattgagatcattttcttccttttactcaaatagtgttcattctggaaggcctagcttaaacctcacatttttattaaagttatcctaactaccatacgcacagtgatctataccttgtattcttttgtgtgattaagaacttaagtttctttaggtgcatcgtatacgtcttgaaagcctgtgttagactttttctgtatgatttccctccttcactgaagttattcctagaattctcttcctcacaatcatttatctttcctagtgcaactaacatgccaccatgttagttcattccttctagactttctgtcctcaggcgaattgtcctcccttgagttcaaattcatcgtagtgtcatctctgctgctggttgcttacgtgtccattctagtgcaccccagagtttgacttatgtttaaatgtataacagtttgcctcttccattagagtttgaacatatttaggatagggatcatattttattcatcattgtatcctcaggactcagtagagggtcttgcatagagtcagtatttaatgagggcagggatataatctattttgtagattgctattttttgagcttctagaacctgtaggaattctgtaaataaatgctgaatgaattaaatgaatgatttggattgaatttggtatctcttcccatacgttctgttaaagtgctaagtttatgtttgattcaaataatagaaaaaatatgatcaccttgtgtggcctgaatcagagacttggtgtaattggaagatggcttttttgaagatagcttagtcagctaaattagaaccagattaattaccagattgaaagtccctttgaataaataaaatgtaaatttttaagttgccatatataatagtgtcttttgtgagtttttttttatctctttcatctgtagtttacaaaaattttacctgtaaaacatactaattttaacacctttttctgttgatcaggtggattttattttgttaggtggtgatctttttcatgaaaataagccctcaaggaaaacattacatacctgcctcgagttattaagaaaatattgtatgggtgatcggcctgtccagtttgaaattctcagtgatcagtcagtcaactttggttttagtaagtaagtatatttatttacttgagtgagtgattacttgtgtatggtatttgctgtataagacacgtaaacacacaactgttttgccttccatataagctattttcttagtaaatatcattctttgaatttttttgtacatcattgtattaatttatattttcctaattaatagtggaactgacccagctactcgggaagctgaggtgggaggattacttgagccccagaagcagaggttgcagtgagccaaaattgtgccattgcactccagcctaggtgatagagcaagactccatctcaaaaaaaaaaaaaaaatacatggtgggactgaatatcttctcaggtttatattgtacattttggtatcctctcctgttcatatcctctgcctattttaaaaattgagatttttttgtttgtttttctacctgaattgcagaagttacttatatattctaattagtaaacctttgtgatacatatattttttcccaatcaatggcttgtcttttgactttgtttatggactcttgttgacagaaatatttaatttttatgtagttaaatctattggtttttctttttttccatttgtgcctttgggactatttatgatatttgtcaatccctatattataaaaatatcatcatgtgttttttctttttttttttgatggagtcttgctctgttgcccaggctggagtacagtggcatgagcttggctcactgcaacctctgcctcctgggttcaagcaattctccctgccttagcctcctgagtagctgggattacaggcgagtagttgggattacaggtgagtagctgggattacaggcgcccatcaccacgcccggcaaattttttgtatttttagtagagacagggttttgccatgttggccaggctggtcttgaactccagacctcaggtaatccacctgccttggcctcccaaagtgctgggattatagacgcaagctaccgcttctggcccatcatgtcttaaacattgtacaggatctcacattgcatttagtagaaacgtttccttaatttcttcagcccatgtcaggttttctgtctttccttgtctttcatgaccctgatacttataaagaggtcaggtattttgtagaacgtccctcaatttggtattttctcctgctttctatgattagattgggattacaggttttgggggagaatattcaagaagtgaagtaccctttcagtcgcatcatatcaggaggtgcgtgacatcaacctgatttatcactggtgattttaaccttgatcacttggttaagctggtctctgccaggtttctccagtgtaaagtcattattttttcctttccatatgctgttggttagaattgagtctctgagtccagcttactctcaaagggcagggagttaagtttccacttctgatggacataagttaaaaccaccaaagtaattaataaatattttagggtagatattttgaggctgtgcgacttttctgttcctccttaaatttgttcattaattttagattcatcagtggatcttacctacaacagttataactgtgatattctaattgtgattttccatttcctatattctttctacatgtattaattgggattcttttgtaaggaagatttgtcccttgtcccacatttgtttattcaattgtctatatcagtagaaacccatttttttttcctttgggttataatttattactatcataatttacttgtggcttaaattgttccagctttagccattgggctccttttgagattggctcctgtatccttttgatatatcccaccttttcttctgattttttactttgtctttcttgtcttcagactcagccatttcttcaaggaaccctggttccttttggagaatggtatttggaaaccaagatctggatgttacatgtgcacattactattgtattgttgcttctaggctctcactggacagagctaagaaaaatatgtgtacatactaacccatgagaatagacatactcatgtttatttatttatttatttatttatttaatttttgcttttgagacagggtctggctctctttcctatgctgtagtgcagtggcatgatcatagctcactgcagcctcaacctcctgggttcaagccatcttcctgcctcagcctcccaagtagctgggactatatgcatgtgccactgtattagtccgttttcatgctgctgataaagacatacccgccaagactgggcagttcacaaaagaaagaggtttaatggactttcagttccacctggctggggcggcttcacaatcgtggctgaaggcaagaggagcaagtcacgtcttacatggatgatggcaggcaaagagagaggttgtgctgggaaactcccatttttaaaaccatcagatctctttagacttattcactatcaccagaacagcacaggaaaggcctgcccccatgattcaattatctcccacgaggcccctcccataacacgtgggaattatgggagctacaagatgaaatttgggtggggacacagagtcaaagcatatcagccaccacacccagctaatttttaagaaattatttttggtagagatggggtctcactgtgttgcccagctggtcctgggcccaagcaatcctcctgccttagcttctcaaagtgctgtgattacacttgtgagccaccatgcccagcccatatttatttcttatttagtttttaaagtgtgactttatattgggaggtaaatttttttttgagattttgtccacatgaaaatgtttatgttcactttccccttgattgatagtttggctgcatatataattgagttttaaaagatttgtataatactttgtccttgtttttcaaaattgtgatcaatgtctttaccctccttctattcaaatctaaaacttgggacattttttattttttattttttatttttgagaaggagtcttactgtcacccaagctggagtgcagaggcacgatcttggctcactgcaacctccacctcccaggttcaagcagttcttctgcctcagcctcctgagtagctgggactacaagtgtgcaccaccatgcccagctaatttttttatgcgtttttagtagagacggggtttcaccaggttggtgaggctggtcttgaactcctgacctcaagtgatcctcccgacttggcctccgaaagtgttgagattataggcgtgagccaccacacccagccgggacattttttaacttcagtattttctttctttcatcttatttttaaattgcattctgttttgaaaactgtttccccaccctatatacatgtttacctatttctttgctcactgttgttccttgtatttcatttcttttgtgtagattcagtttccttctttctgaagcacagttttcagtagttttttcatggagtgtcagtgagtggtaaactcttattttttgttgctgttgaggagtctactgttaggtgagttgctagaaagtttagcatagtgattaagagcatgggttccggtataaaacagctggagttcaaatcctggttctgtcatttagtagttgtaaaattatgttagtcacttaactactctaccttagttctgtccttcataacatgggaaagaaatgtgccaatcttacagagttgagaagattgagatgataagaaaaatggctagagtagtgaccagcataaagacaatacttgggtaacttaagattttctcattgttcttaacatgttgcagtcttatttagctgtggatttaattctgtttgttccgcgtgggctttatcatatattctaatgtaatattgtttttcagcaacttggggaaattcccattctattcattatgttttcaaatattgtttcctttctctttctgaatatcatttatatagcatactattaaaaaaaatattgcccataactttacctctttgtgtttcattttggataatttaatcttccagttcacagttcatgtagaaaataggcaaagatagggaaatcccaaaaaagaagactactaaggagttagtagccaattagatttgaagtataacaatgctacaataattgaaaatgtggtatggctcatgaattagtagataggtaagtgaaagagaatagaaactctagaaatagcctcaaatacatgtaggaattgagtatttgatgaaggtcaccatctcacaatgtaggggaaataatggattcagtaaaactgctaggagaaactgttacacatattttaaaaatctaggtgtggggaaggcttctaagtatgacacaagacccagaagtcataaaagattcatacatttgtctttgcaaaaataaatttctgcatgccaaaaactgcctgaagcaaagccagaagtcacagttcaatcaggaagaatatttgcaaccaattgcaaattaaggttgaattccccaataagcagttctttcaagacaataaaattcatgagttagtaataaataaagaatatggacatacttcacagaaaaggaaataacatgacatttaacttttatttttttttttcgagacagagtcttgctttgtcgcccaggttggagagcagtggcgcgatctcggcttactgcaacctctgcctcccagattcaagcacttgtcctgcctcagtctcccaagtagctgggactacaggcatgtgccaccatgcacggctaatttttgtgtttttagtagagacagggtttcaccatgttggccaggctcatctcgaactcctgacctcaggtgatctgcccacctcggcctcccaaagtgctgggattacagatgtgagccaccgcatccggcctaaacctatttttaaaagtttgatttcactcataagaaaaagacagagctatactgaaatatttttctcctataaggttggcataggtctgtgactctcaatcctgagtgcacagtacagttacctaagaacctttgaaaatatggatggccccctctccaggccaactaacttagagtctctccaagtatgtcatgggcattggcatttcttgaaagatccccaagataattccaacatgctgctagcattaagaactgctagcatagatttaagagctggatgacctactgtgttagtgaggtaggggaaaactgtccctcttgtgcactgccattgcattatgtgtaaatctctatggtgggaaattggcagcacctatcaaaattacaaatacatgtactctttgacctaacaattcccttccaggtattcctttacaggtcgactcaccagggcaacaagattactcgctgtagaagattactttgtacaagattactgactgtagcattgtttgtaaaacaagactgccaagaatctaaatgtccattggtagggaactgctcaaacacattgtggtgatccatgcaatggagtactgtgtggctgacagagcagaagaaaggtcttcatgtactgatgtggaatgatttctaaaatatgttgagtgataaaagcaggatgcagaaatgtatatttttctatcatttatgtaaggagaaagaaaaatctgtttatttgtgtggataggtataggatccttttgaaagatgcactagaaattgctaacattatttgcctctgagaagaggagctggatggctgggggcaggggctgacaggagactttaatttgaacaggcaataagtgatagagctgggagttttaatctacctctttgggattctaaagtatatggattttcttccctccccccactacgaataaaaaccatatgctaagtttttaaaattttgaaggcttattaacttttcattaattagatatactactcatacataccacaagcactgtttattatagttggggtttctttaaaatgtagtgctttgagatattttcaaactaattgaaatgaattgtcgcctatgattttattttttaaagctctaaactagtggtcatatgccaatgtagattatgcagtttgcctatgattgcattaatattttggaggagaatcttagggaaaacagcttttgtcccgtatggaaattttaagtaactttttttttttaaggtttccatgggtgaactatcaagatggcaacctcaacatttcaattccagtgtttagtattcatggcaatcatgacgatcccacaggggtaattattgttttcttagagtttgttggaattttggaaatgatcagtttagtttgtctgtggaaagcatgccttccctttttctcattgtgtagtcaaattgagtcaaaagtcaagttgacttttcacattcatacaagcttttatactgctttttagattttttaaaaatctgaaataagaattggtgtatgagctatgcttttatttcattaatactgatgttaacaataagaagccaggagtaggagtgaacacctaacatctgtatagtggtttacagtttgtcagtgtttttataactatcttataaaatctcacttttaggaaatgattgttcaagaccatctttaaatctaaattagattatcttattacctgtttgatatggaagtaagactagagatcctacaagtattttttcattttatctggtcattaatattatgaatcactgattatctatggtcttttttccccaggctttaagacggttgcttaatattacaaagcatttatctcatggctaatttttatttttttgtggccaagacatcataagttttgatgagatattaaccttgcctttggcatgtgattccagttgctgtaggtgatttgtagtacaaaaatgtagcaaatacttttactattgtaattttgttttgagaagacactatcctcatctatgtttttgtaagtagaatatggagtatgcttttaacaggtgatacgatattcatgcagatacctacttttacatacacactaacattctttgaaattattttgcataggcagatgcactttgtgccttggacattttaagttgtgctggatttgtaaatcactttggacgttcaatgtctgtggagaagatagacattagtccggttttgcttcaaaaaggaagcacaaagattgcgctatatggtttaggtaagacagttttattttactgtttatgtccatgtgtgattctttaaacaattgagaaatttggagataagtttgtatctgtttggaaaaaatggggcaaaccttattctttattggtgactataaaaaatgatggatggttttggtaaaaatttttggtgaaaaaatgtcttttcgttactatttattattttgggttttttttagactcaggtgtagaatcctgaatgttagaattatagaataattagcaaaactgcactttgatatcttggaagtctttgaaaggtctaatgcttcactgtacaataccgctagcttataattttgtgcagctttcataatacctctggcaagtagaaaagcatcatggttatttatattttagagataaggaaaatgaaatctggatgttatatctgattctgcaagtgaaagagcaggaagtgaaatatacttttcttaaaaaagctattaacagttgttttaatcactgcagtgttattagggatcatatctccagaaaattgcctttcctcctccattcagactaaggacagattccattatgcctcagtcaccaccagaagcacatctctccagtcatccattttctcccaaactcttatcttatcctgttctattataccttccttaactggactctgtctccaccctgcacccctccctgtcccccagctcttcattataaactctagaactctttttataattatcagattcctcattattatcagtctcttctctgaatgttacctccactttctaaccttcagtgaagcccagctgtcccctgaggttcctgtgtcccatgcagttctcttacccctgggcttttggaaagaagcggggatcactgttctccttgctccacccactgcttccttttctgcctgcaaacacactgttccctttaagcttctgccatctggctaaaccgcattgctttttctctcagactttttacctacttacctaccttcaattttgccagtgtttttagtgtttcaacactcaagtagattaatcttctaatgccttgggctttgtgtgccttgacttttttgtctccagttacatgttctacattccacctcagccatgtattccattggccactcctgtagcattctccttgggagctaggccacttctaacttctagacttctacattgttggcttttcttctgagaccctctctaatccgtatataaagtagcagtgttgtccacccttttaattccatagtgttaattcgccatcttagcatcctggctttttctccttttataatatttaatatttgtaactattttgttgacttgtttttgttagtttctttcactagatcaaggtgaacctgtggagtatgagaattgtttgaaagtcattgagttatttaaaaagcacaatatattaaaacaatgtaagaatattgtttttaaatacacttttatcatcccttttaatatttatttctgcacatgttataatgtatatattagatcaaaagtatatataatttataacaaagggatggtgaaaaatagtattactagaagttttaataagaattttaccatagaaaactcacatttttattctacattttgctggttttgaacatgtatatgtctgaaatggaaaatgtttttcaaatgcaactaactactgttatcaagaacctggaacaggccaggcgtgctggcacacgcctgtaatttcagcactttgggaggccaaggcaggtagatcacttgaggtccggagttcaagaccagcctgtccaacgtggcaaaaccccatctctactaaaagtgcaaaaattagccagacgtggtggtgcatgctgtaatcccagcaactcaggaggctgaggcacaagaatcccttgaacccaggaggtgaaggttgcagtgagctgagatcacaccactgcactccagcctgggcaatggagcaagactgtgtttagaaaagaaaagaaaagaaaaaaaaccctgaaacagctaggcatggtggcttatgcttgtaatcccagcactttgggaggctgaggcgagaggattgcttgagcccaggagtttgagaccagcctggacaacatagcaagaccctgtctcagttaaaaaaaaaagataaaaaaagaacctgcaacatacccacttataaattattccagaattcaaatatatctcccaacagtaaagtgaaatactttgagaaggacataatttagaagcaaaatagattcattttttaagccgaagtaagaaaacaatttaaaaataatgtaatgtccatttcaggatccattccagatgaaaggctctatcgaatgtttgtcaataaaaaagtaacaatgttgagaccaaaggaagatgagaactcttggtttaacttatttgtgattcatcagaacaggtaaaacttttctctgaaaaagtttgagccaagtgctgaggcttcccaaatctgtttctgagcttacctattttagtgaaatgcccttaatctttcaaggttgtcaatgcaagatcagacaaaacatagatttgctttgtgtgatttcattttgaaattgtttttagtatatattaatacctacaagaatatttgtaacataaggataaggcatacacatgaatactcctcaattcaacaaaaaggtagaatctttttgttggattatccattcctttatcccattccttttccctgatcccacctgcttccccctatcccaaagggaagcattattaattttgaattaattatttcattgcttttctttgctgtttaatcacatgtatactcatattatgctatatttacagccaacttatgttcagcattacattactgagatccattttgatgcttggatgtgtaatttatttttactgatgtgtacagttatgctttgcctcctgtcagtgaacaggagttttttgcttttataaaccttgctgttatgaacattcttagacatgtttcctgctacatatatgcaagtgttcttccaggatatacaaatatagctagattacctttcttttgttagtagttttaagaaatttaatctgttggcagggtataggattgattgaaaagaagacagacttgaagaagcaagatttattatctgatcactgcagtaaaaatgtgaggtggtgacagtgatggcaatgaaacagaaatgggagggacacaccggagaagttgtcagggaagaactcaaaggatttggggcctgattatataatttattacagttgtcccttggtatccacggggggtgttcggtccaggacctaaaatcctgggatgctgaaatcccttgaataaaatggtatagcatttgcatataacctacatatatcctcctatgtactttaaatcatctctagattacttgtaatacctgatacaatgtaaatactgtttaaatagttgttatactgtattgctttaaaaatttatatttttcgttgttattttttattgtttttttcctgaatatttcgatctttagttggttgaatccacgaatctgccaatacagagggccagctatatttattgaacacatttattgaatgcagactactctgtgcattcagtgaatgcagacttaggttaaatactcggtaaaagaaagggtttaagaggctgacttgtgttaccttatgtgtgagttcttgaataaactgtgagtttcaaaggaggggcaggccagagtttagatatgtgtgtggtcttcatataactttgcaccactgggatttgttccttctcttccatagagcttcccaggtctaccatttttttgtactatgccaaagtagggatgatgagttgaaaggaaaactcataagtaattctaagaatttaagccaaatgaaaggtagaatagcagcattggtaaggggaatgggtagtcaccatatgatgttgatttttctcattgcccccctcatcatttgattaagggaatgtgtaacagctttctctgctgtaaagttcccattttctacttttcaattaataaatatttttgggaaaatactttgagactatgcaaatatcctgtttcaccttaaacttttactcgctaattttagcatccatgggtgatcttatttccagtaattaatactgtggtattttaattgtaagttttgatttccttcattctttctatatttattaatggaattcttctgtaaggaaaatttgtcccttcttctctatttacttacttatttatgtcattatggacttgaagatccagtactatcagttttttggttgctactgttcctctgattgttgcagctttgaccattgcattctcttttatgttggcctctgtgtcctttcaatgtcttcccacctgttttgaggtcatgaccttagttagctttttggcacctcaagatggtctaggctcttggctcttgtaatggcaaaaatcacaattacttttgcaccaacctgatattttcctacctagccctggaatcaaccatttctccaaggtgctctgattctttttattggagagtggtattcagaaatccacaaatgcgtactaggtgtgcttactgctaccagggcttgctcagcactctgaatgaacagagttatgggaatagatatatgtgtatatagtaacccatgcatacatacatgtctatatatgtgcttaaaaaaccaatgataagttcagactgattctaatccagccctacaaggtccatttttgtcttctccctttccttacttgtgacttctttgtctaacagaagcctggatcatattataaatatatatgtttacttattttttcaatcttggtttaattatatttccaatcctggtataatttgaaattataaagtaatttcaaaattgctaactcatacccctgtgcaaaacaactttcccaactaggttacaatgtttgtgtaagttattttagtctttagcctttctgtatctagttgaaacctaatttttcaaacttacttagctcattttctccccacccccttcactgtggttatgtggttctttggtaatgctgttagattcatttgtcaccctgtgcattctcaagatacttctgctttcatatttaaaacaaagaaggttttcacagattgggtgagaatcttgagccttctgcattttgccttatttcccatttgtttctctacatcaactgtttttttctcttgtttcaaagaagaaagaatctgaatttggagatgacttggtcatgcaaaatctttcaacaaggatattgtgatcacttctaggtcacaaattacagtcagcctaccagcatcatcctcccttcttcttccgggaaagaaccagcactcaatgaaggcacaatggcatcatgttgtatttgggaattattctgcttttctttagtagttgtgataatctcataccttagatgtatgttttttacataaaaacattcctggatacacaagcctgtatattctgtcttccctgcatttattctgcttagcccttctgttctccttgctgttccttgaattcactgaacacattcccactttagcaccatctgctcttctactgcttaggactttctctctccgcgtactgatgcttcatctcagttctctgctcatttgatgctagtcagagaggtcttcctgactaccctgtgtatgtagagaggagtatggcacttctatgtcacttttccctttatttttctttacagcacctatcactaactgacaagttatacatgtgcatacttacacacatgcatatacatcttgtattagagattgagtatcccttatctgaaatgcttgggaccagaagtgtttaagattttggattttttggattttggaatatttgcacatatgttggggatggaacccaagtctaaacatgaaatttgtttacattttatatataccttatacacatggccttaagttaattttatacatgttttaaaataattttgtgcatgaaacaaagtttgtgttaagtatttatgtgtggaatttaccacttgtggtgccatgttggcacttaaaatattttggattttggattttcagattagggactcaacctgcattgcttgtttcccacactagaacaaggactttgttcactgctgtgtcttccatatctagaagaagcctgggacatctgacataaagtagacagtgtttgggtaacagtatttgttgggtgaatggaagaatattggtttggattaaatgaatgcttggttaaactatgtgaacacttttacttgaatctccaatgatgtaagttaatattagggaaaactattccttcttgtcttctatcaccttgcatttcatgtatctttaaataataactgatataggtataataccatagtttgcatatcacttgtttatttaatatttgatattgaaaactcttagcacttatgtgagattgatgtttttactcccattatatttattagtaaaaagataatgttaagaaattactggacatatttatacttacttgcattttctgtgtgttttctctagtatatagttagactgatttatagatttctactattgatagaattcatgcttttctgattgaccaaaggggaaatccttcctatgtaaaacctttcatgatcttcctccaaatatagaattgactgctttctcttttcgggtttccacttgtctgtgtccaataagtttgtaaagctctcaaggtcaggagttagcattgatgatctttacattcccaatcctgtgcacactttctggtacatagaaggatgcaataaaatctttagtgaatggagaaagaaagatctgtatagacttcaataatatgaaatttttctaatcaccgaatttatatttttcaaaatcttgatacaggagtaaacatggaagtactaacttcattccagaacaatttttggatgacttcattgatcttgttatctggggccatgaacatgagtgtaaaatagctccaaccaaaaatgaacaacagctgttttatatctcacaacctggaagctcagtggttacttctctttccccaggagaagctgtaaagaagtgagtgttatatattttgagccaatttttaagaaatctttgctataataactaatcatctcataggtttaaggcctatgttaaggttaccgctaactggcagtattgtcatttatatgatagctttatttttgaaaattgatcattctgtgtagtcttattgtttttccagattttaagccattttcaaaaagagagcatccaattggtgttattttgctgctcattaggcaaattcaagatgcacatttttattatatttcaaggtagatgttttaggttgatgattactaatttcacaaagttcattataaaaaattatcctaaaaccatttaattgaaaattttctgattataagtgcagtataatagatctcatttttaaaacatttttgggggaatgatatgattgtaagaagtagttaacagtgattaaactcaatttttattatgggttttatcttttgaatcacttgagttctgattgttacaatgataatagggttaaagaatatggtagtagaatctatgttggttggttttttttcttcatgagtccactgcaaaatcattttgtctatatgtgtacatgtatgtacatatacataggtatatagatgtaatactatagtctacatatgctaccatcatagtcctgttaacatttttttatgcttattatgtctatcttacaagactgatcagacagggataataatggatgagttgattttactctggggaaggaaaatgtctaccatcttttcctgtgatgataacattaaggttaaattagcagaaacatttatttttaagagtatgattttataaagaagcatttttagaaactaagaaatatgaaagctttcgtatgcacatcaccctgaggaaatttacactgtgactcggtgttcatttctctccacttcagacatgttggtttgctgcgtattaaagggaggaagatgaatatgcataaaattcctcttcacacagtgcggcagtttttcatggaggatattgttctagctaatcatccagacatttttaacccagataatcctaaagtaacccaagccatacaaagcttctgtttggagaaggtaattctttttgataaagtcaatgagatctactttagttgaagaattattcaccttcaattaagtaatttaatagagtagagggaagcctttatgttgattacattctcatgaagcctgtaaggacactgttcttcagtgaatgtgtttaattgtgtccaagatttttttttttaagtcattgagagagaggaatactggatgttaaaaaaaattaaatctctctcctagtttctttcttccttttcaaaaacataatacataatcttttctcctttttaatcctgatttgatgatttgttcattttatttatgaaagcaggcagtaactttgattgaggaatgggagactatcgtgtgtgagaaaagccttagcttctaataatctgtattaggcgtccctttcaccctgaaagctaccccaaatgaaatgtgaaaaatgtgtttgctatccaccctattgctgcaatgtaagtcccaaacctccctctctatgcacattgccacccctaaatctctagaaaatttcagccactactaaggttgggtggattaatgcatttaataatatgtggtttgacagcttaattagcatcacttgctgacgctcagttcttaactctgtgtcagctgtcctactatgttttcttttcatgaaaaatcaggtaacatagtaacaatgataataattatgaccagtgatacttactgatttactgtatgtgatgtgcactgttgacagcatttaatctagccaacaatactatatgtgagtagtttctaccatctatagtttagaggaactgaaccttagataaggtgactcattcagtgtcacagctttttgagcagtgtgtagctcacgtaaccaaaagtgtacgcttgtttcaagatgattgactctagaaactcaaacatagattaagattctggcatccctaaatccaatctctcaagccaaagagatagaaaatgcattaattgcttttgcattgattgatccaggcctgagtcatgtgcccttccctggagtcagacctgggtttttcaactttggcttagttgacattttgtactaataattctttgttgtgggaggcagttctgtgcactctgggatgtttagcagtattctccctggtttgtacccactagatgccagtagtaccccttctaactggtcgtgatgatcaaaaatgtttacagaccttgccaaatgtccttagagaagcaaagtcacctctggttgaggtctactgtatgaacttcacctaaatcctgtgggctttggtgacatgaatccagagaggaaagtagacgctggtgacacaaagtaatagaggttcattttaaacaccaggtgtgcacataactttctgttatctctgtattttatgtacatttctgttattgtacttagttaagttatattattttttataagcatgtgagtgtcttctgaactctttgaggacaggacccatatcttacttttctgtctcagcacttgacctagtacctggcaaaatgatgctctataaatgcttgttggattgaaataattgacctaggagatcatattcttatagattttctctgtgctgtctgatatgtattcactagcacatgtggctgtttacatttaattatttacatttaaatttaaaattcagtttctcacttgtactagccacatttcaagtactctatatccacatatggttttggcaaccatattgaatatgcacatagaaaaaattattgcagaaaactcttttggacttcattgttacagacagtttaaaggacaagattataaagtcttagatgtgaaagaaatctgaggacaaaaacacttgttctgtattgttcttgagatcaggaccaagttataggaaggcagtttttgttccaatacaagaactttctaagaactagaattgttcagctatgaagttggccatctggagatatctaatcactgtgcacacagccatttatgaaaataatctagtgctgtctccttgtaacttggttttacccttaagaacaatatagaacaagtgcttttgtcttcagaactctttcaagtctaagatgttataatcttatcctctcagagtatgagacaactccacatatttgaaaacatcagtcttattttcttttaccttgaactcttccaagataaataatctaaagtccttgcttattgatccctaaatcttctggtgagtctcccatggatcatatgactgcaaaaactagacttacttggttttaagttggtaagctgaggaaagccttattgaaacatgagtagtaatattttaagttttattctaaaagaattattttagagattgaaaaattatgaagaactttcatgaaaggaaaacattaaggaatagtattaaaggagcattacaagaaggtatatttgaaaaggtgtcataaatgacctaggaaataaagatgattatgtagttcaggaaaattcctgtggtaataagctgctattcagccaagttaaactcagtttactacgttgttttttaatctttttaaaaattttgagattgaagaaatgcttgaaaatgctgaacgggaacgtctgggtaattctcaccagccagagaagcctcttgtacgactgcgagtaagtcctatttatatagattgaatattattaattttcaaagcatagtaatgtacagtttacatggtttctttgaaaagtagtgaggagagtgctcatagtaataagaagagcaatcaccatcggaggcaaaaacaaagatataaggatttgagttaatcacagtttaagtgataggtttggtaacttatttttctcattttctaaataatttgttgttatatttaatagattggctgagctctctggcttcatctttaactacctcctctactcacttcattccaggcatcttggccttctcgcagtttcttgggcatgtgggatgtgctcttatctccctttagtctgctcccgtgtcacctcactgcagccctatcatcaagattgcagcccctaccttctctccagtgccctgatttcacttaccttcttctgcttcctcttttcttcttatttttttccccgtaacacatccttctaatctatgtacggtttatttgttttggttattattaggattgtttcctgtgcctataaatctgcttatcctttctatcgtgttataaacaaagaaacaacaacagacttcttctttaccactatgcttttcccttttccaaactcctaccccatgttgcttactctctttaaaagcccctaaaagtatataacctatatctctcttaactttctcttcttcagttcactataaccaaggctctgacttcaccataaccagtggaaaagatgacctttaattgttcaatccaatagatcgtgtctcatcttgctgaattactcttgggcattctctgagttatttgtatccgtcccgtctcatagttagccctcttttcagtgtaggcatacagctttaatgaccaccaatagagtgatgacttcaaaatctttacgtagacctccttcttgttctgtatctccaggagtcccctgaggcctggtactgaggagtgtagtctttaaaccagcagtgttgttgttgcctgggaaattgttaaaaatgcagagcctcagaccctgcatcagaacccactgtattttaacaaaaatctccaagaaatgtatatgttcatgaaaatttgagaagtactgggatgtagactgtggaggtaaagagtacagtgtagagccagacttcctgagcttcattctggcccaaccactagttgtatgaccttgagcaaccgcatcccttatcccttggtttgtattaggttggtgcaaaagtatttgcgggttttgtcgtagaaagtaatggcaaaaactgcagttacttgtgcaccaaccaaatgcttcgtagatttatgagatctaaatggattaaatagtgtctgttgcacagtaggtaatctgttcccgtttctttatcccactgtcgctggcatagtgaagcccttattaatacttcctggcctattgctgcagcctcctaccaggactctgcctccagtttccttctctctccacactaatgccaaaatgatctttgtaaaacacagttttgcatgtcttttctgctaaaaataacttaattattccccagcactaacaggaaaaagtctaaacttttttaggttagcattcaggggtctacatgatgtggtctaaaccaaaaaagctgccgtcccctgggtgcagtggagtttatttcactggaacctttgtccatgttgatcctgttgtgtgggacatacttctctcctcctttctctataccttcttcagcacccacctaaagcctctgtcttcaaagaagcctttcttgacctgcccacagagaacatgcttcttcctttgtgtcctcatccaactttgtacatacctcttatagcaccactcacagtctgcttccagtgatctgtttacatgtttttcttcccagtcagtttgtgaatttcttgacagccaagattgtatttatttatggttgtatccctggccctgaacagcatacttagaacattgaggacatccaataaaatttgttatgaccaaacatttataaatgagaagtttgaaggagagacctaatagctttagcatttagtattttgtcttttataacatggtagctgtagagatgatctgggtaaggctgggcatggtggctcacgcctgtaatcccagcactttgggaggccgaagtggctgaatcatctgacgtcaggagttcgagaccagcctgggcaacatggcaaaaccctgtctctactaaaaataaaaaaattagccaggtatggtggtgcatgcctgtaatcccaactacttgggaggctgaagcgtgagaatcgcttgaacccgggaggcagaggttgcagtgagctgagattgtgcctctgcattccagcctgggtgacagtgagacgccatctcaaaaaaaaaaaaaaaaaaaaagagagagagagagatggtctgggtaatacaaaaataattactttaagggaatcacatagttctcttcattatggcaaaagatcccaattttctcatctgtgtctgcctcacagcattaaaactaaccagactttaatagaaaattggcatttcttttcctaagcacagtaaattacgaattcattcataaaacagcacatattgtcatataagtaatattacaaaactacattgtactgactaaaagacattcattaattcattgactaaatcttactgagtacctgctattatggatgctgcaggatatagggatgataaaacagatgaggttttgaattcgtcgagcttacaggaggtggaggtgcaaagagagacatgatacacaaatatcaaataaatgaacaaaaaaccttagcagatagtgatgatgagtgaaagtgggagcactttagttagggagcattctggataagctgtgaggtggtgcagtgctggtccccatagcgtactttgggaacagctagttgagaagaacatatctctgagaaagaaaggtggtatttgtctttgtaaaggtctgtttaccactacagacttctgtagaaagagtctaccttgagagaagttctcagtttcagtgagataccatgttttggaggtaatcatttctcaaggctcacagatttgattctttattacctggatgttcctagcattcatctttctcttgaggcacatctctaagatgatagaccaatttactaatgcatttaaggctagtattttattttggtgtgtgtttgtttgtttgtttgttttgaaagttcagaaaattgttttcagatggtttgcttggtaggtacctagactattagtgttatcagggggagatgtaatcattctgcattgtggaaattattgcaataccttgattccatcgaacaaagtattttgcttatgcttataaacttttcaaacattagtttctcagtaggataaatgatatagctccatcatgatctactgtagaaaattaattcataaatttcaaagtatcaagcataaacactgtgaatactgaaggattagtgtgtgttttaaaaattggcaaattgttgtttcctagcgttcatagattattctgtgttttcaggtggactatagtggaggttttgaacctttcagtgttcttcgctttagccagaaatttgtggatcgggtagctaatccaaaagacattatccattttttcaggcatagagaacaaaaggaaaaaacaggtaagctagttatttttatgaggtaaaaaaatgttcttataggatttgtgaaggaatctttattaaaaactgtaacataataatggaagatgttttaatatgattgtaatgtcttaaacaaattgacagtgggaataattctcttgtcttctaaaaattagatagcaatcttttttattattattataccttaagttctagggtacatgtgcacaacgtgcaggtttgttgcatatgtatacatgtgccatgttggtgtgctgcacccattaactcgtcatttacattaggtattgctcttaatgctatccctcccccctcccccaaccccatgacaggccccggtgtgtgatgttccctgccctgtgtccaagtgttctcattgttcaattcccacctatgagtgagaatatgcggggttcggttttctgtccttgcggtagtttgctcagaatgatggtttccaccttcatccatgtccctacaaaggacatgaactcatcattttttatggctgcatagtattccatagtgtatatgtgccacattttcttaatccagtctatcattgatggaaatttgggttggttccaagtctttgctattgtgaatagtgccacaataaacacatgtgtgcatgtgtctttatagcagcatgatttataatcctttgggtatatacccagtaatgggatggctgggtcaaatggtatttctagttctaggtccttgaggaatcaccacactgtcttccacaatggttgaactagtgtacagtcccaccaacagtgtaaaagtgctcctatttctccacatcctctccagcacctgttgtttcctgactttttaatgatcgccattctaactggtatgagatggtatttcattgtggttttgaattgtatttctctgacgggcagtgatgatgagcattttttcatgtgtctgttggctgcataaatgtcttcttttgagaagtgtctgttcatatccttcacccactttttgaaggggttgtttgattttttcttataaatttgtttaagttctttatagattctggatattagccctttgtcagaagggtagattgcaaaaatgttctcccattctgtaggttgcctgtccactctgatggtagtttcttttgctttgcagaagctctttagtttacttagatcccatttgtcaattttggcttttgttgtcattgcttttggtgttttagtcatgaagtccttgctcatgcctctgtcctgaatggtattgcctaggttttcttctagggtttttgtggttttaggtgtaacatttaagtctttaatccatcttgaattaatttttgtgtgaggtgtaaggaagggatccagtttcagctttctacatatggctagccagttttcccagcaccatttactaaatagggaatcctttccccattgcttgtttttgtcaggtttgtcaaagatcagatggttgtagatgtgcattgttatttctgaggcctctgttctgttccgttggtctatatctcttattttggaaccagcaccatgctgttttggttactgtagccttgttgtgcagtttgaagtcaggtagggtgatgcctcgagctttgatctttttgcttaggattgtcttggcaatgtgggctctgttttggttccatatgaactttaaagtagttttttccaattctgtgaagaaagtcattggtagcttgatggggatggcattgaatctataaattaccttgggcagtatggccattttcacgatattgattcttcctatccatgagcatggaacgttctgccatttgtttgtgtcctcttttatttcgttgagcagtggtttgtagttctccttgaagaggaccttcatatccttgtaaattggattcctaggtattttattctctttgaagcaattgtgaatgggagttcactcatgatttggctctctgtttgtctgttattggtgtaggaatgctgtgatttttgcacattgattttgtttttattttcatttttttgagacagagtcatgatctgttacccaggctggagtgcagtggcgtgatctcagctcactgtaagctccgcctcccaggttcacgccattctcctgcctcagcctcccgagtcgctgggactacaggcacctgtcaccacgcccctgctaatttttgtatttttagtagagacggggtttcaccgtattatccaggttggtctcgatctcctgaccttgtgatccgcccgcctcggcctctcaaagtgctgggattacaggcgtgagccaccgcacctggtctgcacattgattttgtatcctgagactttgctgaagttgcttatcagcttaaggagattttgggctgagacgatggggttttctaaatatacaatcatgtcatctgcaaacagggacaatttgacttcctcttttcctaattgaataccctttatttctcctgcctgattgccctggccggaacttccaacactgtgttgaataggagtgatgagagagggcatccctgtcttgtgccagttttcaaagggaatgcttccagtttttgtccattcagtatgatattggttgtgggtttgtcataaatagctcttattattttgagatatgttccatcaataccgaactaccttgacgtcacaaggcaccagcagtacccatgattgcttttgcatcgtcagtgtagcaatgatggcagatggcaaaatggcaaataacatcttaggattattatgaaagtatttttgacgttattactccctgaatgggtcttgaggacctccagaagtctgtgcttcacccagtgagaacagctacaagacacctatcctggaggtatgaacgagaaatactgactgtggggaaaagaccgtggctattaacaaaaatggcttgttttgcctcaaaatttaccatgttgagcaagctggcagttgctaaagtttggccttaccttctccactgacaacttgcaatgagtatgcacattttaacattatgatagaagctattttttgatatacttctttttttctaggagaagagatcaactttgggaaacttatcacaaagccttcagaaggaacaactttaagggtagaagatcttgtaaaacagtactttcaaaccgcagagaaggtaatttcttacagttcacattttgaataatggctaccttatagtaacagattttaatttaggatatgtttagttgatagtttaaacaaaatgaatcctcaaaatgtttctatgaagtaagtagggtgacaattaattacattcatttgcagttgctgcacagcagggaaaattagtgtttaattaatgttagttattagtactgttattaatatagctgttattgttgatgttgttattctctttctttgtatctctgttgcaattattaaactgaataattttaacttaaatcagggacattcttaagtgaaacttagaagtaactagggtgacatttacattcatttgtagttgctgcacatcaaagaaaattagtgtttaattaatgttaattgtgaataccattattaacataactgttattgttgttgttattttcttactttatttgtatctctgttacaaagatctcaatccagatttagttttctcacatttggatgtaatttcagaattattctacaaacaaagacagccaaatgatggtgaagccactgaaacttacgtcataagtatatgccactctaagatcctccggttgtattagtttcctatgggtgctgaaacaaatttccacaaacttagtggtttaaaacaacacaaatttattatcttacagtcgtgtaggtcagaaatcgtacacaggactggaatcaaggttttggcatggctgtcttcctttttggaggctctaagggagaatccattttcttaccttttccagcttctagaggtgcctactatgttccttggctcttgctctccttttatcttcaaatcctgcaatgttgtatctctctaaccatttccccagagttatttttccttccagctcccatctgcctccctcttgtgcttttcaggacccttatgattacactgggcccacctggatagtctctgatactctccctattttacagacagctgattagcaacctttgttcctctttgccatgtattcacaggtcccagagtttaagacgtggacatctttagggggctcttattttgcctatgacactggttaatttcatctctattaatcatagctgccatttttggactccatatcctagccatcaggcctctacatttcacgtgtcctgtactcctcccccatttctggttttgactttgctttttctggttcctgatattagtaggcttaactacagctgttcactatattttttctctggtaacatatttggtaattttccttgctcatctataattattttgtaaggaataaaaactatttctgcatccagtgatttgtatcttacagaatgtgcagctctcactgctaacagaaagagggatgggtgaagcagtacaagaatttgtggacaaggaggagaaagatgccattgaggaattagtgaaataccagttggaaaaaacacagcgatttcttaaagaacgtcatattgatgccctcgaagacaaaatcgatgaggaggtaagtaactaatttgagtgtctaggtctatttaaatagtctgtctttaagagtagctctgagatttttttctggtaaatcactatttaacctctctgatttgtttagtttttctcatctataaaattgaaatgataaaatgaaggttaaattagaaaatgtagaaaatgcctagaacagagtcttgcatatggttggtactaaagtgttttgttccccatggatagtatcttctcttaaagatcctttgaaagggctttaaagtgaaccttgtaggatggtaatttttgttcattttaatttttttagtaagttttgattgagatcttgaatttcatttagaaaatttctgctaagcaagaagcagtggaaaaattacaggaaaagctgtctagacttgactacatagaaattataaatgtttgcatatcacattgtcaaaaaacaaaattaaaagatattgacatgaaaatatttgtatgtgggcagaaaaaagtttaatattcttaatattaatgagctcttagaaatcttaaaaataattaaacatttgatagaataatgaacaaaggacatgaataggtggttcataaaagaaatataaatagctaataagcatatgaaaatggtgtttagcctaggataatcaaagaaactcaaatacatcttttgtttgtcaaattggcagcaatttgagaaaaatagtatctagcacactgctggtagtagtattacgtttgaatagctttactgaaaagcagtttggcagagtatattaagaggcttaagatttaccctttaactcagcctgggaaatttccctatgaaaatagtgaggtagagatttgtgtatggagtgattcatcttagtgttgttcatagtggggaataattggaaatgttttgatacaataaatgttggtacatataccatataaaattttacacagcttaaaaatgacattttggaagaagaacatgagaagatatttctaatctaatgttaattgggaaaagaatttcaaagataaaaaactgcgtagtataatctcaattatttttattttatatgtaattgtgtatgtttatgtaaataaagaaaatatcccagatatattatcaacagttatgtcaaggtagttatattacaggggatcactttctctatttcccagattctccctaagcagaagaacaaaacaatgttatttaaaaaaaaaaaaaaaactcattcccttattttagtgcttttggttaacatggttctcttaaagccttatggtgtcaatgtgtaactaatattatttaataccaagtacttccagaggtaggacaggcagttcaccctctaaaaccattcactctatgactctggatgtgttgggtttgctaatttatagcataaatagatttctcaggtacataccagaaataaaacataaccatccccacctggagtgacatcatgactcctgagcagcaaagtctgtgtggggtgtgtgtgtgtgtgtgtgtgtgtgtgagagagagagagagggagagagagaaagagaaagagtgtgtgtgagtcatggtggctctgaccagacacccgtgttcaaaatcaaaacccttattagctgtgtacccatcattgagttatctaaacccacctatccctcagtatcctcatctgaggataaaatggtgatgataataggccctccttcaaggttgttgtaaggattagaagaattaatccatgtaaaatccttagaatactgtctgacacatagtgcctgttcagtgttcccactctgactctcatttctcttctgtgaatggcttagcacctttggtatgctacttatcacctagggcacgattacatactgtctcatcttttaaaatattgttattcttgtatttttcctctactgaatcataacaaacatgctgttatttctttcagcttaagaaacaaacaaaactctcgatcccattttcctttagctactgctctctgttcctcttctagagcagaatcgcttcaaagagttttctgtatttgctgactcattcttctctctccattttctattaaatctatccactcaggctcctgatcccatcattctagtgaagctgcacttgtcaagatcaccagtgactgccattgctaaatccactgtcagttttctatcttacatctcacttgaccttctttgaaacatgttttttattggatttcaggataccagactcttgttatcttcctgcctcactggctgcatattttcagtgtcttttgttgattcctctaattgctccagcctcttacattggagtcttatttgctgttccctctcccatatcatcaattgattatagattccatgagagcagctttttgtctgttttgttaataactgtattctcagtttctacgataatatatggcacattgaaggtgctcagtaaatatgtgctgagtagattattaaataaatgggcttaaagaacatatacatagctgtataataagagccttgtgagcaggaaccattaaaaaagaaacctgtagtctccttcttgataccaggaccatgctcagcaaaccttcatgagttgactcttaataaaaatggatcttcaggggccacccacttcagatcccatttcacagagcctcctggatgtcttgcagcaaggtgcacaagagtgatttgcaatgtaataaatatttcaagccttgtcaaggagatatttttgtttttaactagtttactgaagtgtaatacccatagggtattagaatttttcctgtacagtctgaaagactttttcagtgatgtgaaacattttggcagcaggtaatataattttgcttcgggtcaatatgagtttttttttttaagagtacattgtgcaattttaacgttaataattggaaaaatatgatttacttttgtgagacattgttaaatttgcaagttttataacataaagcatttcttaattgtagccccttgttttatatttacataactggaataggcaacatgtttgtgatttactctgttatgatctaggtacgtcgtttcagagaaaccagacaaaaaaatactaatgaagaagatgatgaagtccgtgaggtaattattctgctgcaaattcttgtgtttatatatcactttcttaaactagaataaccagtaggtttagttagaatagtcagtccataggtctaggggataggagtgagctggggttggcttaggatggctgcttttggttgatttcagttcagcctacaaatattctgctcattgctctttttttccattttgttcttgtctaaaacctgtttagcaagtgcagtgactcacacctgtagtcttggctacttgagaggctaaggttggaggggattgcgtgagcccaggagttcaaggctgcagtgaactatggctgcaccaccacactctagcctgggcaacagagtgagaccctgtctctaaaataaataaataaaaataaataaaacccatttaattgtatgtgtgtggggatatatacaacaaaagcccctattactcaaaataatatctctttgttagcagagcatcttatagataaaatcttatcttactgagctgatattattttgggcaaaaaagaaacttaaagtgttttggttagcaatgttaaccataagtaagcaagcatgggcaaatagacaatttctattatctattctaaaatattaaaattagcttaagcaccatcatcactgtcttctcagtctcattgcaggtttgaatctacaagttagcaaccatttacttaaatttggggcctctacctggtacttgttgaatttatgattgaaatgtattttcttattttctgattgcccttagtgttttatgattgctatctagtatttaaaagttataaactatgtactgttagttttgtcttgattgctttcattcagcaaacattttatattgtccctgttatgggttagatattctgctttatattaggactgtacatataaaaaagctgaggtctgtagccacaagattttctcaatttagtagataagagacatttgtgtaaggaagatatttattgaattatttttcctaggtgcccattttataaatgaggagacagaccagactcaaggtcatggagtggcgctagaatttgaacatatttctgactccaagtgtagacttttctatcatcctgtgtcctatcaaaattttagattattataatattaattcggtgcattgcaaatggatggttttctaaaaatgaaaaacttctaaaagtgtcatgcaacacatcagaatcactgttgaaatacacatagttgcaaccactgtatcttttacaggttgttttttggaagctaaggaaaagaagctatagattagaaatggcttaacacgtttattatatttctatttatcttataaggtgcatttaaaatagaaatagtttgccaaattgcaagaataatgctaggaagaaatgattcctgattcttaaatatctagcttaaaattgattaaccctttcaatttaacagggtacagaaatatttctttacgtttgagtgagttcttcatgtttgaagcgacaaacctcaatttttcattaagcttttaaaagagttaagagtgaacgtcttatacaaggaaggtgggagaggctgtgacaaatttcatatgggagttttacagaagaaataacttacaagttcagatattcagctatattttaagactaaaatgtaattggggcttcctaggtaatttttcagcatatcataagatattatatattttttcattttcagcatactatttagaacttaggtaatggagtctgaaactctgccaagctgtaattcacagctttgcagaatcatttggcttagaatatgaatcccagcgccatgcttaaattacttatactgacaaacaagactattagctcttctatttggagaaaaaacagtatgctttaaagtctttcaggctgggcattgtgacttacctgtaatttcagcactttgggaggccgaggcaggtggatctcttgagctcaggagtttgagaccagcctgggcaacatggcaaaaccccatctctacaaaaaatacaaaaattagccaggcatggtagctcccacctgtagtcccagctactcaggagacttaactgggaggatcgcttgagcccaggaggcagaggttgcaatgagccgagatgacgccactgcactccaacctggatgacagagcaagaccctgtctcaaaaaaaaaaaaaaaaaatcttttgttcacatagaaaaactctcaaatcttttctttaatgataaattcatatttgaataaaagagcaaacagtaaccattaggctttgcgggacatgtgtggtctctatcacatattcttgtgtttttttgtttgtttgtttttttattaatggccctttaaaaatataaaaactattcttagtcttacccacagtcgttagtttacctggcctctgatttcttatgttctacctcaatttgaggtgggttgataccctctttcaaaatataataccaggcactatcaatagtgaagaagtgacccacagaatgagagaaaatatttgcaaatcatacatctgataagggattaataagcagaatatatttttaaaacttctaaagctcaacagtaacaataacaaaaaaacccaatttttacaatgggcaaaggacttgaatagacatttctccaaagaagctttacaaattatagcacatgaaaagacactcaagatcaccagacattagagaaatgcaaatcaaaaccacagtgagataccacttcacacccattaggatggctgttattaaaacaccataaaataacaagtttcggcaagaatgtggagaaattagaaccatatacattggtggtggggatgaaaaatgggtcagctactgaggaaaacgatagcagttcctaaagtagttaaacatagaattatcatgtaatatagcaatttcacttctaggtacataaccaaaagaattgaaagcaggaacttatttgtacatcagtgttcgtagcagcatgattcacaatagccgaaaagtggaaacaacccagttggtcatcaacagatagatggataaacaaaatgtggtatgtgcatgtaatggaatattattcagtcttgaaaaggaatgacattctgatacatgctacaatatggatgaaactctgaaaacattatgagtgaaaaaaaaacagttgcaaaaggacaaatattatatgactctacttatatgaggtacctagagtaatcagattcatagaaacagaaggtagaatagtggttactggggagagggaggaatgtgaagttactgttgaataggtatggagtttcagtttgggatgatgagaaagttctatagatggatggggggatgattgcataaccatgtgaatgtacataatgtcactctactatacctaaaagtggtaaaaagagtaagtttatgttatgtatatttcaccacaaaaaaaaagtgtttaacagtaggatagtatgttttcaaatctcacaaaatgtatatggaaacatttttgccattggctctagacctgcactcatgagttaagctcttagaagtaatacattccaaagataacagtaaactctgtttttcataggaaaggtagagttaaaatacaatttgaatatacaatttgagatgataaaaatgaagatacagtatttagacaaagggaaaatacaaagtttagaaatgatggttagtaattgattccaagaagtaatcataatagggcatatttattttaaattttgctacatactgccacattagtccaaagatgtcttaactagtttatattctcaccattagtatttgggagtgcttgtttcctcacatctttaccatcgtgatgtattactgtatcttttgatctttacaagtctaaggggtaagaaattatttcctactgttgttttcagttcatactacttttttttactaatgagtctgcctaatttttatgtttataaatcatttgtatttatatgaaacacatggtcattttgtttggccacattttctctttcgagtagggtattggtctttctcttttttttttttttttttgaggcaaagtctcactctgtcacccaggctggagtgcagtggtgtgatctcagctcactgcaacctctgcctcctgggttcaggtgattctcgtgcttcagcctcccgagtagctagcgcgcgctaccatgcccagctaatttttgtatttttagtagagacagggtttcaccatggtggtcaggctggtctcaaactccttaccttaggtgatccacccgcctcggcctcccaaagtgctgggatgacaggcatgagcaaccgcgcctggccgggtattggtctttctctaattgatttgtaagagcactcacttgaacacatttgtgtgtgtgtgccctctctttctctctctggatatatacacatagtaatatagcatatttagggttttttgacacataaagtatccacttattcatcagcttatttgtttaaatcaggaatgattggtgattacatggttctgattttatgaagatatacatttgggttttttctttctttgttccattaatatagtgagttatattattatgtacatagcttattgacccatcctggtaatatatccattaccccctggtaatggatatattggtctttccataagcttctggagtctctatttgctttcataattataaataagattctgtaattttctttttgtgcacgcagttctttgtcagtactgtgtcatactggcattgtgaaaacagtttggaagctgtctttctgtatgctctggcactattgaaatagcagtgggcttatctgttttttgaaagtttggtagaatttacctacgaaactttctgattgtggtccttttttgggagtatttttcttttaataattttctcaaaattttctttgataattggtttgttgaacctgtttttttcccaccttggatcagattaagttattcattttccagattatttagaattgagcattctctcataagtcttgggtcttccctcccattcttccttctttctttttttcgagacagggtcttgctctgtagtgtgctaccactcccagctaatttttaatttttttttttatatagacggagtctcgttatgttgcccaggctggtctctaactccagggctcaagtgatcttcctgacttggcctcccaaagtatggggattagagatgtgagcttctacacctgtagtgctagtattagagatgtgagcctctacgcccgtccctcttatttctaatgatgtatatttgtgttttcttcctttctttaaagctttgtgatttttattaatgttattgttttgtcccaaaggaccagtgcttatatttattcattctaatgtgtttttgtttaaaatctattaatatatggtttcatcttcattctaatacttggataggctttattttgtttctcctagctttttggatacagaattaacttatttacatttattcttagcaggctataggctttcttataagcattgctttagctctctcatatgttgtgatgttcagtattcttgttatgattttctagatgttctgcaactttcgttttgttttatagttttgactctggtttgttttcaggaggcaggtttttgctttattattaattttttattttattgcatgatgattagacagtgtgataaatttatttctcctatcaaaaatgtattgagatttttgtttgcaccctgttatgtatcagctaaaaagtttcatggggtcttgaagtatattattaattttcagtgtatagaattcaacatttatcaattagatctatcttattaattatgtgatttagatcatcttttttctcttaagtctgctttctaaaagcatacagctggttccttttatttgtggtagttatgtcgtataaaatcacttccagcacagaattagcaaatggtgaatcattgctcctaggggaaatacaaaattagctttctatgagccactgataacgtttttgtcagctgatcaatacgtaatctttttaatgtgtttctgtttaaagatactgtatttaacatttgattcattagcattgaactcatagccagtagcactttaacttatacttgaattaagtttatctaatatacattttttctccaaaagtcatattgcagcctttttgcatgtaggaatgaacactaaacatgttgagggggtcatttgaaaacaccacattaccaaagcaaaagtacaaaaatgcagaaaatgcaataaatatgtagtcatgtgccacatacaacattttgatcgatgtcagactgcatatccagtggtggtcccatgagattataataccatatttttactatatcttttctattaagatatgcttagatacccaaatacatagctatggtgttataattgcctgcagtattcagtacagtaacatgttgtacaggtttgtagccaaggagcaataggctatctcctatagtctgggtttgtagtagactgtaccatttagctttgtgtaagtacacactatgatgtttgcacaataatgaaatcacctgatgacacatttctcatgaggcatccatcattaagcaatgcatgactatcacagaaaggacactttaaagtacacaagtggaaacaagaaggcagagtggctcattgttcagcctcagctgggaatatgtgtgtcaggcaattcaaaatatttaccactctgcgtctccataaatgatgccaaaagtatcgtgagtgttgatttttagggttacagagaaattttggcaagtcggtgaatttgcaaatataggattaatgaataatgaggattaactgtatttcatgtgggacaggaaagatgaattgaaatcactgttgtttcttatattttttgttgtatttcctgaagtgttttctttttgcattgtaatgctgtattgaaccctgcatgcagtgagttagctgtgatttcacctcagctgagatcatctcatcatgaagttgccacttcagtcccactttatgctgcctgccttgttcacatctcctcatttagccctgggtctccttactttatggtatcacagagcttagaaatgttctggtcagctattcttagacccagaactgccattccaagcaagagagactgttatcatgtcttcttgggatttatacatcagttttggagagctgtataatacctgaaactcttctcacctttctcccttagctaggtcaaatatttatcatattcattaactcttctttatagtttgtgtgtttgggggtttggaactattttttaattttatggaaaatgtattttgtttttgttctcttactaccttttgattggtttaagggaagatcaaggcaaaattgcttttatttatattttattttattttttggtgacagggtctcgctctgttgccaggctggagtgcagtggcacgatgtcttttctaaatggattcttaccaaattaaaaatgcgtggcatgttcttggtcctaaggtgtttattccttcttaggcttaggctttcagttgatatattctccttaattcttccgtttcttttcattttttttttaggcaaggtctcactgtgtcacctaggctgaagtgcagtggtgcaatctcagctcactgcaacaactcccctccccactgcttcccccaggcttgagcgatcctcctacctcagcctctcaagtagctgggactacaggtgcatgccatcacacctggctaattttgttcttttgtgttttttttttgtatttttggtggaggcagggtctcgccatgttgcccaggctggtccctaactcctgatctcaagcagtccatccacctaggcctcccaaagtgctgggattacaggtgtgagccactgcgcccagcccttaattctctttaccatatatttgtgagagattgttactcatgtttttttctgattataaaactaattttttagaaaaagtgtaatatagaaaatatgtaatattcaagaacaaaaaacaaaagcaccctaaaatattagtgcccagagataacggctattttttgtaagtttttttcttattatttcctaggagccgattctaaaaagtagctcaaatgatgacagtctgttactgtcaaatgtggcattgaattagggatgattgccagtattccttctagttctgaaaattttgattctgtaaaattttatttttcttggtaaaccttttcaaagggtctcattttataggtagtatggtagattggtctgacagataataagtattaaatttgattggtggggaggttctcctttacacatatataaatattttttgtttttatttttatttttgagacagggtctctctttgtcacccaggctggagtgcagtggtgtgatcatagctcactgcagcctgtatctcctaggctcaagtgatcctcctgcctcagcctcctgtgtagctcgggactacaggtgcatgccaccatgcctaattttttttttttttttttttttttgtagagacggggtttcgctgtgttgcccaggcttgtctcaaactcttgggtgcaagtgatcctcccgcctcggcctcccaaagtgctgagattacaggcgtgagccactgtgtcagcctcctttatgtttttatagtatgattagttcatgtcaatgcctaaattaatgatttttaggatggtacgttatctcattgtgtgtactttctccttcttctccctcttaggctatgaccagggccagagcactcagatctcagtcagaggagtctgcttctgcctttagtgctgatgaccttatgagtatagatttagcagaacagatggctaatgactctgatgatagcatctcagcagcaaccaacaaaggaagaggccgaggaagaggtcgaagaggtggaagagggcagaattcagcatcgagaggagggtctcaaagaggaagaggtgagcactgagttcagtcctgtgcacattcacacttggcagttgagtggaaaatacagaattagatcttgtcagagttgaattataagttttatttctaaaacacggttctttaaaaatctatttttataatatataaagacagtctttaaggcagttctgacatgtgccttttacttaaataaattttgaatggccacatgcacttagggttttaattgttcttagcacataccttataaaagcttcactgtgtttgtcacgtagtaccttttggatacatttaatgtcatatgtattttcacatgtgcaaagtaataggcaaatatgagttgttaaagaaaatagctaaaagcctttggcaacaggaggaaaactccagatcatacaattattatttttgttactgtcataagatacaaatacacatatgcttatcaagtagtctttataaagtcagtttaagaaagaaaactgccccccaatttgattcctaaaactagtcattaacatagtcaacattgtatttactgtgagactattgtcattgaatagttcacgccaatagaaattggtcattcagtgactttctcacacattatgtcagttcatctctaaagattttttaaaattgtttttattaaatatgcatccataggaattttaagctggtgaaatgaatattaatttggtttaaaatctccagggagagaaatcctcatcttttaatgatgattattttcactattcttacatttacaaaatttttccttaaaaatttttatttttgttttttaatttttcttgagatggagtcttgtctttgctctgttgcccaggctggagtgcaatggtgcgatttcagctcactgcaacttccgcctcccaggttcaagcaattctcctgcctcagcctcccaggtagctgggattacaggggcccatcatcatgccagttaatttttgtatttttagtagaggtggggtttcaccatgttggccaggctagtcttgaactcttgacctcaagtgatcctcccgcctctgtctcccaaagtgctgggattacaggcgtgagctaccacgtccagcctatttccttacattttaattggataaattaaattggataaactgaagtgtggcctaaaagaatagtctctgaaaattggtcagactctagatgtttgttcttatatatatgtctggctttttacagacaaactatttgacataagtttatttagctttcattttttggtgttgtatgaaataaaccttagctgctgataggcttgtacattgactgttcatttttctaacagcagacactggtctggagacttctacccgtagcaggaactcaaagactgctgtgtcagcatctagaaatatgtctattatagatggtgagtatagactgcaagtgattatttataaattccaacattagaaagaccaaggtaatcaccattggtagcccttatttgtgttgcaatcattgggaagttataagggcaattaggatcacaggataaattattttttaaaagatctttgctatgcattagagttactgaagagggtaagcttttaaaatcatgttttataggccaggcacagtggatcacacctgtaatcccagcactttgggaggccgagacaggcagatcacgaggtcaggagatcgagaccagcctggccaacatggtgaaacccggtctctactaaaaatacaaaaatcagccaggcgtggtggcacatgcctgtagtcccagctacttgggaggctgaggcaggagaatcacttgaacccaggaactggaggttgcagtgagccaagatcatgccattggactctaccctagcaacagagagagactccgtctcaaaaacaaaacaaaacaaaacaaaaattatgttttataatttcttactttcagacaaatgctgtttctgtttggcagagagaccctggaaacaggaaagtgaagtagttggtcactatatggacagtggtcgaaagagagaggaactgtctctactgtttccttgcttcccccatactgccctgtcagtctctgctttccatatagagaagtcatgtgacctatatttaagagaaattatggctaggcccttggaattaatttgtgtatatcctatggtctaaaaattggcctcaaggggatctgtttaactatttttaatattatagatgatgagatcagcctaaaatgttagtcatatttacaaaaagtatgcattaagataggtggtgatacttttttctacctagcatttagaatatattcatatgtatattatttatattatcagttatttgaggttattgtttcacttttataattataaatattttttaaatattataattgtaatatttataatcttatagctaggattaattgttgacacactggggagctgaactaattctcagaagatgaagtttatcaagggtaatataaaccacatttatgtccaaaaggacagctgcacaagtagagttgtgagaggtatgtgagtttaacagcaacccaggtgaaaaagacttaggtcagtaagagttatgcaggcatacccaactgtccaaatctattgatattttaaacagcatttaatgagtcttgcagaggtgtccaagggagagaatacagtcatggattcttagtttctgtttctggttgggccagtaaagcccttttctcatccttcttttcctcatatcactagcgacagaaactaaaaaccatggcttcagctgctaaaagcctaaaacaaaagaaaacagaacaaaaacaataacaaaatgaggtgggttggacaagcttgcacagcaaggaagttctctctgtgtactaaattggccataacatgccaaggatactgtactcctctttggaattatatttcaaggagactgtcaactatatatgatcattcagaagagataccaaataatataaaaaatggttggccaggcgcagtggctcatgcctataatcctaccactttgggaggctgaggcgggcggattgcctgagctcaggagatcgaaaccagtctgggcaacaaggtgaaaccctgtcccctactgaaaatacaaaaaattatccaggcagggcggcgtgcacctgtagtcccagctacttgggaggctgaggcaggagaatacttgaaccgagaaggtggaggttgcagtgagccgagatcatgccactgaactgggtgacggagcgtctccaaaaaaaaaaaaaaaaaacaattggttgaaggaacttaggatttaggatatctaacctgggaaacattcagatctttatgtagattatgttctatcgtgtaaaatgtggaatgaatagatttgatctgtttagtcccaaaggcaatgctttttaatctattttggcttatggattctctaaaaatctgatgaaagctatgtcttctctccttaaataagtactcacatgcaattgcacccaatttcaaagggttcagccactcccatgaggcgcattcgtgttttccagcttaagaactcctggcccaatggggatggatgggaatagctagaaacatactgatttaagtttctcatctgatagaatggacctggaagatttaagaacaactttgttcccctgttttatatgtgagggaactaagccaagcagttttgccctgagttgataaaaccactaatagtagcaataatagctaatatttatgaaactgcatgcctcttaacaggtctgtggggtaggtacttactatattatttctgttttacagaaaaggaaacaggctttaaaaagataggtagcttatcctagatctcataacttgtcagtaccagatctgggaatgatctcacattctctgcactctacaaccagtagttgaccactgtactagtttccagagcaaggtaagattagagacctagctactagttctccatagaataatttttgcattatgcagaataacctatgtaattaatataaagatggactaatttgccttggaagtaagtatcactccattaaaggaattttcaacatttatcaaatgacagctgacattgaagaaaagatacaaaatcaggttgattaaatgactcttaaaccttacaaaaaattccattgctatatttttactcaagtattatttagtacttcagaagagctagctaagatccttagctttttgcttcacaaacatgttgtctttattgccatttagggagtggtatctggaaagatgctgttccattcttggtaggtttaatataaaagcagagaggaagaaagagagaaaaggcagcctggaaaattgtaaaggattcatgctgagttcaaccttgcattcaacaaatgacagctttgtgacttgagacaaatcagtcactctcctagtttgtttagatatgattggaaataataatctctattgtattgggttattctgaagattaaatgatcaaaaagcctggcacagtaggcatttatcaagtgttcttttaaaaatgagaaaacaggaacatagaaaaagagtgaataaaataatgaacacttccatgttaaaccaccaaaattggttagcatgcaatcgacagagtcatagatgtagattacccacctttaccttagcccaaatcgtctttttttgtcctgtcttgttttttttttcttttttgtttttgtgtttttgtgtcctgtggaatccagtgtcctggcttgttttatgttaagctttccttgactccagtgggtagaattcatcacttaaaatgagtcgtctttgagtttccactgtaattaagaaatcagatatcagttaagcttgttggtttttgttttttaaaaaataacctgtttttctctcagcttgctgtttttggtgttctgcagtttcactgtgatgaatctaaagatggtactcttgtttagcctgcttagcaattattgggcttcatgaatctctgaactgctatcttccgtcacttctagaaaatccttagctattatcccttcagatgttacctctatgctattcttattctccttctgagtcttcagttaaataatgataagacctctttactctctcctcacatgactcttgtattttctgttttctctttctgtgctacattctgaataattatttctgatcacttttttttttttttttttttttttttgagacagagtctctctctgtcgcctaggctggaatgcagtggcatcatcttggctcactgcaacctctgcctcccggggttcaaacaattttcctgtcttagcctcccgagtcgctgggattacagatgtgcactaccacacctggctaatttttgtatttttagtagagacacggttttactgtgttggctagtctggtcttaaactcctggcttcatgtgatcctcctgcctcggcctcccaaagtgctgggattacaggcatgagccaccttgcccagcctatttgcttcctttaaaatatgctctgtcacttttaatagtttttagaagttttctgaagatatttttaggcctgttttaatttttcgtgtgtacacagtaaggacttcttttattttgtatctaataacctagtgtctgaatgtctttggcctctttctgttgtctgtttctgtgggttcttatttatggtgacttatttccttccatgctttgttacttactgtccctagaaaattatcaacaggaataatttgagaccttggatgaagccatcttccttcagagaagattcacgtttgtttctctaggtttgtagggcaccacaagtcatagaccactttaagctaaatttgagggtttcttggaccagtcatttgatacgtacttgtaactaaaatgcaggttcagtcacttgctgcttgcaaagtccaattaacaagagcaaggtgtggtataaagaaagtgactttttattccaaagcgaacttaggggaagaaatacaggcttcctaccttaagggtactgcttccccctttgcagcagaaagtggactcttttaaaggggacctatcaggagtggcatgcaggggaggaagcgagcaagtggggggtttgcattctagtttggtgtcttatctaccaggcagttgaattggcatcttcatgggtagaaataggctataaaggtggccgaatactctctaggttggcgagagtttcatagcaggactttggattgtgaattgactgttatctctagaggcaaccccctggtgggtgatagttcaactctggagcttccaagcacatagttagatgaactccccttttagggagtctctgatgaagaggaagtaaaagactatagttgcatttctaaagaactaagtagaaagtgggggaaaggagaaaagaagagagagaaaaagtaatgaactacctcttagaaaaatgagggtactcagttacatgcttatgaaatcctgtttacctctgcttctctcttcaaccactggggctccaccttaggaagggaaatgcatcggggttttcactttgggcagccgtgggctgtggtagccctctctatttttcttcaggattctcaaaaccaatgttaacattttcccaattgaaaagtgaactcagggaaaggactctgcttacctctctgagttctagcttttcttcagttttggcctggtaattccttggtatgtgatcagctcttcaatgccattgagaatttttttttttttttaaatgtttgaggtactaatttggattgttgtcagcagaagtgagtttgaagacaatgagaggtcattttgtctgaataacctagcctgcaatgactgttacccattgacaacatagaataaagcttctatttgtgtagaaagactggagaccagttatgatgccttaaaagttttacagaatggcttgactaatttttttaaggaaacagtattcatctatgaaaagaggctatgtaaataaactaaatacgaaacgtcagatttcctgaattatgttgtaagcaaaaatcttattatggtaccttttgcagcagagcatgatggttaagaatgcaggctctggagtcaggtccattgggtcagtcacagccagctctttactgctggcttagcacccttgcactgtaagtgctgtgagaaaggggtctgcatcattcctcctcatcactgtatccactatatttggcacataacatagtagatgcttgttaaatacttgacaatgactgagtaaaaattacttggagattgtgtagcgtaagggtgaagaccatggttctaaagtgaggaagatcttggtttggatcctgacttctcaattttactagttgtgtgtcctccagcaaatatgttaagtttttcatctttaggaatgagtgttctcatctgtaggatgggacaatgattgcgtccacctcattgcgttattttgaggattaatgagaaaatgcatgtgaagtatcaggcagtgtctatgcatattaagccctcagtaagtgcaaactggtgttattctacaagcatcagatcccttagctataaaatttgacaatgttgtactgacttcagagtaattttattaaatgagcttaagtatttacagtactgatcacagcacctggtaaaaatgcgacagatgatagctgttattaatattagtggtagtgttttgcaataagattatgaagatgaatattatgtgaatcattggtctaaatttgtcttttatctaattgatttgatataatggtttcgctaacttaactgattacctccagtactaggcctttttttgaaaaatgaactgattttttaagtataaatttgtgaaacatttttatcaggttggatttggtgggtttttttttaagtctctgacagaatacctgtgaagtagtaactatacttgtcatcactttgggacagaagcaacaaattaagactgtaacttctagatctctgttttaaatggaggagtgaagagataaataaaggtcaaattctcttataacaaggtccatggagtatggaaatttattattgtgctgcaattttattggaaaagataaaaattacacttgtagccacgggagttgtaaataggagttgacagcccagatttttccattgaagttagtcagcagaggatagtggctaggtgaataaaagtacctctgaagtcacggcctttacatttcatttataccactatgggtaccactgctgctactatgtttgctacccaaacagctacatgtatttgaatgctttctatctgctagacacttcctcttaccctctcagcagttttctgcatgaagtattaacactgttttacaggcgaggaaattgagttttaaagaagccaaggagcttggccatagtcaagctagtaagtcaaaatgagtctaactccaaaaccagagcttttaaccaccacactttattgtcttcctaacagaacatattgcttagttttctgataaaattatttcacaacatcactcatcttttgccttccagtgggataaaaagaaaggtatcttgttttctaggatctcagagttaaaggagtcagtgaataaatactgaacagaaatattctttgaaatcatcatgatcactggattttttattcagttgctctgtctagccttttgagtagagtaggatgtgaaaaaagtaactgagtaaagcagataagaacactgtttctgcctctcgtttctcctcttagatattacaagtttggggacagaacctagaataggaaacatgtgcaaacacaataaatttaggttagatagaaagattcgttagttttctgactaggagaattttggactttgcaggattttttgagtatttgtttgtttttctgtgccctatttagtttgtgagttatcttggggaagatatttttgatattagcaaactggtaaggcataggagaaaataaacctaaattagacgtttgaaatttattgtaggttttgttttgttttgttttgttttgttttttgagacggagtttcgctctgttgcccaggctggagcacagtggcacgatctcggctcactgcaacctctgcctcctgggttcaagcgattctcctgcctcagcctcccaagtagctgggattacaggcacctgccaccatgcctggctaatttttatatattttttagtagagttggggtttcaccatgttggccaggcttgtcttgaactctggacctcaagtgatccgcccgcctcagcctcccaaagcactgggattacaggcgtgagccactgcgcctggccttattgtaggtttcgatgtcaaggaaaaagaaagggaaagataaagagctagctaaacttcaagtatctaaccaagtttaaaaggaaaaaaggtatggatacaaaggaatttttatcatagaatgctgttttctagaattctcctctggaatatttcttagatattgaatatggctactaaggtagaggaaaatgagaaactactggaaccccatggctcctaatgtagcaacagggataaaggtatcgtcaacaacaaagaagggattaggaggctttccttcaatacatttgtagttcatttggttaggtgattagattttatccttcaggtatttttctatgaaatatttttagtgtgtgtatttataaacactacagtatctcaataagctgggaaataatgagactgacagttgggcattgagttatgcgtacctataattctatctccctttagatttttaaaaatatcaaatagttttataattaggcatcattcagttttgcagataggactcagaaaatctttagctaaagaagtatgcaagtttttctaagttattttaagaataacataatgcacatttcatctttttcattctagcctttaaatctacaagacagcagccttcccgaaatgtcactactaagaattattcagaggtaagaaaaaaagttttatggttgtgtattaataatttatgttttctgcattatgaattgtcaactctctgatttacaaagtaaataaaagaagaaaaattatggaacattaaagctggaaggagctttaccaattatctctagggcttctaggatttgattttttttttcttggttgctctctttttttaaataatggttattatagaaatccataaatgttatgtatacagtaatgttttcaaggataacagtgttgaaccaaaagagctcatacatggaatactaatattgaaggtgagttcaatggttatagaggttttttctatgctggatttccttttgttacttatcttcccaaaatactagctgtgccttaacagctgttgctagacttaagatgaatgaaaaggctggagtccagcgatccatgtggtttgccctaggtttagcctgggccttctgctcttcctttcgattccaagaagagtccaatatgggcttgattctcttattacttcactttcaaaactgtgtgtcttaactcccgagccaatactcttccctttacatcagggtttctccatagtagcactgttgacattttggactagataattctttgttgtgaagggttgtcctatgcattgtaggatatttaacagcatccttagcctcaggggctgttcgttcagtatttggtctttggcttcatcctcatctgtacttaagttagatgaagatatggcaaatgtatgtatcaaatgtcaagataacaaaatgtagagaaatagtattttgggtggtagaatcaacagtcagaaatatctttattgggtcttaacactaacaaatggtatttaagagggacagatttaacagaaagatatctagtatttcccacatggtctgatacctcatttaaagttggagatggaacactgatggtctcacctctcataagaaactaagaggaaagtcataaggtctgcatatgagcctatgcaagtcattcaccagtgtaactgtgttcccttaggtgctcaggctcctgggatggccaggagagaggtgagcaaaaagtaacatttgtgaatgaagagggacattggagggaggtcagactgagtgttagttttaatggttatggctttctgtctccttttttgtggctcatatataacttaagatttaatcgtgtaattcatttcttcattttcatttttattcagagtctattctcacaaaaactgtttgttgctttgtttccttgccaggtgattgaggtagatgaatcagatgtggaagaagacatttttcctaccacttcaaagacagatcaaaggtaggtgcagtgattttctgcaaaagaaacatctgaaaaaaattaaaaattatccagaattccaaagttacacatttttctatgccatgtaagtttaacagacttattttcaactagtaaagtatgtagaggaatgaaaacagaccaagggctagtttatagagttgatgcagcattagtacaaggattttcagtgaaaattgaaatagcctgtaatttttttccttttgactttattagtgcttttctttctttttatttatttatttattttttgagacagtgcctcattctgtcgcctagactggagtgcagtagtgcgatcttggctcactgcaacctccactttctgggctcaagcaattctcccacctcagcctcctgaatagttgggattacagacgtgcaccaccacacgtggctaattttttgtatttttggtagacacagggttttgccatgttgcccaagctggtcttgaactcctgagctcaggcgatccacccacctcgacctcccaaagtgcctggattacagatgtgagccagtgcgcttggcctcagtgcttttcttaatggaagactgtgttctctccaaataacagaaaataattttgtattttgctatcatttgatttcagctttttgtcattgtcttatttttatattcttaactacacatggtactgtactaaacacttaaaaggggatcacgtagactcagtctgccttcagaggacttgcatgctcttcctgtgtgttttgggattttttgcctattgctgttaagcttgacttgattcactattaccatttgcttttatacgttaacattttggttgaatactgcttaactaaagctcgaataatgagaatttctacttaataaagtaatcaactgccttattttgtacttattttctgtttgagcattatattaggtctgatgagggaggggcataacgaatgttttaatatggcctctgccttcaggtaacttcaattatagtggaaaagagaaatgaacatatttgaattcatcaaagaatgaattagtacataattaggtgtagaattttatattacagacccataagtgtgagtgcttatgggctggtgaaaaaaggaacaaggaatgtgggctagaagaagcagcttcatggagggagtaaaattgacctgaggtttcaaagataagatttggcttagtagggtggaaaatggtggtcccagctgagaataagggcatgagcaggaactccagaaagaagggtgattgaggaaaaagccttatatcagtgtttctcaagctttttttccattatctcagccatttcttgattatccaaggagaagaattaagtaacttagatgtaagtcaatttctccctaacgttagaaattaaatacttaaagaatgaaatttttttgggtatggttgagtctgagagggccaaaaaccgtagctttttcatcccactctatcccctggagccaatttttgttctttatgatactgaccccactgagaatataagctgtatgtgacttaaaggttaatgttagagcaagtgtaagtatagttccacgttcacttattagatccttcaaacatcatgctaggttctggggatagaaagataaatgtttcttccttcaaggaatttacactttagtggtatgctaattacagggcactgctaatccaccaagataaatgttttcttcaggtgtaatgaaacctaagggacgtgccagtatcttcctgggaaaggtcattgaaggttttacaaagaagataggtgacatttgagctggtgatcagccgatcagttagcatgcattaaaggaaatgatctggtgtagagagaagaaacagtggcacaggacgggcatctactttgaaggatggtcatggaaagcctctgaggaagctacatttaagcggaaattttaataagggaaatgtggccttgcaaaaagcagagggacaagtgcatgcagcctgtattagtccattttctcactgctgataaacacatacccgagactgggcaattacaaaacaaagaggtttaatggactcaaatttctacatagctggggaggcctcataatcatggcagaaggtgaaaggcatgtctcacatggcagcagacaaaagaagagaaaaagagccaagtgaaagatcttgtgagacctattcactaccacgagattagtatgggggaactgcccccgtgattcaattatctcccaccaggtccctcccagaatacttaggagttacgagagctacaattcaagatgagatttggtagggacacagccaaaccatatcacagtctattgaagaagcaagtttaataatgttatttaggagccaatgactaatgtgtggtggaaaaggaggttgtttgagatgagaatagaaaagagacacagggtaaatcatgctgcaggaacaggtgagcactacaaaggtattggatgttgttataaatgcagtgggaatccacagaaagattttaagagaggagtggcaccttgtgatttacatttacaaaggatcactgtggttgcagaacaagtgtaaacaagcttatctgaaaggagggtgctgcaggtagtctgagctaagagagacgatggaggcttgcacaggctggtggtaggtgaaatggaggaaacagatggtttcaggatatattttgaagatagacatgacaaaacttgaagatggattaaacatttggagtaagggagaataaggaatcaagactgattttctggtttcttgctggagcatttacattgtgccatatattgagaaggggacaaaagaaaggacagatgtgttgtagggaatgataggcatataattaaaagttccactttagatgtgaaaagtttgagatgcctagaaacttacatgaagggaagttataggcaattgaatgtgtgaattcagaactcagataagggtttttgttttgttttgtttcgttttgttttgttttgttttttgagacggagtctcgctctgtctcccaggctggagtgcagtggcgcgatctcggctcactgcaagctccgcctcctgggttcacgccattctcctgcctcagcctcccgaatagctgggactacaggccctgccaccatgcccggctaattttttgtatttttagtagagatggggtttcaccgtgttagccaggatggtctggatctcctgacctcgtgatccgcccgcctcggcctcccaagtgctgggattacaggcatgagccaccgtgctcgtcccagataaggggtttgaaatggtacttacatttacctctggacagcgtgcagatggtacttaaaaccattgggatggataggatcacctcaaaaaagaaggcagagcagaagagtgtttgttttcctagcctgcagttttaaccttactcagcctttgggtagagtagaaaaaaacaataaagacatgagaaaaatccgggagagtatagagttgcagaaggctgtactggcctttataggagtaaaaaataccaagatgggcgcagatgcaaatcagtttatatgtctatggtaagtagtggagggacttattttagctcacgaaggtttacttgaatttctcaggctcatttatgtgtatttaacaggactcctttggttccagctgatagaaacctaactcagattctcttacagaaaaggagatttattggaagattatcgggatacctcaggttttggaaggaagtaagggcccctttctgagtccttgtttggttgttcttgtctttgtaaattgaagcacacacaaatcagatctagctttctaagtttttttttttccagaaatggatcaaaatgctattctgatatttttgatatatgcttaaggatattaaagaaaaaatagtttgcttttgatatcacagtagattgtttacttttcagctgtataaatgtctgccgatttctttagacatgaaatagtaatataactcacagttgtttggtacttcctatgtgccaggcacttctctgagcattttacatgtgaattagcttgcgtggtgctcacaacttccccaggagatagattatagttataactttatcatccccattttacagatgaagtgtgaagcacagtggctaagtaacttacctaaggtcacccaactagtcatacagtccaggcattctgaccccaaactcatctctgttgttgcttcttggtatggtaactaacttctctgaccattgtgcaagcaataagaatcatttaagttttgagaggctgtttaacattttagaggcaatttccaaaattgacattttggaaacacatcagaaatcagctttggcagattggtgtttctaattacagcatctaaatgataatttagactgtttttgcagaatgttttagtaattgcaggttatgcatggtgttttatttataatttaaactatttaagctctgccacttaccagagtggaccttgataattgtgctaatctgctacctctgaaccttagttgctcttcaagtttgcctgataaatccttctgtcctttcctttagtgcaaaggacctgtgaatttttctatttacttctgacataagatctcgtgattctcattcttttttccagataaaacctttggacatatttcttttgctataatgacatcccaaagcatgttaataaaattgtagactaagaatttataaacactacttttattgaagacgggaatcagcagactttttcttaacaggccagatagggagtattttaggctcggcaggtcaagaggcaaaaccggggatattatgtaggtagacacttgtataaccatttaaaatgtaaccatttcaaaatgtgaaaaccattcttagcttataggccataaaaaaaacaaaacctggtggtgggctagatttgcttactggccccgatctaaagtgacttaaatttcttattaattaaaagacataggaatttactgcaagttaagctttgtaagagtaggaatcggctgggcgtggtggctcacgcctgtaatcctagcatttgggaggccgaggtgggcggatcacgaggtcaagagatagaggagatagagaccatcctggccaacctggtgaaaccccgtctctactaaaaatacaaaaattagctgggcatggtggcatgctgagggggctgatgcaggagaatcgcttgaactgggaggtggaggttgcagtgagccgagatggtgctactgcattccagcctggtgacagagcgagactccatctcaaaaaaaaaaaaaagagtaaaaagagtaggaattatgattttcttattaactgagatttgaatagaaaatatttcaatgttcccatggttttcagaagtggaagatggtaatgtatacattttggtacatgataagtactataataatataagtaagtattgttgtagtacttaatatgtgtcaggcactgttctaagtgtttaagcatattaacacatttagtctttataaaaccattatccccgttttacagatgaggaaattgaagcacagagaggttaagtaacttgctcaaagccacataggtagtaaagggcaaaaccagagttcaaacctcggccccagagtccttttccttacagttaagttttattgccgctaatgtagattttaagggaattgtgtgttatttatattcgtggcagctgctggattgaaaaacttagccagaaaggcacacttgatgaattatgtagttcattgtgtttgtttttgtttttgttttgcctcaggtggtccagcacatcatccagcaaaatcatgtcccagagtcaagtatcgaaaggggttgattttgaatcaagtgaggtaaataagtaatattgttaaattttaattaatttttaactttataaaatttaaatagagactgccagctagttgctgaacttttttttctttgataaataacttcatcttttatgttcagggagtacatgtgcaggtttgttacatgggaattgcgtgatgctgaggtttggtacagatcccatcacccaggtagtgagcagtaggcagttttccaacacacatcctactctcagcctccactctctagtagtccacagtgtctgttgttcccatcttcatgtccatgtgaactcagtgtttagctcccacttgtaagtgaggacatgtggtatttggttttctgttcctgttaatttgcttaggatagtggcctccagctgcaaaggacataattttgttctttttatggctgcatagtgttccatgttacatatgtaccaccattttctttatccaatccgtattgatgggcacttaagttgattccatgtctttgctactgtgagtaagtgctgcagtaaacatgagtgtatgtgtctttttggtagaatgatttcttttcctttggttatatagccagtaatgggattgctgggtcaaatcgtagctctgttttaagttctttgagaaatttccaaatggcttataatggctgaatgaatttacattccaacaatgtataagcattcccttttctgacaacctcactagcatctgttgtcttttgactttttagtaatagccattctgactggtatgaaatggtatcattgtggttttgatttacatttctccgatgattagtgatgataagcactttttgtttgttggctgctttgtgtgtcttcttctttgtaatgtgcctgttcatgtcctttgcccattttctgatgcagttatttgatttttccttactgatttatttacattccttttagagtcttgatattagacctttgttggatacgtattttgtgaatattttctcccattctgtaggctttttgtttactctgttgatagtttcttttctcttttttttttgacatggagtttcgctcttgttgcctgggctggagtgcaatggtgtgacctcagctcactgcaatctccgcctcccgggttcaagcgattctcctgcctcagcctcccgagtagctgggattacaggtgcgcatcaccacgcctagctaattttttgaatctttagtacagacagggtttcaccatgttggccaggctggtctcaaactcctgaccttatgatccacctgcctcggcctcccaaagtgctgggattacaggtgtgagccactgtgcccagcctgatagttttactgtgcagaagctctttagtttaatgaggtcctacttgtccatttgtatttttcttgcagttgcttttggggacttagccaaaaattatttgccaaggccagtgttgagaagggtattttcttggttttcttctaggattattatagtatgaggtcttactattaaatctttaattcatcttgagttaatttttgtatatggtgaaaggtagggatccattttcttctgcacattgctagccggttatcctagcaccatttattgaatagggagtcctttctccattgcttgtttttgtcagcattgtcaaagatcagatggctgtagatgtgcagctttatttctgagttctctgttctgttccattggtctgtgtgtctgtccttgtaccagtaccatattgttttggttactgtagccttataatatagttcaaagttgggtagtgttatacttctggctttgttctttttgcttagggttgctttgtctatttgggttcttctttggttccatgtgaattttagaatagttttcttctaatttctgtgaaaaatgacgttggtagtttgatagggatagcgttgaatctgtaggtagcactgggcagtatggtcattttaatgatactgattcttccagttcctaagcatggaatgtttttgcgtttgtgttatctgtgatttctttcagcagtgtttcatagttctccttgtagagatctttcacctccttggttagctatatagctatgtatttaattttctttgtagctattgtaaatgggattgtgttgttcttgatttgactctcagcttgaacgttattggtgtatagaaatgctactgacttttgtacactttttttttttattctgaaactttgctgaagtcgtttatcagttctaggagccttttggcagggtctttagggttttccaggtacagaatcatatcgtcagcaaagagagagtttgacttcttttcctgtttggatgtcttttctttctttctcttgcctgattgctctggctaggacttccagtactatgttgaataggagtggtgagagtgggcattcttatctttttccagttctcagggagaatggttctagcttttgcttgttcagcatgatgttggttgtggattttcatagctggctcttattattttgaggtatattccttcagtgcctagtctgttgagggtttttatcatgaagggatgttggattttatcaaaagctttctctgtgtctgttgaagtgatcatatcgtttttgtttttaattctgcttttgtggtgagtcacatttatggatttgcatatgttgaatcaaccttgtatcccaagaataaagcatacttgatcatggtatattaactttttgatgtgctgctagatttggtttgctagtttcttgaggatttttacatctgtgttcatcagggatattggactgaagttttctttgttttgttgtgtctctgccagattttggtatcaggctgatgctggcttcgtagaatgagttagggaggagcctcccttgatttttttggaataatttctgtaggattggtaccagttctttgtatgtctgatagaatatggctgtgaatccatgtagtctagggcttttttggttggtcagttttttattactgattaatttcagaatttattattggtctgttcaggttttcactttcttcctggttcaatcttgggaggttgtgtgtttagagggatttatccatttcctctagattttctaatgtgtgtgaatagttattcatagtagtctctaaagatcttttgtatttctgtggggtcaattgtaatgtcatctttgtcatttctgattgtacttagttggatcttctctttttcctttgttaatctagctagcagcctatcaattttgtttattattttaaagaaccaattcttgatttcattgatctttggtatggatttttgcatctcagttttgttcagttcttctctaatttatttcttttcttctgctaatttgggggctggtttgttcttttatttctagttcctccaggtacaatgttaaattgttaatttgatttaaattaacaaattgttaatttgattctcttaatgaaggcatttagttctgtaagctttccttttaacagttttagctgcatccctaagattttgtaagttgtgattctatttttattttcattaatgaaattaatttcattaattaatgaatgaatttttattaatttcaaagaatttttttatttctgccttaatttcattattgacccaggagttatccaggaataaattgtttaagttccatgtatttgtgtagttttgagagatcttcttaatattgatatctctttttattgcactgtagtccaagagtatacttggtatgattttgatttttttgaatttatttagacttactttgactgaacacgtgatctatcttagaatatgttctgtgtgtagatgggaagaatttgtatcctgcagttactggatgaagtattttgtagctttcaattaggtctgattggtcaagtgtcaagtttaagtcctgaatttgttagttttctgcctggatgttctttctaacactgtcagtggggtgttgaagcctcccactattactctgttgctgtctgagtctttttttaggttaagcagaacttgatttatgaatctgggcatgtatatatttggcatagttaggtcttcctgttgaatcaaaccgtttatcattatataatacctttctttgtccctttttactgttggttggtttaaaatcggctatatctgataaaagaattgtgactcctgcccttttttgtttttcatttgcatgttagatctttctccatccctttactttgagcctgtgtgtgtcattacatgtgaaatgggtctcttgatgacagcagtcaggtcttgtccttttatccaacttgccactgtattccttttaagtagtgacatttagacaatttatattcagagttagtattgatatatgagatttcgatcctgccatcgtattgttagctggttgttttgtagacttgattatgtagttgctttatagtgtctctaagctatgtccttaagtgtgtttttgtggtagtaggtggtggttttttgtttccatgtttagcactctattaaggacctcttgtaaggctgatctagttgtaatgaattcctcagcatttgcttgcctgagaaggattttatttctcctttgcttatgaagcttagtttggtgggatatgaaattcttggttagaatttcttttttctttaaggatgcagaaaataggtccccagtctcttctggcttgtaaggtttctgccgagatgtccgctggtagcctgatggggttccctttgtaagtgacctgacccttctgtctagctgcctttaagatcttttctttcatgttgaccttggtgaatctcatgactgtgccttggggatggtcatcttatataatgtctgataggaattctctgtatttcttaatttgcatgtcaacctttctagcacgattggagaaatttttctggactgtatcctcgaatatgttttccatattgcttattctctcttctctctcaggaatgccaatgagtcataggttttgcctctttacataatctcatatttctcagaggttttttttttccattcttcttcattctttttcctttatttttctctgaccaagtagatttgaagaactggttttgaagctctgagattctttcctcagtttggtctgttatgttgttaatactttcagttgtattatgaaatccttgtagtgaaattttcaattccagaagttcagtatggttctttcttaaaatggctattttacctttgtaaaattgttttactggattcattggattgggttttaactttctcctgaatcttgatgagcttccctgccatccagattctaaattgtatgtctgtctttcagtaacttcaatctggttaagaactattgttggtgagctagcaggctcatttggaggtaaggggacattctggctttttgaattgccagaattcttgcactgattctttctcatgttagagggctattgttcctttaactgcagtgtaagtcgagtatagtcaactggccttgtttctgggtgctttcagagggccacagctctatatagatctttactgtgcctagattcttgccctgggtgtcacagagatgtatattggcagaattattttggtgttgtaattttggctgtgatccagtagctggcatttaacattagtgtccagtggataggctcttactcagctgcatagttcttttgtatttctgtgtgttcacagccgtgctctgtggtggggttggggagagagatgaccactcataagggccactcctggaccatgggtgaggtccctcctatcactggcactgtacctgcattactgttgtttggtgtcttgggttgcagggctcccttagacagaggccatggctgccagacaggccacacccttcccagaccagcactgtggaggaaggcatgtcccattcctgcactggcccacgaacccacgtgtctcactcctttcagtgttctgaaagtgggatttctcccctacttgagtgccagccccagctcttagctcgacagccccagctgtgtgctgtagccctgtagcactgggaccagcctgtggctccatcgtctggaccctcagggtcaggcaccagctgtgctggggaatctgaaatgctcccaggctgccaggaaggtactcaggtggaaccaccagcaaaaaacaaggctaggcagcagaggctgccctgtgcacacattcctgcagggcagcttggcaggggccctggaaggggctgtaggggaggagggcctgcagaacagatgttcctctgtcccacagggaagctggccccaggctggcctgccccagcattcaggtggggctagtcctactccaggggaaataagaagtcttaggggatgggcgcctatggccaccttctgctgcagctgccttagatatgaaaacccctgggctccatgtattctggagctctgtctctgcctactgtttgggccaatccccctgccagttgaaacgtctccagggggcatggaatcttgtagctaggatctctgaggtccatagtgagagtgtgctgccccatcatccattcactcacccctttctaggagcctttcaaggccaagaaccagccctggcattgggcaacccccacaaggttaccagcttcctccctcttcagcttccagtttgtatcacctctctatcagctcttggtgctttttctccaaagatctgctcaaaatatgttggcttactcgatattttggtctttattagtggcagtggtgcttcttggccctgtctagttggccatcttgtccttcttccactaaaaattatttttaaaaatagtttcaggctgggcgcggtagctcatgcctgtaatcccagcactttggaaggctgaggcaggcggatcacctgaggtcgggagttcatgaccagcctgaccaacatggagaaaccccgtctctactgaaaatacaaaattagccggacatggtggcacatgcctgtaatcccacctactcaggaggctgaggcaggagaatcgcttgaacctgggaagtggaggttgcagtgagccaagattgcaccattgcactccagcctgggcaacacgagcgaaactccatctcaaaaaaaaaaaatagtttcattgataaccttcctttgaactatagttaatgttaagagttaacaagtaacatatgttgagtgcccatcagtgtaatacctcagatataaaagtcctgtagatttttaaaatatgatattcactcagttcttatttgcccagttaacagtgggatcggaattttttttagcttctaccatttacttatatttggagaaatgatgatgatgatgatgatatcccaagagcttttaatattactttaatgaatatttattaagtactcactatatgctctacatgtgtcatgtagagggtggcgcatggtggtgatttcatgacatacaggtattcaggcattgtccgaaatgttctctgggaggatgtctggaaaaaactccagttccagatcgcgtctgcaaccatgaaatctccccaccatgaatgaggaggaggaggaagaggaagagttataagtcaggacttacctcttgcctttattaatttgctgtttcaattaagtttaaataaaactacatgactgaaggatactgcccttcccctttccttcaaggctgccatttgaagggcctttgctagtttttgttgatttgcttgaaagtgtttctcttaggcccatgacccctttcatttatttttttatttaaaaaattgttaattgtagcaaaagcataacataaaactaaccattattaagtgtacagttcagtagtgttaaatagatccatattaaacagatcttcagcactttttcattttgcaaaactgaaaatctatatccctgaaataacaagtctctgtttccccttcttcatcccctggtaactaccattccactttctctttctatgaattcaactactctaggtacttcatagaagtagaatcatatagtatttgcctttttgtgactggcttatttcacatagcgtaagtacctgaaggtttatctacgttgtagcctgtgacttacacctttcatttttagctttggctgctgctgccatgttccctgtatttaagctgtggtttaaaacagcttgagaggactcaactcaggctgccaagaaaaatggcagcaagagctcattctacctattaaatactaacatgttgcttccaggagggaagtgagcaattattgtttattccaaaacatctggatatatatgcggttatatgttacagttaaaaatttgtatactagttcatgttaactgcaaagacaaactattagcaaattatctattagacttcatttggatttgtctctggtttatttaagttttgtctttgatagcagcagaaaatgaatcaataaatgaaaatgaatttatatttcttaaggcatccattactcatcagagatagttaatttagctaacatttggaagtgctgataccaccaacaaagcctagcatcaaataatttcttttaatttcttttaatgtcttaaacacaaataaaaaacttataaacaaatttgctttattttctgaatatttatagaatacgtaagaattggttttatcttcataaaattatataattgggcttatctgaggtttgttttcattctctttaattaaattattagttaatatctgatattcctatttattcttaccatgcatacaatctatagcccaatagcatgggaactcttttttttttttgagatggagtctctcgctctgtcgccgaggctggagtgcagtggcacgatctcagctcactgtaagctctgcctcccagtttcacgccattctcctgcctcagcctcccgagtagctgggactacaggcgcccgccaccacacccggccaattttttgtatttctagtagagacggggtttcaccgtgctagccaggatggtctcgatctcctgacctcgtgatccacccgcctcggccttccaaagtgctgggattacaggcgtgagccaccgcgcccggccagcatgggaactcttgaaataactgcatgtatttctttttttatccaaaaaactatttgaaagcttgctttgctaggttgttttttgcataagtgtgagagtagctagctatttctagtattaaatggtaatgggaaataaaattacagctgtttctgagttggatctccatgtggcttcattattttttcgctgtgaatttccagaagagtagatacaactgtaataaaatgtaaatgagaaaatatattcaaaaaccaaatataaaatgacttgaattatttttctggcttacctatacttcatttatctttattaaggttagtaagggaaatgtgtgtggtttatattgtagatacatgcacacacagcaggataaattttcattttaatgctcattaagaatttaattgtacttaatatattttgcagttataaaggaaatagaaaaataaagtctatcccatgtgaaatgactctcactggtattgttttgcccataagaacttctgtcttgtttcagtgaagcagggaacaatcactaatacaacatttgtatctcatttcaggatgatgatgatgatccttttatgaacactagttctttaagaagaaatagaagataatatatttaatggcactgagaaacatgcaagatacaggaaaaatgaaaatgttacaagctaagagtttacagtttaagattttaagtattgtttcctgagcataactccataagtaagaaatttctagttcacagacatacaatagcattgattcaccttgtttttttaacctggttgttgtagtaagagctttgtttcaatatcactcttgagtaaagattaaaataaagctaccattttacatttctatttcataatgaaaaactatgtcagtattttaatatggttacatttagccaaagttgagggaaagagcttataaaatttaacttcttcataattttagtaatttcctagaggttctgggttttctgaaagtaaaacaatttatgcgaacctatgtctaaattcactgtttgttactatgtatgtttttttccaatgcttcttataagactaaatgattagaagtacctaatagtttgaacagatatgtttttatttaaaagagtagaataacctttcagaattactgagttttttattccagttgtagcaaagatttcaaaagattgtgttcccattaagtggtagtaatttcctttattattctgtatccttaatggtgttctctctctctctctctctctctctctctccctctcccccccgttccccactcttcctttctcctttgctttttcttctctttcatacatatatgcgtgcctagttctaggaggaaacgggttaaaaattgttttaaactacatcttgaaaatattgaagaatttgttttaggtagagtggtcagttgaaccttacagtaaagtatagaaatatatttaatgtggaatgtcaatgccaggatttctcattaacaatattttatctcaactttggttcctgtgatacatttctgaatgggcaattccagaaatcttagtagcccatgttaagcttctattttttacttgttttcggggagaaataagaattagacatcttcagatttaagttaaataatcccattctttataatcctctgtaaaaagatccctgagattattccttcttctagttttatgcgacagctttactttaaaattcaagttatacatcttgggagtacaatggcccgacatttcttcataggtagaaacaaatacttgactcagtgatactcatgaccattagaatagtcatacctggaatgtgtcaaattataagagacagacacttggttagtggctgcctcatatagcacttttgaagaggcctaagtcaaaacttgcaatataacattctattgactttcttaaaaatattttttctgtacctaacttgagcataagggttatttgagcaagtaacattaactcagtggaaggcattgtcctgtgaaatattcttaggcagatctgcccacatctttattgaacttgaaatctaatatttctagtatttgaacaaagcagaaggttaagtcagggaagagcagtgctgtccatgatgtaatggaagctaccaggggaggcagtgtctggatgatgctgtgctacctacccctgcacaagccatgctggctcagtctgagctgtgggccacatcagctagtggctcttctcatgcatcagttaggtgggtctgggtgagagttatagtgagggaatggtcactaaagtatcctgacaagttcctaggaaaaaaggaataaagtttttttccttaaaaaaaaaaaaattgctcttggctgtgaaaagaggtactaaatgcgattcagttcaccgctaaggaaagtgatgacatagcagttacagagggtgataaatctctccagctaattcaggtcattttgtgaatactatgtatcaagccctgaaaatatggtaaataaaacgtgacagggaaacctttttttgattgaatattgttacatagttaaatgtgctatatatccttaatattttatattgatcctgcaaaatctgttggttttaggggagttttgttttttgtttctaacaattttcagacctgttggtataggaatgtagaagtctttcagatgatttgaaagcagctgcatttgctcttggaggctttgggagagcaggaatgaaaacattcagaggaagacatctgtagggaattcttctgttacttaccaaagaataagtgtctttctggtgttttatttcctatcataaaaatacaacagtgcatttacaaggttaaagattcctcgaagttctaggaaattcttgaaaatataagtggtgcttagaaaattcaagcatttaggaatgtgacctttaattcaggtatgtaaaagacttttttcccaaacttttaaaagtaggaaatacaataaatacagaaaagtcatatggttgaataaataattataaattgagcactgatggaatccctctacaggtcaagaaatagcgcagtgtcctggatgcccattatattgttttctcctttctgggtaacaagccctaacttctgtaatttaaaagctcctacttttgccacaaggtggtgcttctgccattagacgcagttaggaggatgcaactgcaaatctaaaattacgaagttagtgtagttgcaataaacttagaacatatgcattaatactaaacctatgcagtaataccataattagccttctaatcatgtaatttgctttacttaggtatttcatttggttcagcctgttatggaatttaccagcttgataaatttgcctataaagttttataaagaaaaggaatattttgttttcataaagaggaaaatccattcttagaaaaaaactgagtaaaaaagtatctcaatgggctgggtgcagtggctcatgcctttaatcccagcactttgggaggccgaggagggggttcacctgaggtcaggagtttgagaccagcctggccaacatggtgaaacctcgtctctactaaaaatacaaaagattagctgggcatggtggtgtgtgcctgtaatcttagctactcaggaggctgaggcaggagaatcgcttgaacccaggaggcagaggttgcagtgagccgagattgtgcccttgcactgcagcctgggccaccagagtgaaaatccatttccaaaaaaaaaaaagtatctcaatgtaaaatatcttctttggaaatatagaatttaaaagcgactttcccccaaagtaatctgatgtcctttttgtatctgtcataaatttaattcatagtattttgtgttttttttgttttttttttttgagacggagtctcgcactcttgcccaggctggtagtgcagtggcaccatttcggctcactgcaagctccacgccattctcctgcctcagcctcccaagtagctgggactacaggcgcccaccaccacgcctggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacaagcccccaccaccaaccctggtataattttttttttttttttttgtatttttagtagagacagggtttttctgtgttagccaggatggtctcgatctcctgaccttgtgatccacccacctcagcctcccaaagtgctgggattacaggcctgagccaccacgcccagcctattttgtgtttttttaaagctaactaccattaagatcattatagaagtttggtataatgaagatttgggtttttcagtccaatgagtttccatattcttgaatgaaaaagatccacatttcatcatttgcctgtttcattttcttttagtacttttgaacttagtttggtcagaaaatactagaattttagtttgatctaaagaaccagcttatataacttgctgttgccatgtacatttgtatgtctttgctgtgtcaaataactggatctgattttagctctttttaagtggtgaaagcaatgcatttttattcttcaaattcagacattgaatgtgtattaaaatgtgtgtgcttacctttaatcctctccccaccgacaattaggaacacgtttctccaattactgttggcaagactaccaagaaaaattgttgaattagaatcccagcaccgggcacggtggctcacgcctgtgatcctagcactttgggaggccaaagcaggcggatcacctgaggtcaggagttcgagaccagcagggccaacatggcgaaaccccgactctactaaaaatacaaaaattagccaggcatggtggtgggcgcctgtaatcccaactactcaggaggctgaggcaggagaattgcttgaacctgggagttggaggtcacggtgagctgatatcacgccattgcactccagcctgggcaacagagcaagactctgtctcaatcaatctatccatcaatcgataagaaccccagattgtatagctacatgttttagcccccttttcaaagtatatgttctccttggtacttattttgacattctgacttttctacatatgctttatcaacctcttaattaaaccatcattgtctattttgagagataactgcgctgcttcccgttgtgtgttttaaatgttattgttcagtttgagtcaaataaaaggatatttaatctgtggtgccttgacattaaaagtggtaaagtgatttttaaagggctcttggctggcttttgcacattatggctgattaacaaaagaggtttaatggatattaggctggttggcccatgcaaactttgttctgcctctgagccactgtgtagtcaagatggttcatgtacaaatacccaaaactagtgcataagtacccttgatcacagtgcctgttcaatatcagtaccaagtgtttcgtgtttatattttatgtaaaaatcagaattttctacatagaagcttataactgcagtctacctgttagtgcatttgaactgatgggatggtatatctgactttgagtacattttgctagaggcaaaaggccattgcttaataggctgagaggcccaactgcatttccgttggttcttgggtagtctggaaatgaaggcatccattttacactcattaaagtgttttaccataaacgatgagataaataaataaacccatcataggtatcctgaaagtttctagtggtttgtcattccagtactgatttctgaggtttttagtagttttaagtccagatcatatttttaaaacttgaaagagtatcaactttacagaaagttgcaagaataatggataactttttatagtttattcagattaaccaatttttgacattttgtcattaaaaaaattctatatgtgcatatatgtatatgttatatacatatattttcatgtcaaatgtgaacacacacataaaatttctcaatcttttgacactaggttggaatgtcatgttcctttactctttaatacttcattgtatgttccctaggaacaagaatatccttttataaccaccatactgttaatctacagtccattttccaatttttttatttgttccaatactttccttatatagcatgtttttccctctagtctaggtttagttttattctgtgaatatgtagagtatcaacgtgcttcctgaagtctaaatcattcaaatgcacactcaagtcttactcccttccctattcctttcatccctttttgccccacccattgtaggtaaccaatttcatttttgtttattcttttcaccaaaatatgcaaatttgtacattttttcatgtcccctattttcttacataaaaggttttatgctatatatactctttttgtctgaacaaatggagttttttgtcctacaaactactccatgtcattttatggagatcttccttttttatagcctcatggtactccattgagtttaaatgccatagtggattctgtcctcctatatttgtgccttttggtagttctgatatttacaattacaaataatactgcaatgctaatactagtatttttaatactgcaatactaatactagtattttaaaatttttagaagtgttatcttcagagtaaattcctggaaatgtgattattcggtaaaagagtaaatgtacatgtagttttgttaggtgttgccaagttcctttttataaaagtggtattcccaccaacaatatgtggactacctatttctctatagcctcaccatcagaagaatgtattgtcgtcagatttttgattgtttgccaaactgatggacaagaaatggcatcttagtgtaattataatttgcatttctcttatgaattaagttgaatttgcaaaaatatgcttaaggcacatttttacacccattttcggtgaattgcttgttcgtgtatcttactcatttttctagaatgtctagtcccctttttcttcactcgatataaaaagtattttttaaatattagatattaaccctttgtctataatatattgtaaaattttttcccaacttcttgtttgtatttttattttgcttatggtgactttttttgcagtgcaacagtttgtttttaatgtagtcaaatttatctggttttgcatctggagttggtttttgttgtataaatggtgtctaattgaacagagggtcttttaaggaacataacttttttatttttataattgcataattggactttatgaagtccaacttacattgattaaggtgtaatgtttttgtgttctgttcaagaaaaacattgcttaccttaagctcatgtaacttctgtgttatcttcagaactttatgttttgcctttccaattcaactccacagtccagctgggaattgatttctatgctcttaattgctattgggctatttttttctattttgtttctgctatgtgctttgtttcaaatcagatcctcagaacatgaaagaaaataattatctgttaatttaagctattgattaatattgcatcttacagatggggaaataatgattaaagtggattgtttttgttttaacaacaataccatgtaaaaatatctttaaggatatttctagaaaacatggccagatcagcaactcattttcacaggatgtaagcaatagctatcattgatcttacatgcttttaaaaaatgcttctaataagatttttttaattgccatttgaggccattatttttgagcaccagagaaagaaaagttgtattttttcatactggctctaactgccttgtgtttcataaagttcatgctatgataaagacaaattctagcaattacagttgaagatgcagcttgcaggcagtggaacagggaaggttgtgatgatcatatatctcaggggaaaagtctgtacacagtgaaggaaacatgtaggatctgaaggtgaaagtccgttcttgacccaccagttagactattcgacaaaatcatacgatattataaaaggctgaaattaagggtagagtgataaaaatcgaaattgtgtgaagaaaatgaccatgtcttttttttttttttttttaagttcgagagagttttgctttgtcgtccaggctgaagtgcagtgatgtgatcttggctcactgcaacctccatctctcccagattcaagtgattctcctgcctcagcctcctgagtagctgggattacaggcacgagccatcacacccagctaatttttttctatttttagtagagacgagacgggttttcactgtgttggccaggctggtctcgaactcctaacctcaggtgatccgcccacctcggcctctcaaagtgctgcgattacaggcatgagccaccatgctcggaccatgccatttatgctgtacttacaagtttaattcctaaataacaattcttaacagcaagtgccttctggcaggctgtggactcccagcctgggttcatcctgaattcacctcttccacaaccttttattatgtgatgccataactctcgacactgcctttcccattaaattgagtttccttaagggaatgccccttgctgtttttgtctctgaaccaagcctagcatggtgcctggcatagagcaggctcttagtaaatacttaatgcatgactatgtgaagacataatagattttgttaaaagaaaaaaattccaaagcactcacagaaataaagcagagctgttaatttccccctcactccttgacaatggaaataactctcgtaaacacaaatgactgtgctatgcagtagaggcattagagtcttaagttatgaagtcaatgacttgatttccaaacaccttcttacccaaaattgccaccctagtcagattggttcagttggctgatcagaccagtgactcatctgtgacagtggcaataattaggaacctgttacagataaagatggactgttgtcctctgtaaactactgagttttttccgagtataaatagtatttgtgaaaaatgcaaaagaatatgaagaaaaaggatatcaaaatcctgctattaacatttcactgtgcgccctttaacgcttcacataattgaagtgaaattgtatcagtttgtgtcctgcttgtgttattctgaaagcattttctgtgttactaaatttttctcaaaaacatttcttttaatggttgcatagtgttttgggtcatggaataccacagcataatatatttttcactataataaataatgcttgatggagtcatctttttacataatatttttatactttttatgtggagatagggtgtgagaaacctacatatatccatcatcctgcttcaatccatttctcttccccaggtccagatgattttgaagcaaattccagacattgtgttatttaatctgcatgtatatatgcacatgcgtatatataataaacaacaaggactctttttaaataaaatatgctgtcagttgtacataaatctttgaccacattttaaaaattatatccgtaggctaggatagagtaaaaaatagaatttcaggtaaaggagatgaaaatattttaaggcttatgacagttttaccagattcctttgcagaaaggatatatccatttatactcccaccagcaacatgagagcacctccttcactgcaccctacccaatacctagtcatttatttgattttgtgaacttcacagtaaaaggtttcttccatttggttttaggctttaacagtactcttcacccagaagctaatgataagattgttgatcagtcagacctgggcttcaatctttcagtccttttagctgtgtgacttatacaagtcagtctcagaacatctgcttccccattcagtagataaaaatgcctaccttgtatgttttgtgattagatgcaatgatgcttatgaagtgattagcacagtcccggcatataaaaccttcgatgattccattggctgctagctgcatcttcaactgtaattgctagaatttcttttatcatagcatgaactttatgaaatagaagtcagtgtaaaattaatatgaaaaaagacttctttttctgatgctcaaaattaatgacctcaagtggtaattcaaagaaataaaaaaaatcctattaaagcattttcaaaagagcctaagatcaatgatagctgttgcttacatcctgtgaaaatgagttactggtcctgtgatgctttctagaaatatccttaacaatttttttacttggtattgctattttttaaaaaaacactttaatcatcattctccctctgtaagatgcaatatcaatcaaatagcttaaatatggctaattatcctctttctcgttctgaggatcggattcaaaacaaagcacacaacagaaatgaaaaagaagtagaaaaaaatagcccaatagcaattaagagcatagaatgagagctgatgttaagaaatgtgactcaacctatagaattgtagaaaatccccttgaaacatttaattgcacggctctactctttagaggaactgtatcttccttttgtcccctctgagagctaatgaagaaattctcattttatgagaacacttggacacagggcggggaacatcacaccccgaggcctgtcgtggggtggtggggaagggatagcattaggagaaatacctaatgtaaatgacgagttgatgggtgcagcaaaccaacatggtacacgtatacctatgtaacgaacctgcacgttgtgcgctagaacttaaagtataattaaaaaaaaaacctcattttaagtggttatccagcaacagaaccagaaaattgttacttttacagaaggtaggttttattgcatatacaaaatggatattgttattttaaattagatatgtccaaggtaaacgatcgtatcagcaaacaagaacagtttgacttcctctttactgatttggatgctctttctcttttgtctgattgctctggctaggacttctggcactatgttgaagaggagtgttgagagtgggcatccctttcttgttctcattctcagaatgctttcaacttttccccattcagtattatgttggctgtgggtttgtcatagatggcttttattacattaacgtatg

SEQ ID NO: 1223 - DNA, 2613 bp, Homo sapiens
gaattcaggtttacggccctgcgggttctcagaggcaagttcagaccgtgttgttttcttttcacggatcctgccctttcttcccgaaaagaagacagccttgggtcgcgattgtggggcttcgaagagtccagcagtgggaatttctagaatttggaatcgagtgcattttctgacatttgagtacagtacccaggggttcttggagaagaacctggtcccagaggagcttgactgaccataaaaatgagtactgcagatgcacttgatgatgaaaacacatttaaaatattagttgcaacagatattcatcttggatttatggagaaagatgcagtcagaggaaatgatacgtttgtaacactcgatgaaattttaagacttgcccaggaaaatgaagtggattttattttgttaggtggtgatctttttcatgaaaataagccctcaaggaaaacattacatacctgcctcgagttattaagaaaatattgtatgggtgatcggcctgtccagtttgaaattctcagtgatcagtcagtcaactttggttttagtaagtttccatgggtgaactatcaagatggcaacctcaacatttcaattccagtgtttagtattcatggcaatcatgacgatcccacaggggcagatgcactttgtgccttggacattttaagttgtgctggatttgtaaatcactttggacgttcaatgtctgtggagaagatagacattagtccggttttgcttcaaaaaggaagcacaaagattgcgctatatggtttaggatccattccagatgaaaggctctatcgaatgtttgtcaataaaaaagtaacaatgttgagaccaaaggaagatgagaactcttggtttaacttatttgtgattcatcagaacaggagtaaacatggaagtactaacttcattccagaacaatttttggatgacttcattgatcttgttatctggggccatgaacatgagtgtaaaatagctccaaccaaaaatgaacaacagctgttttatatctcacaacctggaagctcagtggttacttctctttccccaggagaagctgtaaagaaacatgttggtttgctgcgtattaaagggaggaagatgaatatgcataaaattcctcttcacacagtgcggcagtttttcatggaggatattgttctagctaatcatccagacatttttaacccagataatcctaaagtaacccaagccatacaaagcttctgtttggagaagattgaagaaatgcttgaaaatgctgaacgggaacgtctgggtaattctcaccagccagagaagcctcttgtacgactgcgagtggactatagtggaggttttgaacctttcagtgttcttcgctttagccagaaatttgtggatcgggtagctaatccaaaagacattatccattttttcaggcatagagaacaaaaggaaaaaacaggagaagagatcaactttgggaaacttatcacaaagccttcagaaggaacaactttaagggtagaagatcttgtaaaacagtactttcaaaccgcagagaagaatgtgcagctctcactgctaacagaaagagggatgggtgaagcagtacaagaatttgtggacaaggaggagaaagatgccattgaggaattagtgaaataccagttggaaaaaacacagcgatttcttaaagaacgtcatattgatgccctcgaagacaaaatcgatgaggaggtacgtcgtttcagagaaaccagacaaaaaaatactaatgaagaagatgatgaagtccgtgaggctatgaccagggccagagcactcagatctcagtcagaggagtctgcttctgcctttagtgctgatgaccttatgagtatagatttagcagaacagatggctaatgactctgatgatagcatctcagcagcaaccaacaaaggaagaggccgaggaagaggtcgaagaggtggaagagggcagaattcagcatcgagaggagggtctcaaagaggaagagcagacactggtctggagacttctacccgtagcaggaactcaaagactgctgtgtcagcatctagaaatatgtctattatagatgcctttaaatctacaagacagcagccttcccgaaatgtcactactaagaattattcagaggtgattgaggtagatgaatcagatgtggaagaagacatttttcctaccacttcaaagacagatcaaaggtggtccagcacatcatccagcaaaatcatgtcccagagtcaagtatcgaaaggggttgattttgaatcaagtgaggatgatgatgatgatccttttatgaacactagttctttaagaagaaatagaagataatatatttaatggcactgagaaacatgcaagatacaggaaaaatgaaaatgttacaagctaagagtttacagtttaagattttaagtattgtttcctgagcataactccataagtaagaaatttctagttcacagacatacaatagcattgattcaccttgtttttttaacctggttgttgtagtaagagctttgtttcaatatcactcttgagtaaagattaaaataaagctaccatttt

SEQ ID NO: 1224 - protein, 708 aa, Homo sapiens
MSTADALDDENTFKILVATDIHLGFMEKDAVRGNDTFVTLDEILRLAQENEVDFILLGGDLFHENKPSRKTLHTCLELLRKYCMGDRPVQFEILSDQSVNFGFSKFPWVNYQDGNLNISIPVFSIHGNHDDPTGADALCALDILSCAGFVNHFGRSMSVEKIDISPVLLQKGSTKIALYGLGSIPDERLYRMFVNKKVTMLRPKEDENSWFNLFVIHQNRSKHGSTNFIPEQFLDDFIDLVIWGHEHECKIAPTKNEQQLFYISQPGSSVVTSLSPGEAVKKHVGLLRIKGRKMNMHKIPLHTVRQFFMEDIVLANHPDIFNPDNPKVTQAIQSFCLEKIEEMLENAERERLGNSHQPEKPLVRLRVDYSGGFEPFSVLRFSQKFVDRVANPKDIIHFFRHREQKEKTGEEINFGKLITKPSEGTTLRVEDLVKQYFQTAEKNVQLSLLTERGMGEAVQEFVDKEEKDAIEELVKYQLEKTQRFLKERHIDALEDKIDEEVRRFRETRQKNTNEEDDEVREAMTRARALRSQSEESASAFSADDLMSIDLAEQMANDSDDSISAATNKGRGRGRGRRGGRGQNSASRGGSQRGRADTGLETSTRSRNSKTAVSASRNMSIIDAFKSTRQQPSRNVTTKNYSEVIEVDESDVEEDIFPTTSKTDQRWSSTSSSKIMSQSQVSKGVDFESSEDDDDDPFMNTSSLRRNRR

SEQ ID NO: 1225 - DNA, 30057 bp, Mus musculus
  misc_feature (1)...(30057): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttgggtactttctctagctcctcccttgggtagccctgtgatccatccactagttgactgtgagcatccacttctgtgtttgctaggccccggcatagtctcacaagagacagctatatctgggtcctttcagcaaaatcttgctagtgtatgcaatggtgtcagcgtttggaagctgatcatgggatggatccccggatatggcagtctctagatggtcaatccttttgtcacagctccaaactttgtctctgtaactccttccatgggtgttttgttcccaattctaaggaggggcacagtgtccacactttagtcttcattcttcttgagtttcatgtgtttagcaaattgtatcttatatcttgggtatcctaagttttgggctaatatccacttatcagtgagtacatattatgtgagttccaccacctgaatttttgaaatgatgtcctaatctatccaggagacagatgaaagttgtgataatcacagggacctttgccagatggactcaaggaacttcagttcaaaaccatgtgctcagttacttcctggtcctaactttcatgccattgaatcactattatgttcaccaggtttctgtggtaaatctccatctgctccttcatgaagaagagcaggcaacatgtgtgtttgcaggaggagctcaccctgtaaagccctcccagtttcctccctcgcatcaggagctctacaggcaacatcagggggatccagagtgcccccgccagcctctaaaatgtcaccacttgacaccctgccctcatcccttggagcccttctctatctctacctgcctgtttttatttctccccttgttttatctcatgccatcttggtttttgagacaaggtccttttatgaagctcaggctggcctacaatttactatgtagcccagtctggccatcaatttacaatccttctgcctcagcctcatgagtgttaggattacaggcataggtcaccacatcttctgcataactcatccatccatccatccatccatccatccatccatccatccaaccatccatacattctatccgttcgtctgtcaggatcctactctgacagttaggttcctgaggaaggcagtgaggtatatggtgacatttaactctttcctgctattctggggcaaaagctgttggcttctgacaatttgactcttatctgctattcaggggccaaaagcataggcttctggccagtaatgcctgctaatagcagcagggggaaagaaacatagttatttgagttcttttctctttgactcagggatccctcactggccaggtgagaggctcagagttttttaattcttttgattcagagagaaaagaaaagaaatggagagtgcatgagcgcatgcgagagagagagagagagagagagagagagagagagagagagagagagagagagagagagagggagagagagagggagaggagagagagagggagagagagagaggaagggggagggagagagagagagggagagagaaagagagagtcaggcacagagacaacacacacacacacatacattggatgaagcagaaaaagggcttcaccacagtttattgttgttcttagtttttataccttctcagaataattgatcgtatagttttaaaagcatttttacattccataagttcatagtaagcttaaggcaatagttaaggagttacagaaaaattgtttacatgtctttccattaagactagtgcctaaccattcattatctgtttttagcctaccataagttcattataagtttaaagcaataatttttatgtcataaattagcacggttttgtcaagagacaaatcatctgccctatgtcttgttgttttgaagtcttgtatagattaactagtctattatttattttctgtccttgtgcctacaataaattgcccattcccagttatggtttttagttatcaggattcctaacctagaacgaatgttttccttgatcataaatttgttccaagcctgctttcttttccctagtgcaattagcccatgacgcatgaaggtttagagagctttacttgtggcctttcttctatagagggcttgagaatacttgtatcaatttaggaattctataaacttattaacaggaattatgaaataatcagttcatcaacatagcattactacatgaaagtaaatcttcatattgattctgcaggaaatctacccaacagtgtgggctgctgcccagaaatcattaaactatgtgatagtggcaggaaaccattaggctattggatatcagcagcaagaggcattcctgagatggagtctctaaagactctacacctcagagcacacacatcacagtcatgcaaaatgtcatgccatctctagaaaactcacttacttgccaaagcctttcctagatgacttctgacatccatccattcaaccatgcagcccactgaaagtttattgggtaaccagtcgtgatagtattacaaactgtacagaatctaggatcagctgggagacaagcctcaagacacagctatgggggaattacctaaattggcttctcatcatgcctataggggattatcttgattagattgaagtgagaaggcccactattggtggtaccattccccaggttgggatcctggctgcatacaaagaggaaagagaactaaacacaagcaagcattcattgttctctgatttttcttttgccttgtttttatttttgttgtttatgtatttatttatttgagactgtctcagtaggtagacctggctagcctggatatgtatatatcaatcaagctatctgagaatgcacagagattcatctgcctctgccccctgactgctgggattagaagcatgcgccaccatgatcagctgttctctgcttctcagttgtggatgtaatatgctcaattgctttaaactcctgtcttgacttctttggcatgatgaattatatctttaaagcataagctaaattagatcttttctcccttaagtggcttgtgtccagctattttatcagaaacaggaaaagaaagaaaatcatcagtattggtgtatcattgtgtgtgtgtgtgtgtgtgtgtgtgtgtgtgtgtgtgtagcccacaagtctaaacccactgctaaaggaggggaagcaaatacaatcctgagtggttatgcaagacactcctgaataatgtcacctccctggagggcctgctgcctccacttctccaggaatgcaccctccaaactttttcaataataactggactgcagctgacctgacacaccccatgagcatcttcctggcacatctgagctggagacggctcctggctcctggctcctggctcctggctcctggctcctggctcctggctcctggctcctggctcctggctcctggctcctggctcctggctcctggctcctggctcctggctcctggctcctggctcctggctcctggctcctggctcctggctcctggctcctggctcctggctcctggctcctggctcctggctcctggctcctggctcctgggcttctgactcctggttccagaagggatatggagatgaaatatagtctaactgaacatttggagtggccagtgtttccttagtgggaaaagagtctctgtgtccagaaatccaggaggtggggtctgcagggagtggggccgctggtctgccaggagtgacaggaaggtgaaaagggtagattaaatctcaccaggtgtccatggctgttggtggagtagggaggctcctgtttctcccacagagcccttttctgtgcttagaggacaatggttctatcttatgaaaggatgcagtttcatgaaatcatttgctaaaagctcaagggtgttgtaagttttccagcactgaaggctttcatttactgggcatagaggaagcaaggtcatttcttagcacattggctcaagggagaagtgactgacgtgtctcctgactttgagacatggtaggtagtttctctgacttggctgatgtgaaaatgtaaagcttgggaatcaggttttccttctggctgtgcctttcattagccgcgtgaccctgagcaagattctccttccctgactttagttctgctcacctcagagggccggcagccccagtgttctgtgtgaaggagaagctgagagccgtcaggaggctgagctcacatcactgggctgtgaggaggtgacggttggttgatggaggcagaagaatgtggatgctccatcagtccctacctgtcattgtagggtggggggagctgcgagtagagagccagagtgactgaagaagcatacacaataacaagagaaacccccatgtccttcccctaagcatatatacctgccaggaaccaggaagagagcagagaatggctggctggctgtgccaggtatccacaaatggggctgcagtgagtggaaatgccagggactgttgtccattccacccctggccaggacccacacagctggacaagggctgcaatgattcagactagcatgcagcttacaggcaatgaagagagatggacggtgagtgaaagaggcagagagcaacaaaggacaacgcccactgactgtaaaggccagggcaagcgtggatggtgggtcccaagctgtgctgtggagggaaaattgactgaagtcaggagccctaccctagaattgtgttcttcctgcagaagccaagtagtccctcttgcttacatttcctttcccagaattcttttcttctatgcagctggcaagacaagaatcatcttagtcctttcagaagaaagaaattttcctaagagtaaaagcaaatagatgtgaacctcattcctgctgactatgtgattgttttgtttttgttttgttttttaaatcattttcagtgatcctgatttatgaaatgagaacagcacttgtttagtcagcagtaaaccaggagtcattttgacatctcaggctcaggtttactttagaaatcctgaataacaataacagcttaggaggcaggggagcctccattgtgccaggacttgccaggcaagagtggccactttagtttgatggccagtaccaatattgaaagccaggcacataccagtaatcccagctttgggggggcagagactgcaggatacctggtacttgttggctggccaatctaaccaaatcagtgatccccaagctcagcgagacaatccgtctcaaaaaaacaaagtggagaatgaaagaagacaacgcctgacataagcctctagctcacacacacacacacacacacacgcctatacacatgagtgtgcacccacccaggtgaacgcagatgcacacataccccacccacacaagaatggatttagagcaagaggcacttgctcagtcttcaggcgaatctgctatgggaacatcagagaaatttatcacacagatatcacaaatgctattattagtatctgagaaccaagttgctcaaatgcaaatgttgctctaaggaacccatgagggggcagtgaggtggctgagagggggaggtgcttagtgagcaggccttacagactgaggtcagtccctaaagcccatgccaggaggagagaactggaccccaaaagttgtcctctgaccacaacacggcatgcatggcccatgtgtgctcatataccccccatatgagcacacaccagtaagtaaacatttataaagatgttcatgaggcttccacgcacacactggcttatgtgaacttctgacaagccttggtacttggtacttggttctcctgcttggttttggtttttttcatttatcttatttttttatttggaggaaggtgtgtgtgtgtgtgtgtctctctgtgtgtgtgtctgtgtgtgtgtgtgtgtgttgttgttgttgttgttgttgacagtttctttttttaggagaagtctcattatactgcccagttgttcttgaactctttttgagacttaacaattcccttacattgcattcaaagtagtgggctctctttgaaaagggagtactattagcttacagcccgtgaatttgaattagtaagtaaactaaatctccattttcacaaccttctcactcagttatttcatctcctcatggatagctacctaaacctaaagttatgataacaatacctgtattttcatccctatgttacagttgatacaggtttcatgaaatactgtgtatactcaaaagtactttaaaattaagtcttatgttgaatagcttatgtagcatacacttctggcatttaaatattttcatattgctaactaaataacgtgtttctttgagtccttacgttttatatgtttggagttatctttcagaggtgggcacacaggtttcacccgtagggtttggggggcacactcatcctaaagcctggtccagagcattggcacaggttcctgagacaagagctgtggttagggggcttttctgaggatgttcacaggtttattctaaatctagggcaacatcatgttctcatcccctctgtaggaaccaggagcctggagacattgggctctcctttggactcctcttcgtctctgctacaggacgtgtctactcaggcatgtctgtctccctagttccttatgctggtccagagcagggtccagtgaaacacaaaatagacttatatccctgttcaaactagcacacaaccagcttctcctgtcagacaaggtgcgcatatgttcacaagcacacacaaacagactagaaacttaggggttattattgggatgtggggtacatgcacggggacttctaaaaagaaaataaattcaaaatagcctccggcactttgtttttaagactcttgctggcagtgtgagtgtaatcctcctatccccccatggctggtccaacccagcttcatgtgatcacctctccctccctccacacagggctgggtccccaggatatataaatgtctttggacttcagacttgagccagcagggccacccatccagacaccttgcaggagaactttccagaagaaacctcacccagcctccacactgctgtccttctctgcacgctgctgcagctgtggtcccaagatgccagctctccatctgctgtttctggcctgcttggtgtggggaatgggggccaggacagcacagttccgaaaggccaatgatcggagtggccgatgccaatacaccttcactgtggccagccccaatgaatctagctgcccaagggaggaccaggccatgtcagccatccaagaccttcagagagacagcagcatccagcatgcagacctagagtccaccaaggcccgggtcagatccctggagagtctcctccaccagatgaccttgggccgagttactgggacccaggaggcccaagaggggctgcagggccagttgggtgccctgaggagagaacgggaccagctggagacccaaaccagggatctggaggcagcctataacaatctccttcgagataagtcggctttagaggaagagaagaggcagctggaacaagagaatgaagatttggccaggaggctagaaagcagcagcgaggaggtaacaaggctgcggaggggccagtgtccttccacccagtacccctctcaggacatgctgccaggctccagggaaggtaagagtgcagggtggagtggccacctgacccagaaggtagcaagtttgctggtgacccattacaggacccccaggcttctccttctgttttgtcttttctctcagaaactgcaaatccagcatgcagtagtttcattaaggagagcaaagcaaacacttttgcatgcttctagaaagttggctcccttgtttaggtcagtggatctgagatcttgtgcccagtcatgacaaaatgatcacggcccacagccaaatgacaaacatggggccaggtggcagatacatatgatgaataatcaatagaaaatggcttgctgtgcccttggataatttattctttttcaacctttgcttagaatttgcgattcctaccaaaatgaccccctatttatgagatgccaaatgatttgtacaatgaaaactggttgtttattattattattactgctgctgctgctgctgttgttgttattaatgtatttggtttttcaagacagggtttctctgtgttgtcctgactgtcctgaaactccctctatagactagactggccttgaactcaaagatctgcctgccccttccccctgaagcaccaagattaaaggtaggcaccaccatgcctggtggtgttttatttttttaatctcttaccttggtaaagaaagaggaaacaacttctctctcaggtcccttggtgtgtggctatggaaattttgacttttgttgctgaatcaaagaatatctgctttcaggtcaccaaaaaactctgcagtggcccttctcacaaacgcccttttctgtttgtcccggctcctgcctggagatgggtattcgggtgcactgagagatgggcacgttattttggacagttagaagacagtatttgtgccacgttttatgagtgttttgttcccaaatagttacttgtttcatgaacacacacactcagttgtaggaagtctgggctccttaaaagtgtcaatgacaagcaccaagggaatcgaggcgaaaggttcattttaaacaaagcagtctaagaaacctggtaaccaaacacgtgggcgtcctccatcagctctccgtggtcaggtgacagtgtagttatgagggacactctcccaagcatgtgctcaagttcctagaaccaaactgtcagtgcaaggagcatgatctcaagggccctaccaccttctcggggttgaaagcctcctggtgtttaccttccttgctggtgccggcttctgctttgacagccagcttgtgtcttctatcgcacattctcttcctcctattaatgaattcctagttaaatatttatatttaagctggaagaaatccagttccacattggaccacagagaaaagttgaggtcctaagtggctaaggggccgagggctgcctaagacttcatctggtctctgaaaggacagatggggaaatatcatcactaaaaggtatacgccaatttcagacttgaagttacactctcaacaacaacaacaacaacaaaaactatgtaatgttatatacgtggagtgtatgtatgcacgtgaaaatagaggcaatgctttaaaattttactgtcttgtggtcttttagtttaaaggacatgcctggccttgggaatttattggatgtgttctctaattttacttccatccccctttctagctattctccttttgacataggcccacagcccattataacgaacttagagtgtggatgtccttttctatagtggagcattaacaggccagggattgcatgagggcagaacagataactggacaggcaccttgaaagtatttagccatgggctcatttgtgtacatgtgaaaactgaggccagagagattgctggtccgtggccacctagtctatgaacagcactgtgagaactagaattctgccttttctaagagttgataacattcatgatctctactgtcttcaagtttgtagaccttaaaaatgtcagagagcgccaggtggtggtgatgcatgcctttaaccccagcccttggaaggcaggggtagagaatctcagtgagtttaaggccagtctcgtctagagagcaggttccaggacagccaaggctacgcagacagtccttgtttggggcggtggagggataaaaagtcaaagagctacagaaatacctggaataaaatccatttccaggccccaggcttggaagtcagcagtattctgagggtctggaactcaagcggcaggaactgaggtatgaagacctgaggtataggtctcagtagacaaaggcagggtcgagaagacaggcttcttcctacccaccacacagttcaaaccgtcagcgccactttacatggaattgttatatagaaaaacctcctcagaatcaatcactcatgtggatttcagcacgagcacctacacaaatgtaaacagaagtactattcaccctaaagacaatgcaacagcagttccctcggagactgaggagttagacccagacatcaatgagggcctgtgagcaagtagtttacctgggccctgaagccaggaaaagaaatgggacattatggagagtgacacagggaatgaaactaggaagggaggggagccatcaaattgatggccacatgtgatgtgtttataaaaagacaaagagggggggaaacatgttctatggaggtgtggtgaggaatggggaagggggtgcctctctgcaggcccatggtaaggcatcccttcccctgtgagaccagccacaggatggtatagtatagaacagagtttattcagggcatagggaagaggatagtagaggcagagagagagtagagaagtaggggagtagaggagtagaggccggcctctctcatggggagagagaggtgggaaggggcgaggggacaaagtgggagcaagaaggcaagagaccaaggagagggcaagcagccaggtaactgtggggtggagcttagacagaatgctaacaagggaaacaaaagctcagctccagcgaacacttatccctggacttgacagtccttcatcaatgagaaataagatgccagattggtcctcacagtcagagaagcttgggcaggaagctgatatgtagtcctggaagctgatacctctaagagtcaggttgccataacaactactggggaaaaatggacaggaatggataggctatcatggtaagcagtaatgagaagaagcagcagcctgggccattcctgacagagtggccacacaagcaatggactgcaattgtaatgttttcctctggttgagtcctaccattgtgtgctaatgtcatgcattcattaataacctgggcctgtacttactatatagtccagagatagtatctaggacaattagcaaccaggctaatagctaaactttctttctctgaagttatttgtgtcaacctgaaaatatcatgacattgctttaacctattctcttcatttaaataatactatattttcacagtaatagaaaatatttacaaaaatctttatatcatttgaatttgcatgcaaattagttaataatttaactggcccatgggtcccactccactacagtatgaggttaaggacagagcaggcagagagtctcaacaaattttcacaatagaggaatgaatctcaataaaaattaaaggcaaaagtaagcaaaaggcatgaaagcttcaaatatctgatacaatacagatattattttccacaatcatttgttttccttctatattcaaaattgagtgttagtggttttaaacatttaaaaaaatatcagtttggacattcctttattcaggattatttgctcatggtactatataatcttcaaaaacaacctgacatgtttgtacagctcagaatgctggtattcagagaggttgattcatttgtccaaagtcccacagctgggacatagtggaactaaaggaaactacatcttctggctcagcccagtcccttttgcgcagagcttccctgcttcagcaggctttgccagatggctctcctctgggaatctgaatgctgccagcagctcctggctgagaggactacaaagccaccaggagtttcctaatccaaccaccacaccagccaagtggaaatgggtcacgtggtctctggaaggctttccttgatgttctgtgtggctcttgtttacaaggagagtgctcgaggtgtggttccctgtaaagagcaagggaagacagaagagagccagagctgaggcctcctgtgccgaaccttggtgtgggtctcagtgggaccaggatggcaacacaatcctttactcctgtgcatctgcctctctgacagatctgatgggcgactgtactctgtaggtatgctgagccatcatctagagcctgagttctgccctaggacgaggtcattctacaagagttcactggctctcctgcagcctctagctactctctgggcccagtgaaggtgcagaagccactcagtgcatcagtccagggaagtttaacagaaggaattattatagtttcttttactgacagattttttttttatagaatatattctgattttccctcctgttcctccttcttgttcctgcctcccctctcatccagatccatctcctttctgtttctctttagagaacaaacaggcatctaaagaagaataaaataaaagacaaaacaaaattaaatcaggataggacaaaacaaaaagcagaaagaaaagagcacaagaaaagacacaagaaatagatacaaattcagaaacacacattcgggaattccaaaacactacccaactggaaggcataaaatatatgaaaaatatatacaggggaaagccctgttgcaatactttgggacaaggaaacactaaagacaccattgagctcactttcagttggctgtctactgcttggcatgtggccttttcctaagaggaactggtttcctcagtgagactcccttggagaaagtgatttacttgcaagtggttttcagttggatattctgcattagagatgggacatggcccacttctcagctctgggatgacatttggtgcagacccgtgcaggccctgtgtatgcagcctcaggcatacagtgaactatgtgacttcgtatgtgagttaggcttcttgacttagtgagccttgcttccttggtgtcctctattccctctggatcttgcgttctttctgcctcctcttctgcagggttcctgagccctgaatgaagggatctgatggagacacccccttaagggtcaaatgttacaaggcctcttatgctctgcacattgtcagtatctattgttcccgtctgcagcaggagggagcttctctgaggatggctgagcgaggcactgatcctgagtatagcagactgtcattaggagtcattttactgctgggttccttttgtagaatagtagtttagttttcccctgggtcccctgggctatctagtgtcaggtttaatcaagcagagtcaggtatgtgttccacttcagggagtgggttgtaaatcaaatattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacatcattgtaaatcaaagggtttatagatggcttgatgtttatggttctctttggtagagtgcacagtaccttctggtaccaagaacaccagccagtaggggtgaggccccagcttaccttctccttgctcaattagttgtatagataatactcttagcaataggaccttgtcatccttttgtggagagccacctataacctttgcaacaacctgagttgtttgggggttcacatgggacccctttcgccaacaacccattcccagtcatgaagcttcatttggtgatgtgagatgttcgcttggggctgtctctcctgctaattggcaatttaatttacatcaccttcgtatatgtgtgtaatttaggaatcttctgatatattaggttccctatacaactcatcaaatggctgttcattttagctctttgtccctgtatttccttcccttaaccccctcttcccgtcccctcccagactgaccctccccacaccccttacccccatccatcactatccattctactttcactcctgtccctccctcatagtcctttactctatacctaaccacaaagaaaattattaatgatggtgagaaagcaaatttaacaaactccatatgtaagtaacctccaaatggcagtttggggttacaggggtaggggtaggactggcagacttgaaaagacttcaagatctcctagggaagggacactctgcctattcaagagcagatggtactgtttgtcctggcctcagccgcataggcagatggggacccgtgacactgcatggaggaatcctgaagcatatggaagggtcacattcagaacacagaggtctctggcagcaactctgagttccttatggaatgtgtaccacaaggctgacgtttcagaggaaccccatgcaaggctagggacctcccgatgtcctcaagtacataaccccatgcaaggctagtgacctcccgatgtcctcaagtacatgtgacaggaagccaaggaagaactgcagacatgatttcgctgtagcgccctctactgggatagttcgacagtgctcacttctacggagcacttatagaaaggagcatccagatgtgagagccaagacatttgtgtgcagctgacagagcccctaaccccaaagtggaagagtcacaaatgccaagacttccgaagacagtggttcaactcccagccttcacacttgctagctgtgagaccttggtagattccccacccctctgacctttgctttcctcatttgctgatgagggtaattaatagaagttacttccaggactgctgtggagagacgagataaacacagggcagagcacacgttagtggcgacggtagacaggtcactaggtcaggcagcacagtactaaagcccaacttcagtctctgaaactttagaggcagcatgaggctaacgatagctggtgatcatctttccacacacatgtacacacatgtacccttcttggcatcgctgtccatccttcagctatcttcagggaagttgtccatgaagatgccttacctcatcagtctacatagttatgtcaaatgaaaataggaatatagttaaaaaccagaaattgatctgttcttccaagatatgtacatgtgggaaggaaaacccatctaagaacttgctatttattacctgtcttctgttccttgaagccatactttaccaaccatcaactttcgaagtggaaattatgtaaatcacagtgtgctttattttgtactgaatattcaacccagtgttatttgtaagctttttaattatgccaatttctccccgattgagaccatcaccctagttccaatgagctaccaacgtggttcagtcatgttacatcttcagataacaagtatttgggaacatatcaaacatcaccctccacagagtccgttcttgtgccctttctactacaagtgccaattttttctctctttgaatacagtctctcagtgggaatttgggacacgttggccttccaggaattgaagtcagagttaactgaggttcctgcttcccaaatcttgaaggaaaatccatctggccgacccaggagcaaagaaggagacaaaggtatgaagttagacttctcccttttgagcctacctggcctcctctccctctctccctctctccctctctccctctctccctctctccctctctccctctctccctctctcccctctcccctccccctctccctccctgtgtgtgtgtgtgagtgcatgtatatgtgtgtgtgtgtgtgtgtgtgtgtgtgtgtgtgtgcatgtgcgtgtgcatgtataccttgttctgtgttcagttcggaaagagcaactgttcacccagaagagaagacaggtgattccccaaggcagagttggggagaaggaagctgaaacctgtctgctgccttttctagacatatgtactggaagccaaccttggagggctaggtatatactaaagatcatttcagcatgtctgttacacaaagtatttttctgacctttgtctatcaaggaaaagagcatttgtgcctcaaaaaaaaaaaaaaaaaaaagtgttcgatagaaatatggctgctgtttccagaaaataacattgactgttttattagcaatccctgctaacactgaagtctatgtagaggctaacacggaagggtatgttgaggggatccgacaccctcacacagacatacatgcaggcaaaacaccaatgcacacaaaagaaaaacaaatgagaaagtcaaggctcacagagctaagtacctcactggtcacatggtcagtgggcagcggggttcagaggtcaacccactctgtctctgccttctctgttttgccactactgtccagtctgcagtctgtattcggaagacatagatactaaatacatggcaactcttttttttgtttgttttaattcatcaggatgtggagcgctagtctgggtaggagagccagtcaccctgaggacagctgaaacaatcgctggcaagtatggagtgtggatgagagaccccaagcccacccacccctacacccaggaaagcacatggaggattgacacggttggcacagagatccgccaggtgtttgagtacagtcagataagccagttcgagcagggctatccttccaaggtccatgtgctccctcgggcactggagagcacgggtgctgtggtgtatgcggggagcctctatttccagggggctgagtccagaactgtggtcaggtatgagctagacacggagaccgtgaaggcagagaaggaaattcctggagctggctaccacggacacttcccgtacgcgtggggtggctacacagacattgacttagctgtggatgagagcggcctctgggtcatctacagcacggaggaagccaagggggccatagtcctctccaaattgaacccagcgaacctggaacttgagcgtacctgggagactaacatccgtaagcagtctgtggccaatgcctttgttatctgtggcatcttgtacacggtgagcagctactcttcagcccatgcaaccgtcaactttgcctacgacactaaaacggggaccagtaagaccctgaccatcccattcacgaatcgctacaagtacagcagtatgattgactacaaccccctggagaggaagctgtttgcctgggacaacttcaacatggtcacctatgatatcaagctcttggagatgtgaggagcctctctctatgcctaccagcaaaggccagaaaaggtgaagttccgggctcccgggtgaagcagctgtcagcagaggcagccagatgcatggagtttctcctcctgctcaagattttgtttatccgggtcaatgtacagctcccctctgactgacacgtcctccaggcttgtacagtcgcatagactctgttctcttctgtcagctttcaaagggctgttcctcttttaaaaatcacatagtgtagcagtccagaggaaaaactagaagtaaggttgtttcttcatgaaaccattgcttttgcacgctgttatggttaccataagccttgcgaggcagcggcggttctgcggagcgaccgctcctgtggttagaactgctcctgccgaaggtgtatttactccagggggcttctagtgctacagatacagcatgtggttgggtggtacgtaaaccctttgccctgtgaaataaagttatcttacatgacgatgctgtccttgagacctgtggaaattgttgctcaaaagcacagattccagagtgcgccttgcctctgggttggataatatggcagccagatgttacaggcatgtgggcgcaggtgtgggagtgtctgtctgtctgtcaggcttgtgcctgtcttttcctgttttgcccctgatgacaataggtcaacagtgggctacacagcttcccacagcttccaacctccatctaactgtgttgttgcctctttctgagcaatcttggggtctttccctcaacctacccacgttcctagattcgttttagatttatctgttgttacagatactagattttttccccctttttttggagacagtgtctccaaaatccctggctgtcctggaactcactgtatagaacaggctgggctcaagaggtctgtctgcctctgcctccagggcgctggtgttaaaggtgtgcaccattacatctggcccagagactatattttaaagtcacagctctcacatgagcaaactttatagagcttctcttgcattggtaaagctggtgacaacacacatataataaaaatggccagtgtgaccatttaaaaacggctacacgcgctatagagcgtgtggtcagaggacaatgtaagggagtcacttttctctgcctaagatgtgggacctgggacttaacctaagcagtcagccttagttggcaagagcttctatgggctgagtcattttgagtgtacatataggcgttattaaatggttttgtgccaaccatcaccacatctggggaactctttgcatcatacccaaactaaagctgtccacccagaaaataactctgctccttgtgcacgcacatcccccgtgtgcctgtgagaatgtgtctgtctgtgcaggtatgggtgagaatgtgtctgtccatgcaggtgtgagaagcagagggaacctgaggcatcggtcttcagtcactacgttcttctttttggagacaggtattcttactaacctggtacatgctgaactcccgtcttctccctcagtgctgggaacaccagtacaccccactgtactcagcttcttaaatttcccatggctcctaggggcaaacaccttacagaccacactatcaccccagagctttttgggcactgaggttagcatccttctctgcggggtgtagtggtagcatatctcatcttgccagttcagcctggactttctccccatgggtnnnnnnnnnnnnnnnnnnnnctgccatcaccacagggagcgtccaggcagatccccagtgtctgtcactaacactcacatcttcatttctgcttccacatctgccagcctccacagtctggcgtctggatctctcaggtacagcatttgaaagacagaaaaggaaaggaaggcttttacatctccatgactctcgggggcatttcaggagtggtcctgaggcaaaggagcatgggttccctttgttctttgtttttgtcccagctgctcttcctgctgtttctcccaggggcctgaggagcaccagtccctctgatttctggtacctgcataaggtttttgtacaccacattcacatagttggaatgtaattttacatatttcagggtgacttcattttgattggcccattacataaggataggtgaggtcccacattaggcattatgtaaatgccctcaaaattttggattttggggcatttcaaatacaggactgttcagtttatattaagattaagacttgagtcaggtagtaatgtcacacgcctttaatcccaacacctggggggcagaggcaggcagatctctgagttggaagggtagcctggtctacagtaagttccaggatagccagggctacacagaaaccctgtcttgaagaaaacaaaacaaaacaaaacaaaacaaaacaaaacaaaacaaagaacaacaaaagacttcaatataggacttgaaggaatacaattcagcccatagcaactgggctttaatctaaaccttcgctcagatccaaagactctgaagtcagaaagcaaggactctttcatctgatcagctgccaggtatccaaatgtgtagaagactcacaagaaatctctttaggtgatgagagaaatcacagcacacaggagagggaatccagtcagtccaaccctgccctgtccaggctccctctctccatcaggtatcccctagctttgggaaagaagagcatgaagccagatggtcctccatttctgaatactcttattaattcccatcttgttccacatttacagtcagagtccttatagagctctttgggatccacctcctctcccacctcctctcctacctcctcccccacctcctccctcaccacctccctcacttcatcttctactaatgtcttgactcacttgagtccagccaacccatctagcttccttgttgaacttcaaatatgccacggatgccttcatctttaaacgttcacagtggctcttcactccgccttcagcatctacacacttaaccccatcactgggctttaatatttactcaaatttcacctttctaaagaggcattcccatacaactctcctaaaaatcacaaccagcctactgtttcctcaggcacatataatctcctttattattttatttcttactttaaattttcttttctagtttaatccccctggtttgtgatagaatttatatttttaggttgtcagtctttttctgctgaaatgcaaactctgttgggataaagaccaatcctcctatataataatgtaacactaggatattggttgaatcacatagcacattctcagtaatattcattggacaatagaagaccctagaatatgcttagaaaccaaagtagaaacgaaaccaacacagtagtgagtctttccaaccctctcctctccttgattctaatctctgctagcagtgtaactgaccccagacccttcacttcccctctgtggtatgtgctaaaaatttctatagtcttcacattctctatctttaagatccaaatgaggtaaccactagccacaggcagctactgaacaattgaaatgtggcctgagcaaagtgtttgttttctttgaataatcttatagtcaaatgatcacacatataactagtggctacattatgggacattgagggtctgttttctcacttgaccaaggatgagtgaggcacattatcaagtactttgatgacaatgacaagtttcagtgtatactccttttctgcccaacactggagccaaagtttacagaagaggacagccttgcagactgtgggtaggaggatccaaacacttttgcaaaaagaactttttgaagatggagatgaactaaaaggatggcagacaagcacacttcctgagtgaatcagaacaatcatgttcctggtgccttcaaagcaatcagagaagccctctaagtcattagaggccccgtggggtctcctgaggggcctgggtgagacatccaagaagtgtacagctacccaccaatcagttgcctttcttcaagggtagtgtgtttgattatagagtttaaaaaccaccccagccctctacaggtaaactttgaaatactgacaataactttcaaactccacagccctagttaggctcaagctaggaatgcaaatagcttagtatgaaaagttcgtatgactatggaagtgcctggcataaggtttgataacctcaaacatctcagcattctctggaccacagatttcttttaaggtttagttttataattatttatgtgtagatagatagatagatagatagatagatagatagatagatagtgttatgtgggtacctatggaagccagaagaggcatccagtcctctgcatctagaattacagtcagttgtgagtctctgggaacgggactcaggttccctggaaaagccacaagtgttcttaaccactgagccttctatccagccccagatctcaaacttatagagtcacttctataaaggcctagattttcaactggttaggattttattataaacaagacccaacaatttaaaaaagactcaaatacagctgacaaccagccacactctatacagcgtagccccagtcaaaaacaaagccaaacacagccatctcagaggcttggcttgaaaactcgttaccttgaagtgttatcagtgaggcactagtttggatgtgaactgtccccacaggctcatgtgtctgaccacttggtccccagatggtgatattagtggggaggctgtagggacttctggagatagaacttagctggaggaaatgtcactaggggacaggccctgaggtttagcctgaccctgcttcctgccctgcctgttttatctagtctgctgggagatgaacaagcagctgtcccacacttgtgcaccgtgaaggcagctacctgctgacacacctttcatgccatgctaaactgtatcacctcagaacataagcccaaacaaaccctcctgtccttccttaagttcttctgtcagaacttccgtcagcggtaggaaagttaacgaacagacagggcaagcatcattcaactgtgactctagagcacagaaaggaagtccaagacttctgggacactcttcaaaagcccgcccaggcaccccaaatgagtttgtgtgttggctgctatgtccacacccattaaaccattcaatttgtacttgcttatgtctgcagcatcagctggagaaggagggggagcaggaggcaccatgagatgggctttgctgggagactcgtggtccatacccatgctggggagcatttcctcaccctcgccacttttcttggtgatggtttcatctctaggaggaaaaacacgttaaatgttattcaagtaaaggtaggatagggcctggggggatggctcagtgggtaaaggcgcttgacactaagtctgattatctgagttcagtcattagaacccccatgatggtaggacagaactaccacctgaaagttgtcctctgatgtcctcatgaacatcatgatttgggtgcatgtggggttgggggggcacacgcagaaatacaaaggttgtttttaagggagggagcaaggaagagagggaaagagaaaggaggagagagggagggagggagagggagaaaagaagggagagagagagggacagagagagagagagagagagaaagagagagagagcaatccaagatgctaataccagagagaactacttaatattttacagttttacaggacatcctttgttcataccttcatagctacccacttgtaaaaatgagataattcagagtctgccatccttggaatggacttactagtccctgttggtcaccgagaaccaatggggtacaattcactctcttcatccttagaagagtctctgatgataaaagcaatctctttactttcttttctcttcgccaccaggctgctccgactgagtctccatttggcttccttagtcctcaggacccatcctccctcaagctcatttaaagttcatctcccttctgcctgactttccccacttacaacctgtgagggtttctcttcctctactgaggtgtactagggctttcctgtcactctcaggtccgggctaacccacacaatggcatgggattggcatattgagctattactgattggaactggggtacccactcccaataaagacaactccctcctgttgttgagaggactcgagtggagctggtgggtagtgagagtgagttctcagactgggagcactgagagcaatactatacagaaggccatcttctaacgtaataatgtctgctcctctggccagttagcttgtaagatttaacaagaataggatgtccaggtttctaactgtcaaggagttagcactgccttttgccatatccaaattatttcaacctgagggctcttggaagaattttctttttttagatcacctctcctttaagggtcatacaacttctaaacccattaaagaaactgccatggtatcatttgctaaaaacaaaggactctttctgttccttgcctaaaaaacctgactgtgcctcaacacagtgaggcctactgtgctctactgtgcctagctgggtgacaatttcagtagagtcccaccattctccacagagatgctatccccaaagctgacatcagaggcataccaaatgaagtaaatgaaacttcagggagagctgggtgtgggggcacacaggaggtagaggcagggggatctctgtgagtttgaggccagcctggtctacatagtgagttccaggacagccaaagctacatagtaaaaccctgtgtccaaaaaaaaaaaaaaaaaaaaacaaaaaaaaaaccaacatcaaccaaacaccggggctggagatggagagatggctcagtggttaagagcactgactgctctttcaaaggtcctgagttcaattcccagcaaccacatggtggctcatgaccatctgtaatgggatctgataccctcttctgatgtgtctcaagacagctacagtgtattcatatacataaaataaataaacaattcttaaaaacaaaaacaaaaaaccaaacagaccaaaacagggtgcctagttaaatatataattcagataaatggccaatttgtagtatatcacacagatgtatttaaacttaaaaacttacttaaaactcaaattcaaccgaggtttctgtattttatgtgccaaacctaccgtcagaagattggtcctcggcagatgaagagtcttagagctgaaacacttctatcacgtcatcaaagacgaggtgacttagtgggatatagggctgaccacacagacctgaagacctgagttcaatccccagaatataggtagagacagacagactgaagaacagaccaacagacagacagacagacaagcaggtgcacacacgcacatatggatgtaaaaacaatacaatttaaagtaaaataaataaataaacatgatcccctgcccacaacaatttgaaactcactccaccatcaacactagggctagactcacagaataccatcacctcttctcagtagggactgtgaagacgttctgcccctcacagcgggtagaaactcgtcagctttgcctctcaggtgcagctaagaaggcagcggatgagtagattcacagcatccctacttcctacagcttctgccaaactagctgaggctgagctgcccttctcctgcctacctgacaagcaagctaaagaacctatgggtaccttgtggccatggctttcctacgcttgttgatctcagagaccaggtcaatgttctggaagtcaagcttgtccatagagtttctctgaaccacagcttcactcggcccaatggagggttttagatacactgcacctgggaagcaggaaatgggtgctgggtgtcaggccactcagctgggtccagcttgctctgccctgaacagggctctcattgccacatctgtcaagaggcagatatttcttcaaacctggatgagggaggggccgcggtctcacggaccatttaaacaattcacatgtgcttattgcaaccactaaatgaagaagcaggccagccgtaagtggccctggtaagggagaggaaacgggcttgaagaagagaacggagtctccctaggttgctcagtggccctgtctcatgaggcttctcaactatcggtgccaatccaggggaacagtatttcctcccggggttctttggagcttgaagacctgtcttcccagagcccgtgctgtctgaaggatgggaaagggctaaggtaaagccgagggccagggttaggtcatttacaccaatgcccatggaacttagacaccagagagttggcactggtaacagaagtaccggcatactcattgggcagtgccaggtgctacagggcagcctttcccacgggtttacctgatagccaccacttctcctgtatcataattgccacaagagaaatggggcaactgaccaggagagaaactagggaggatgtatgggacctgaaccaatgcctatctgatgtcagaaataccagctttccctacagcacaggcaaacaacctgcaggtcctgccatcctgctttgtctttccttaagggacaggagagactgtacacagtgccccactccagtggccacactgctaatgtcacagtgtgaatttcaacagcctgagttcaacagcctgggcttctggctgaacaggttggttcctgtggaaacaaacaatgaactcacctccgaatctcagatctgctggtagatggccatttccacacttagtggctttgctaaaaaatgctaccattgcattcggtacccacagaacagctctatctcctcagagaaggaacgagccaacagatgaccaacatcttcatctcctttactcttttatcttcctagagtgagtctctctctctctccggaactcgagttgatagaatttatttgcacctgaagcacgcagcagctgacatgaatgttctctaccaatggagtctaccagttgcaaaatgcacccatttttgcttcagagagaggctgggttcctgcacagagaaggacactgtatgtatgttacttgggcattagggaaggcaccagcttagaccatggggaactggcctggccaacatcttgacctgtagctctcgagtacacattaaaaaacaggttcacgaacatctgtcttcccagagctaaaataatcagtgcttcttcctctgcctaaaattacctttgccagacttaggaagcagaggtaggcagatctctgtaaggtctaggccagcctgatctacacaacaagctctaggccaacctgctggggtgccaggtgctttgggctctgaagtgttaacacttggattcccagcttcctcttctgagccaagtgatcttgggcaagtaacttaacctctgggttttgattttcctatctgccagagaatttttacttactcctagggtagttgtaaagactgagaaaatatttgtaaaaaaaaaaaaaaaaatccctcctttattaactctccctccagtcttaaaaatgcttaaatgaaagcttgaatataagatatgctcagcccaggcaggaagggatgtaggaatgatgctatgaatatgtgtacgagtggatgcaggtatttctactcctatactgtcatggatcagtctggtgtcccccaaacacaaccttatacatgttgggaaacaggagcccagcttcgtccctttatctcaagaacttagcaaaaccgaacacacgggaccccaatgactacttaagctgagccaggcaggatcttgaaatttcatcttttttgttttgtttttttaagacaagacttagactcagggccttatgatcaccaggcaagtgtcctaccactgagctaagttcccacccccttgaatccgaatct

SEQ ID NO: 1226 - DNA, 1475 bp, Mus musculus
atgccagctctccatctgctgtttctggcctgcttggtgtggggaatgggggccaggacagcacagttccgaaaggccaatgatcggagtggccgatgccaatacaccttcactgtggccagccccaatgaatctagctgcccaagggaggaccaggccatgtcagccatccaagaccttcagagagacagcagcatccagcatgcagacctagagtccaccaaggcccgggtcagatccctggagagtctcctccaccagatgaccttgggccgagttactgggacccaggaggcccaagaggggctgcagggccagttgggtgccctgaggagagaacgggaccagctggagacccaaaccagggatctggaggcagcctataacaatctccttcgagataagtcggctttagaggaagagaagaggcagctggaacaagagaatgaagatttggccaggaggctagaaagcagcagcgaggaggtaacaaggctgcggaggggccagtgtccttccacccagtacccctctcaggacatgctgccaggctccagggaagtctctcagtgggaatttgggacacgttggccttccaggaattgaagtcagagttaactgaggttcctgcttcccaaatcttgaaggaaaatccatctggccgacccaggagcaaagaaggagacaaaggatgtggagcgctagtctgggtaggagagccagtcaccctgaggacagctgaaacaatcgctggcaagtatggagtgtggatgagagaccccaagcccacccacccctacacccaggaaagcacatggaggattgacacggttggcacagagatccgccaggtgtttgagtacagtcagataagccagttcgagcagggctatccttccaaggtccatgtgctccctcgggcactggagagcacgggtgctgtggtgtatgcggggagcctctatttccagggggctgagtccagaactgtggtcaggtatgagctagacacggagaccgtgaaggcagagaaggaaattcctggagctggctaccacggacacttcccgtacgcgtggggtggctacacagacattgacttagctgtggatgagagcggcctctgggtcatctacagcacggaggaagccaagggggccatagtcctctccaaattgaacccagcgaacctggaacttgagcgtacctgggagactaacatccgtaagcagtctgtggccaatgcctttgttatctgtggcatcttgtacacggtgagcagctactcttcagcccatgcaaccgtcaactttgcctacgacactaaaacggggaccagtaagaccctgaccatcccattcacgaatcgctacaagtacagcagtatgattgactacaaccccctggagaggaagctgtttgcctgggacaacttcaacatggtcacctatgatatcaagctcttggagatgtga

SEQ ID NO: 1227 - protein, 341 aa, Mus musculus
RFGQEARKQQRGGNKAAEGPVSFHPVPLSGHAARLQGSLSVGIWDTLAFQELKSELTEVPASQILKENPSGRPRSKEGDKGCGALVWVGEPVTLRTAETIAGKYGVWMRDPKPTHPYTQESTWRIDTVGTEIRQVFEYSQISQFEQGYPSKVHVLPRALESTGAVVYAGSLYFQGAESRTVVRYELDTETVKAEKEIPGAGYHGHFPYAWGGYTDIDLAVDESGLWVIYSTEEAKGAIVLSKLNPANLELERTWETNIRKQSVANAFVICGILYTVSSYSSAHATVNFAYDTKTGTSKTLTIPFTNRYKYSSMIDYNPLERKLFAWDNFNMVTYDIKLLEM

SEQ ID NO: 1228 - DNA, 37252 bp, Homo sapiens
aaacttttaatgtatgagaagctattgtaaacatcaaaatattttacagaacccctctggagtacctgttaggcttttaatatgtatcaattgaaaaaatttacggccggacatggtggctcatgcctgtaatcccagcactttgggaggccgaggtgggtggattacccgaggtcaggggttcaaaaccagccggagaaaccctatctctactaaaaatacaaaactagccagacatagtggtgtatgcctgtaatcccagctacttgggaggctgaggcaggataatcacttgaacttgggaggcagaggttgcagtgagccgaaatagcaccattgtactccagcctgggcaacacgagtgaaagtctgtctcaaaaaaaaaaaaaaaagaaaagaaaaagaaaaaaatgtatattcacgcatgacctgggcaataaaggctccaggctctaacacctgcccaaacggaacgactgttcatcttttcttctcccatcggcccctgcaaatatagtctttgagtgcatttaagaaagaagtatatttttcttttttgacacaagccatgagaactattttctcatagaaaagtgtaaatggtaaggagaatcccagaaaaaaaacccataaaagcctattttacctatgctattgctatatggtcaccatgtacactattatttttcctatatgtgagtgagaagcgaagcccaagtcatcaggaagttgtctccatcttccctttagctcttttcaccccacaacctttaccaacgaccttggaaatatcttttccatgcctagcacagtgtcaggcacacagaaggcccaagcatgttattgaatgtcccacactttttacctccatggtaagaaacataccgactaaacatagtgaggaacagattacttttaggcactgaactacaattgctgattatcctttgcctacccacatctccttctaagggattcttctttgcccatagatctttctgctctaaacaggccctcatccccctccataaaacataatttcatgcatcaaagttgagtttctgtcccaggccagtgcttcagttgcctactggacaacttcctgctggtatggtcacttgaaagaaggagctcagccaatcagctctcttctaagaaggggtttgggaaacacagaggctgggtcagttaacagaggaaatgagctgaaaggtcacatgcggggaggtaggctcagggctggggcagccatcagggactacagctgaagtcagcagctagatattggtgaagaggagaatgaagttgatgccgagaaacattctgtaaaccaaaaataaaattctaagccccacaactggctgaatgggaccacgcggattccaaagaaacctgaaaaactagttcagaccacaggaaggagagtcagacatgctttattataccctcctccctttagaatttagacacaattgaccaacattaaaacagatcttaagaccgaccaaatgaactctttctttaacaataagataccaaaatccaacctgactctagtatagcatcacatgaccaataaagaaggaaatcaaaatattttaccccaaaatatgtttctttcccatattttgaaatgactatttgcatctgtaaagaatctcaattaatgtaactaggtatttgcccttccaggccctctcaaccccaaagagattaactaaatctggcaccatttaaggtctgaaaagagatatttattatccattatctcttaagcctgctacctggaggcttcatctataacaagaaccttggcttccacaaccccccttatcttaaccccaagtatttctttctgctgacttcaactttagggaaagcttaactcttttaactaattgccaatcaggaaatcttttaactctacctacgacctgaaagccaacccagtgtgtacctcacacgtatagattgatgtcttctatctccctaaaatgtataaaaccaatctgttacccaactaccttgggcaaatgttctcaggacctcttgaggccgtgtcatgggtcatggtactcacatttggctcagaataaatctcttcaaatattttatagagtatggattttcttgtcaacaagaaccatgatgagtgagactctgcagctcctaagagacagggaaaatagtggacttgaccttttttgaaaggccagtttctgttttggttttggagaatacttactatattacacaaggaggtgtttgggtcatgggtgtggatccctcatggcttggtgctcttagggatagtgagttctcacatgatctggtcatttaaagtgtgtggcacctccccccaacccactctctctctcactcctgctcctgccatgtgagattcctgctccctctttgccttctgccatgagtgtaagcctcctgaggcctccccagaagcagaggctggcgctgtgcttcctgtgcagcctacagaactgtgagccaattaaacctcttttctttataaattatccagcctcaggcatttctttatagtaatgcaacagtggactaaagccccctcccccgtcacactctttcccatttctctaaagaaacttgaaacatttccctaaagaaactctgtaccttggaagtaaggtgggagaagctctgtgctgcacctaaaggagattactgccagcagccttcacaaagactcagaatgagtctgtagctgccctcaggttggcccaagactccactagcaccgggtctccccacagctgctcatggtttccactctggtcctgtacagcataggacacataatcccacaccacagggcaagcccaaggcagatgtcctgcatatgtttgggcaaatctagtcctcaagttgctagtaaatagattgggtgaaagaaaaatatctgaagagcctccataaatttttttttttttttttttgagacggagtctcattctgtcgcccaggctggagtgcagtggtgccatcttggctctctgcaacctccacctcctgggttcaaatgattctcctgcctcagcctcctgagtagttgggattacaggcacccgccaccatgtctggctaatttttgtatttttagtagagttggggttttgccatgttggccaggctgctctcaaactcctgacttcaggtgatctgcctgccttgacctcccagagtgctaggatcacaggcatgagccaccacgcccggtctaaagttcattctattttttttttttttttttttagatgggagtcttgctctgccaccaaggctggagtacagtggcacaatcttggctcactgcaacctccgcctcccaggttcaaatgattctcctgcctcagcctcccaagtagctggcattataggtgcacgtcaccacgcccagctaatttttgtatttttactaaagacagggtttcaccatgttggtcaggctggtctcaaactcctgacctcaggtgatccactcaccttggcctcccaaagtgctgggattacaggcgtgagccaccacgcccggcctaaagttcatacttgagggctttcctacaacagcataatatttagaaattagatggcattagaaggctgtatttcagctatatgatcggctatatatatagttactgggaaaattgtcagtaccaaaatggagtcacctatatcaaatcctaacaaaatagagtcaagaggcctggcgcggtggctcacgcctgtaatcccagcactttgggaggctgaggcaggtggatcacgaggtcaggagatcgagaccatcctggctaacacgatgaaaccccgtctctactaaaaatacaaaaaattagccaggcatgctggcgggcacctgtagtcccagctacttgggaggctgaggcaggagaatggtgtgaacctgggaggcggcttgcagtgagctgagatcgcaccactgcactccagcctgggcgaaagagcaagactccgtctcaaaaaaacaaacaaacaaccaaaaaacaaaatagagtcaacaggccaagaaaatagagtcaaaaggccctcacacatatataccctataacaggaactgtgacaaaagacttttccaactgaactttcctgttaagccacttctatgaagaccctttcgtagccatagccagtaccaccaatgaacaaacgtcaccacctgcaataagtccctgtaaccaatagtatttgtttcaaaacagtttatgtggacttctcctttttgcctttaaaatcttgcccttgcccaaacccctcagatgcacctggggtttgccacagcacacatatcctgaatcgcaatcccttgctattcctgaataaactctttgttttggggagttggtcactctgtagctcattttaggttgactgactctctgtctctgtctctgtctctctctctctctctctctctctctctctctctctctctatatatatatatatatatatatatatatgtatattcacatatatagtatatatgtgcgtatgtatatagagagagatatatagtttgtgtatatatatatacacacacacacacacacacacacacacacacacacacacacacatacacatagctatatggactatctatgtgaccttaaataaatcagttaattattctgatccacagtttctccacttgtaaaggaagaattctgatctttgttcagtttacctcagggctattatgaaatgaaatgagataaccaatgtgaaagtcctataaactgtatagcctccattcggatgtatgtctttggcaggatgataaagaatcaggaagaaggagtatccacgttagccaagtgtccaggctgtgtctgctcttattttagtgacagatgttgctcctgacagaagctattcttcaggaaacatcacatccaatatggtaaatccatcaaacaggagctaagaaacaggaatgagatgggcacttgcccaaggaaaaatgccaggagagcaaataatgatgaaaaataaacttttccctttgtttttaatttcaggaaaaaatgatgaggaccaaaatcaatgaataaggaaaacagctcagaaaaaagatgtttccaaattggtaattaagtatttgttccttgggaagagacctccatgtgagcttgatgggaaaatgggaaaaacgtcaaaagcatgatctgatcagatcccaaagtggattattattttaaaaaccagatggcatcactctggggaggcaagttcaggaaggtcatgttagcaaaggacataacaataacagcaaaatcaaaattccgcaaatgcaggaggaaaatggggactgggaaagctttcataacagtgattaggcagttgaccatgttcgcaacacctccccgtctataccagggaacacaaaaattgactgggctaagcctggactttcaagggaaatatgaaaaactgagagcaaaacaaaagacatggttaaaaggcaaccagaacattgtgagccttcaaagcagcagtgcccctcagcagggaccctgaggcatttgcctttaggaaggccagttttcttaaggaatcttaagaaactcttgaaagatcatgaattttaaccattttaagtataaaacaaatatgcgatgcataatcagtttagacatgggtcccaattttataaagtcaggcatacaaggataacgtgtcccagctccggataggtcagaaatcattagaaatcactgtgtccccatcctaactttttcagaatgatctgtcatagccctcacacacaggcccgatgtgtctgacctacaaccacatctacaacccaagtgcctcaaccattgttaacgtgtcatctcagtaggtcccattacaaatgccacctcccctgtgcagcccatcccgctccacaggaagtctccccactctagacttctgcatcacgatgttacagccagaagctccgtgagggtgagggtctgtgtcttacacctacctgtatgctctacacctgagctcactgcaacctctgcctcccaggttcaagcaattctcctgtctcagcctcccgcgtagctgggactacaggcgcacgcccggctaatttttgtattgttagtagagatggggtttcaccatattagcccggctggtcttgaactcctgacctcaggtgatccacccacctcagcctcctaaagtgctgggattacaggcatgagtcaccgcgcccggccaagggtcagtgtttaataaggaataacttgaatggtttactaaaccaacagggaaacagacaaaagctgtgataatttcagggattcttgggatggggaatggtgccatgagctgcctgcctagtcccagaccactggtcctcatcactttcttccctcatcctcattttcaggctaagttaccattttattcaccatgcttttgtggtaagcctccacatcgttactgaaataagagtatacataaactagttccatttggggccatctgtgtgtgtgtataggggaggagggcataccccagagactccttgaagcccccggcagaggtttcctctccagctgggggagccctgcaagcacccggggtcctgggtgtcctgagcaacctgccagcccgtgccactggttgttttgttatcactctctagggacctgttgctttctatttctgtgtgactcgttcattcatccaggcattcattgacaatttattgagtacttatatctgccagacaccagagacaaaatggtgagcaaagcagtcactgccctaccttcgtggaggtgacagtttctcatggaagacgtgcagaagaaaattaatagccagccaacttaaacccagtgctgaaagaaaggaaataaacaccatcttgaagaattgtgcgcagcatcccttaacaaggccacctccctagcgccccctgctgcctccatcgtgcccggaggcccccaagcccgagtcttccaagcctcctcctccatcagtcacagcgctgcagctggcctgcctcgcttcccgtgaatcgtcctggtgcatctgagctggagactccttggctccaggctccagaaaggaaatggagagggaaactagtctaacggagaatctggaggggacagtgtttcctcagagggaaaggggcctccacgtccaggagaattccaggaggtggggactgcagggagtggggacgctggggctgagcgggtgctgaaaggcaggaaggtgaaaagggcaaggctgaagctgcccagatgttcagtgttgttcacggggctgggagttttccgttgcttcctgtgagcctttttatcttttctctgcttggaggagaagaagtctatttcatgaagggatgcagtttcataaagtcagctgttaaaattccagggtgtgcatgggttttccttcacgaaggcctttatttaatgggaatataggaagcgagctcatttcctaggccgttaattcacggaagaagtgactggagtcttttctttcatgtcttctgggcaactactcagccctgtggtggacttggcttatgcaagacggtcgaaaaccttggaatcaggagactcggttttctttctggttctgccattggttggctgtgcgaccgtgggcaagtgtctctccttccctgggccatagtcttctctgctataaagacccttgcagctctcgtgttctgtgaacacttccctgtgattctctgtgaggggggatgttgagaggggaaggaggcagagctggagcagctgagccacaggggaggtggagggggacaggaaggcaggcagaagctgggtgctccatcagtcctcactgatcacgtcagactccaggaccgagagccacaatgcttcaggaaagctcaatgaacccaacagccacattttccttccctaagcatagacaatggcatttgccaataaccaaaaagaatgcagagactaactggtggtagcttttgcctggcattcaaaaactgggccagagcaagtggaaaatgccagagattgttaaacttttcaccctgaccagcaccccacgcagctcagcagtgactgctgacagcacggagtgacctgcagcgcaggggaggagaagaaaaagagagggatagtgtatgagcaagaaagacagattcattcaagggcagtgggaattgaccacagggattatagtccacgtgatcctgggttctaggaggcagggctatattgtggggggaaaaaatcagttcaagggaagtcgggagacctgatttctaatactatatttttcctttacaagctgagtaattctgagcaagtcacaaggtagtaactgaggctgtaagattacttagtttctccttattaggaactctttttctctgtggagttagcagcacaagggcaatcccgtttcttttaacaggaagaaaacattcctaagagtaaagccaaacagattcaagcctaggtcttgctgactatatgattggttttttgaaaaatcatttcagcgatgtttactatctgattcagaaaatgagactagtaccctttggtcagctgtaaacaaacacccatttgtaaatgtctcaagttcaggcttaactgcagaaccaatcaaataagaatagaatctttagagcaaactgtgtttctccactctggaggtgagtctgccagggcagtttggaaatatttacttcacaagtattgacactgttgttggtattaacaacataaagttgctcaaaggcaatcattatttcaagtggcttaaagttacttctgacagttttggtatatttattggctattgccatttgctttttgttttttctctttgggtttattaatgtaaagcagggattattaacctacagtccagaaagcctgtgaatttgaatgaggaaaaaattacatttttgtttttaccaccttctaactaaatttaacattttattccattgcgaatagagccataaactcaaagtggtaataacagtacctgtgattttgtcattaccaatagaaatcacagacattttatactatattacagttgttgcagatacgttgtaagtgaaatatttatactcaaaactactttgaaattagacctcctgctggatcttgtttttaacatattaataaaacatgtttaaaattttgatattttgataatcatatttcattatcatttgtttcctttgtaatctatattttatatatttgaaaacatctttctgagaagagttccccagatttcaccaatgaggttcttggcatgcacacacacagagtaagaactgatttagaggctaacattgacattggtgcctgagatgcaagactgaaattagaaagttctcccaaagatacacagttgttttaaagctaggggtgaggggggaaatctgccgcttctataggaatgctctccctggagcctggtagggtgctgtccttgtgttctggctggctgttatttttctctgtccctgctacgtcttaaaggacttgtttggatctccagttcctagcatagtgcctggcacagtgcaggttctcaatgagtttgcagagtgaatggaaatataaactagaaatatatccttgttgaaatcagcacaccagtagtcctggtgtaagtgtgtgtacgtgtgtgtgtgtgtgtgtgtgtgtgtaaaaccaggtggagatataggaactattattggggtatgggtgcataaattgggatgttctttttaaaaagaaactccaaacagacttctggaaggttattttctaagaatcttgctggcagcgtgaaggcaacccccctgtgcacagccccacccagcctcacgtggccacctctgtcttcccccatgaagggctggctccccagtatatataaacctctctggagctcgggcatgagccagcaaggccacccatccaggcacctctcagcacagcagagctttccagaggaagcctcaccaagcctctgcaatgaggttcttctgtgcacgttgctgcagctttgggcctgagatgccagctgtccagctgctgcttctggcctgcctggtgtgggatgtgggggccaggacagctcagctcaggaaggccaatgaccagagtggccgatgccagtataccttcagtgtggccagtcccaatgaatccagctgcccagagcagagccaggccatgtcagtcatccataacttacagagagacagcagcacccaacgcttagacctggaggccaccaaagctcgactcagctccctggagagcctcctccaccaattgaccttggaccaggctgccaggccccaggagacccaggaggggctgcagagggagctgggcaccctgaggcgggagcgggaccagctggaaacccaaaccagagagttggagactgcctacagcaacctcctccgagacaagtcagttctggaggaagagaagaagcgactaaggcaagaaaatgagaatctggccaggaggttggaaagcagcagccaggaggtagcaaggctgagaaggggccagtgtccccagacccgagacactgctcgggctgtgccaccaggctccagagaaggtaagaatgcagagtggggggactctgagttcagcaggtgatatggctcgtagtgacctgctacaggcgctccaggcctccctgcctgccctttctcctagagactgcacagctagcacaagacagatgaattaaggaaagcacagcgatcaccttcaagtattactagtaatttagctcctgagagcttcatttagattagtggttcagagttcttgtgcccctccatgtcagttttcacagtccatagcaaaaggagaaataaaaggaccgggtgagatgtgtctgcatatgagcagtagaaagttgtcaattgtcccttttgaaaaactatccttttttgaacctttgctcagattgttattcgtaccttttgatgttaaaatgacctttatttatgaaattacaatagatttgggaaatgataataagtggtaagtttttgtttatttttaaatgttcttccctggcaaaataaagagatggcacctctctgtcagttttcttaatatgatgttctgaaagttttcttactcagtccaatctgagaacctctgcttttaagtcaccagacaaattcttgagatggctttttctgagaggctcttctgttcatcctggtcccttcttgcctaaaggtgagtctgtgtgtgtgtgtgtgtggggtgcgggggggaggtgttgggggaggtcttcttattagctgggaagatggtatttgtgtcactttttgtgaaagtgggctcccaaatattccctgttgaggaagtgttctaatcatgaggaaataagcaagcaaatccagttgttggacaattagtttggactggtcaaagatgtcagtgccaaggaagaaagaaaaaaggggtggggaagggcttgttctatattaaagagactaaagaaatgtgttaaccaaatgtagtgcatgagtcttgattggtgtcttcatccaagggggaaaaaggctatgaggaacaggtttgggataactgaggcaatttgactgctcattattatgttactgtattaatgttcagtttcttggtgagataatgatactgtggttgcgaaggataaaatctttgttctatggagatacatgcttaagtacccagggtgaggcgtcaggatgtctgcaatttgctctcaaatggttgaagaaagactgcaaatatatagataatgagagaaagaaaggtaaaacaactgtggcaaaatattaataactggtgaattacaaactggtgaatctaagtatatggggagcttattgtactattctttcagtttttctataggcttgaaaagctttaaaattatgagaaaatatttcctaaaaagagccttctacgtgaaaggcaagctcttcatagctatggggttagaaaacctaagagccagagcctggggatgaccttgggcaagttattgaaccctctgcatcttcatttcttgtccataacataacaaagaaaattcctgctgtgaataatttttgtggggttcacatgaaatacctataagatgtaaaggatttttaaaaaatgtttagattgttagaattagaagagatccaattctgaattttacaaccaaggaaagtgaagtcctaagatgctaaggggccaaggttgcccagctggtcagtggtagagcttgagacttgaatctgtggagacaattgaaagaatcatcattaccagaagtgtgatgaggcattacttatttcagactgttgaatgaagttacattctcaataaaaactcctgcatgtgtgtatgtgggtgtgggtggtgtgtgtgtgtgtgtacaaaaatagtggcaatgttttgcctttttttttcttttgtggtcatttaacaagtctttggggatttattagatgtgtttcctaattttatattttttcttgatctttccagctactccacttttgaaataagggcaacatcccattatattgaacaccaaacatggaagttcttttctagtagtagatgtttttcatgagcaggaaattacattagtacaagaatgtggaactggaaagggacctaatgagcatccggtaccgctggctgatttttgcagatatggaaactgaggcccagagaggttattcagcttgtccatggccatctaccagttagtggcaaagctcgaattctggcctcttcctctgaagttcagtgactttctttctttttttttgagacagagtttcactcttgttgcccaggctagagtgtaatggcacgatcttggctcactgaaacctctgcctcccgggttcaagcaattctcctacctcagcctcctgagtagctgggattataggcatgtgccaccatgcccggctaattttgtatttttagtagagacagggtttcaccatgttggtcaggctagtctcgaactcctgacctcaggtgatctgccgacctcggccttccaaagcactgggattacaggtgtgagccctccctgtacatggccatgaggttcattgactttcaagaccttcagctgacctctggtttatagaccctaaaggtaaaagacagaaaggtacaggaatgcttggaacaaaagatctgtttcaaggccagatctagggaaaagggggcattctggaggctggaatataagtctaggtatgcttttttgcaggagtggcaagaactaggtgtgaaggtttgggtagagaagcttagtgaggctgagtggacaaaggtaaggcctgagaaggcagcctttctgtattccacctgcaactcaaattgttaccaccactttcttgatcatgtattaatagttgttatgtagaaaaaaattccttataatcatagaaatcacttgtttatacatacacataatatgacatattttactacataactattactacaaagttatatataactttttcttctctgggcttatataaattttcatatatatacatatataaattttatgtatatataatagtttttgaaaagtagaaaaaaaatacaattagccaagtgtggtggctcacacctgtaaccttagcactttgggaggccgaggtggacagatcacttgaggtcaggagtttaagaccagcctggccactgtggtgaaaacttgtctctactaaaaatacaaaaattagccgggtgtggtggcgggcacctgtaatccagttactccagaggctgaggcaggagaatcgcttgaacctgggaggcagacgttgcagtgagccaagatcacgctactgcactccagcctgggtgacagagcgagactccatctcaaaaaaatatatatattacatataatacatataaatatatataattatatatataaatttattatatatataataaaatacatatataatttactagaagataaattagagttggttattactgtcacaagagaaggactgctttgtttgttatttagcccctgctttggactggtctcctgttgaacagagcctggaagagggcttgtgtgcagttggtttatatggaccatgatcctagagaagagaagttgagacaggggaaagtgagacagggaaggcaggaaagccacaaaatgggggccttctccagctagtcaccacagtgggcaatggaggctcaatcccatcaagcccttcagaggggctgtgtagactgcaacagaagaggggaggtttacgcatggatctgataccctcttggccaagggctatcccatggagtatattgcgcttccctgatactcagatgtggggacgaggtttgttcttgcagactgatttttttttttttttaagatggagtctttctctgtcccccaggctggagtgcggtggcacgatcttggctcactgcaacctccgcctcctgggttcaagcaattctcctgcctcagcctcccgagtagctgggattacaggtgcacactaccacacccagctaacttttgtatttttttttttttccagtacagacagggtttcaccatgttggccaggctggtcttgaactcctgacctcaagtatccacccatcttgacctcccaaagtgctgggattacaggcatgagccacggcgcctggcctgttcttgtagactttctatgcagaaagtcagagaagctgggccacggtggctgaggcgaggtccccgcaggtgataactgcaagaggcaggttgcctcagcaatgactgcaaaaaagtgggcaggatgtgaggggagggtgaggggagaaacctgaggtgttcaacacaagtgctgcagattccctttcctcacctagaataggatggggatgataatccctcatgggagtcatcatgcaaattagcagtcacacagggaagcacccagtgcagcgctgagcagtggccacccagtgaataaaatataactagaaaggcttattttacttgagttccactattgtttttgttttttgttttgttttgttttttgaagatggagtctcgctctatcaccaggctggagtgcagtggcgtggtcttggctcactgcaacctccacttcctggattcaagcaattctcctgcctcagcctcccaagtagctgggattacaggcacacgccaccatgcctggctaatttttgtatttttagtggagatggggtttcaccatgttggccaggctggtcttgaactcccgacctcgtgatccacccgcctcagcctcccaaagtgctgggattacaggcatgagccactgcacctggccagggttccactattgttttaaagcatcattcaataatcaatatgtcaacatgtgcataacattttaataacatgcgttgattctagagacagtacaagttagagcagtactcaggacaatagtctattagctagtcttcactttcctaagatgtttctgacaacctgtagataattaggcatagcttgttttacttcattcctttcatttatgtaatatggactgaactttccagtgatagaaaatatctatgaaaattattacaatgcctatgtctacaggcaaacgagttaataaattcagtttccgggttgaggtctctaaaatgccaagtctataaagaagcgacggcagagaacacagaacatttccagaattttgtaatagacatgaacctttaaaccacagaaggactgaatttaacattttaaaaaacctagaaaaaaaacagctgggcgtggtggctcacgcctgtaatcccagcactttgggaggctgaggcaggcggatcacgaggtcaggagttcgtgaccagcctggccaatatggtaaaaccctgtctctactaaaaatacaaaaattagccaggcgtggtggcaggcacctgtagtcccagctactcaggaggctgaggcagaagaatcacttgaacccacgaggcagaggttgcaatgagctgagatcatgccactgtactccagcctgggtgacagagcgagaccctgtctcaaaaaaaaaaaaacaaaaaaaaaaaccttaaaaaataaaagccccaaaaatgctaactatctgacacagtacagcccttaatattttcacagtctctttttggttttcctccacattcacaatgaaatgttagtgattttaaaacattccagagaaattttagtgttgacacatctttattgagggccatttcatttatagttacttatgtaatcatccaaacaattcagctcagaatactggggctcagagaggtggagtcatttacccaaagtcacacagctgggacatggcagagctgaactaggagctatgacttccggcttaggtccaggcccctttacgagattgtttccctgcctttgggttttgcatcctctattctgggcttccacccgcatgccagatggctctattcctggagtctgaccattgccagatgctcctggctgacatgacctagaagaagccagcaggctcataacttaaccatcgcccctgccaaatgggaactggccttgcagtcatcctggaagccattccctgacattttgttttattgcagttcatgtttattccagctaatgcacataaggagtggttcctgcaaggcacaatctgaagggctccttgctcagagccgtaagggccatggtgggattcagcagggaacttggcaccagccaggcacttttgctgcctcttctttgccagtgagggtagaagaactgataagaggattgagtgcacagcccaggagctgagagtttacaaggcaacccactgggacctgagctcagccccaggagtgggtcaccccacaaagtgctgagcagcatctttgagactcttctgaagcctccagtagccatctgggtccagtcgggagatagaaatcacacagtgggttaagctggggaagtttactttaaagaattactaaccgtgatgaaagagcaactatagatagacgtgaactccataggcacctagggctgagggagggtgccggacaagcttggaaggggaaggtgaggttcagcacatcagcttgcagagaaggtggctaaggtgtgcaggcctcagctggtctgcagctgcaataggccgcctcccagtgcaggtgaggagggcaacctgcaacgtgtggcaagggcatggtgggagtcagggcaggcacaggcaggaggcctccagagcactgaggtccgtgtgcagggactctgggttccttgttgggagggctgtggaaaggttatggccaggctgtggctgtgaggtcacagaagaacttcgctctgggtccgtggctggggtaggactccaacaaatgtcctcacagtcataccacctatggacgcaggacaggaaaactgcagacctttttcctcccacgatgtccctccagcgccctctactgagatagttcaacatcgcgctcacttcaaagctcttgttcttcagacagcatacatgggagggtgcattcagctctgagaggcaatgcgtttataactgacacacctcctcagcacaggatggaagagttcgcagctgccatggcctcggaagacatgggttcaagtcccagcgataccacttagctgtgtgaccttgggcatgttacttaacctctctgaacctcggtttcctcatttgcaaaaggggatattaatgttcactttcaggaccattatttgaaagtagtgagtagcaagcacccagcacagtactggctcataagagacacttaataagtagtagcgatagttcaactttatcaggcgctatctgcagtcctaaagcctttctctatttctctgaaactttgaaggcaccagatcacatttaaaaattacataaaaattacttgaaatgggcaaagagctataaatgccaacaaaccatcttgtttcacaaaaaaaaaaaaaagctgttttttagagttgcaaagccagtacatactttagctatccacaaggaagtcatctgtgaaaatgcctgacttttttgggtttcactttcttccttccctctatagcaaaaggggcatttctttcttaattttctccccactgactggtaggtaggtacccctacttttcttagtatacatcttttctcggtaagttgctaaattaaataaccagcataaaatacatcattttgtatgtgtaaaggggccagatgcaggggagggatggctcgcctgaatttaatatttttttaaaaacctaaaaaaaaaagccctaaaaatgttaacgatctgtcacaatatagcccttaatattttcataatctctttttggttttcttccacattcagaatgaaatgttagtgattttgaaacattccagagaaattttagtattgacacatttattaagggaccctcccatggcaactgtggatggcatagctgaagtgtagggacaaggttggggcagtcctccagactttgtgtacagatggcatgcagtatttctctctcctcacattgcctgaaaccaactccttttttttttttttttttttttgagacagagtctctctgtcacccaggctggagtccaatggcacaatctcagctcactgcaacctttgcctcccaggttcaaacgattctcctgacttagcctccctagttgctgagattacaggcatgtgccactatgcccggctaatttttgtatttttagtagagacagggtttcagcatgttggtcaggctggtctcgaactcctgacctcatgatccacccacctcagcctcccaaagtgctggaattacaggcgtgagccaccatgcccagcaactcttatattctgagagttgagacaatgaaagaaaagaaatttgagttgtcctgaggcagagtctgcagtgatccaagaagaggtacagatgaaaggaaaccagctcaattcaaggaacttgcttaatgccctgattttgaaaaattgtcctggcaagactttgccacatcgaatgagcctctgcacattgcaggaggctggcagggccagggagcggtgggctgctcctaacagcctgggtgtgtgttctgggcctaagagagaaggcatggcaatcggcgaggcagcatcagagaggaaggttacagatggttctgccacctgtgtacaggaaggcggtcactctctcttacctctccctggcagcacagaagaacagggaacctcgggcaccctgtccctctcccccataggcagcaccaagtccctgccggaggtgtgtgttgcctgcacagggggagaagggaagcagctggtactggtctcaggtcgatctaaggaaactccatttgacctagtgaatcagtccctgccctggataccctcctaggccaatgcaacctttagaatgaagaacaaaggggtttcctcacccctgcacaacctcagatagggagaaggagacgcagggaatgaaataaaagtttccaggactctccaggagccattcagattgtccaagaaactggtttccgcagcagcctggaataaacccattttccttctcgggtatgaggactttgccagattatgatttccttaagggcatggactgattgtgtctttttttttttttttttaaacatagactagcctattagacaaacttgtgtcttagacacctttttttcttgagcacctagcacagccttgcactcaataggtgctccaatgatgtgactaaaaggatggataaatagctctgtggatttgaggctaggaataatgaaggcctgccatgtcccggggggtactccctattgcccctggagtttggaatgcacattgaggatgtcctcagttacatatacattttggcttatgagtctttctttttttaattttttttttttttaagacagggtctcactctgtcacccagactggagtgcagtggcatgatcatggctcactgcagccttgccctcttggactcaagagtcatcttcctgcctcagcctcccgagtagctgagaccacagactgcaccaccacacccagctaactctttaattttttgtaaagatggggtctcgctatgttgcccagcctggtcccaaactcttggcctcatgcaatcctgccacctcggcctcccaaagtgctgggtttacaggcatgagccactgcgcctggccagcttatgggttttaactacttacatggtgcactctagactgagggatatcccagggatggaggacccacccacctccagggcattaacacttttagggaggctaacaactgcagccacacagaggcaggggtggagaggagagaagggtagctgggatcaggggcaggcagctgcagcagctactgagctggctcactgtgggcagcatggctgtctggcccagcctgcacctgagagctagctgaatgttttcttcacctccttccagggagaaattttttccagtactataatttgttgaagctgaaccccagcaactcaaacaaggtaccctgactctggagatgtgaaaatgtaaaataatgtgtggctttgatgaaatgtggtagaaccagaggattaagacttctgtggtgatcctctctgcctgaaatctaaatttaggagagctgagcaaacaaatgatcaaaggcagaacatgtcttcccgaccctctcggctgtgtaggcgctccggcctcaggggatgcactgactttcctcccactgtcctgaacacctgagaatcctgagcggggaacaagttgctcaaagggcagagaagtgactcagaggttcagcaagagaaaagcccagtgtattaagcatgtctttttattctgatgctttgctgtctgggccttgcaaacgtgagagggactgcccctcccaggggtagccagttcctacggttagcaaaggactcacctgggaggacagctttcatatgcaaaccaaccaatccagagcccacaccctgtgaccacctccatctggctcaaactcaaggccactgtccccctgacctaatcacccagggcctggtaccagacaattagagataactcctgtgaccccagatcctgctgaaattattcaaactccccaatcctaaacctgcttaccctgcctcccctttctttccttcccatggaaagaataaaggcgctttcccacattttcccctggtgccctcttctggagcaaccctggtgcttccccacgtggcctcctgggcttagtgtgcccccttcctcttgggctctgtgagtacaacaacttgtaaagataattttttttttagagcagttttatgttcacagccaaattgagagaaaagtacaaacagttcccagatactactggcccccacacatgcacagcctccccgattatcatcatctcccgccacagcagttgttacaactgatgaacctgcatcagcacgcacaacacccaaggtccacggtttaaattagggttcatttttggtgttgcgccttctatgggtttagacaaatgcatagtgacatgtgtccaccattatagtatcatacacagtattcattgccctaaaaatcgtctgtgcctcacctagtcatcccttcctcacccaacaactgctgatctttttactgtctccataattttgctttaacttgcttttcagtgacaattgcctcctgggatgttggccttgccacacctgaataatcatcaaacctgcattttatttgtttttatgtgtatgtgatgggttttttgggaggttggaggggaggacagggtctcactctacgccagggctggagtgcagtggtacgatcactgctcaccacagccttgacctcccggtctcaagtgatcctcccacctcagcctcccaagtagctgggactgcaggtacacatcaccacccaggctaactttttgtagtttttgtagagatgggatttcaccatgttgcccaggtttgtcttgaactcctgggctccagtgatctgtctaccttggcttcccaaagtgctgggattacaggtatgagccactgggcctggccaaactgcattttaaaatagccaagcctgttccttgtgactattgcctcatccttgtattcaagactgctgtaagatcataatcctaagcaagagtagagacatgtagcacgccatgatcacttactgtctaaccaatgctgcccacccgcttcccttctgtatggctcaccacccccaccccaaactcctataggaactctgcacacactccctctccattatgcaaaactggtctcagaaaggaatcagacagaatatttctactgaaagtataaagcttaatatgttacttcttacaagaatatttgcatataacaagggaaaaaaccttaagtcatgcagtaaacttttatcttttttttttttttaacaggagtctccctatgttgcccaagctggtcttgaacacctgggctcaagtactcctcctgtcttggcctcccaaagtgctgggattacagacatgagccacacttctttttttttttttttttttttttttttcttgagacagagtcttgctctgttgcccagactggagtacagttgcacaatcccggctccctgcaacctttgcctcctgggttcaagtgatcctcaacctcctgagtatctggaactacaggcatgtgccaccacaccctgctaattcttgtatttctagtaaagatggaatttcaccacgctggccaggctagtcttgaactcctggccttaagtgatccgcctgcctcggcctcccaaagtgctgggatttcagtctgagccgctgtgcccggtctctttttttttttttttttttgagaccttgagaccgggccttgctctgttacccaagctggagtgcagtggcaggatcatagctcactgcagccttgaacttctgggctcaagcaatcctcccacatcagcctcccaagtacctaggactgcagatgcttaccaccatgcccagctaatttttcatgaatttttaattattgaaattcagacatctaagaagatgctgaggactgtctccatattcctgaaattacgactcacctattcacaaaccagcccttctagtggaattaaaatattatttgattttgaataccctactctaaggtaggcacattgccctgcgatttattatttatgaggtttttaattatggaattgttcaaatattcacaaaagtagagagactacaatgaactccaatgtagccatcactcaggcccaactgttatcagcacagtccaatcatgttttatcttcccttctctgacccccaacccatccccagtccttatctaaaatcaaatctcaaacaccatatctttgggagcctatttatttagttagttagttttgagacagagtttctttcttgttgcccaagctggagtacaatagtgtagtctcggctcacagcaatctccccctccttggttcaagcaattctccggcctcagtctcccaagaagctgggattataggcacctgccaccacatccagctaattcttttgtgtttttagcaaagacagggtttcaccatgttggccaggctggtctcgaactcctgacctcaggtgatccgcctgcctcggcctcccaaagtgctgggattacaggcatgagccaccacgcctggccggcagcctatttaaatgtcatcctcaacatagtcaatccttgggccattttttcttacagtaaaattttgtctctttcttttaatgcagtttctacgtggaatttggacactttggccttccaggaactgaagtccgagctaactgaagttcctgcttcccgaattttgaaggagagcccatctggctatctcaggagtggagagggagacaccggtatgaagttaagtttcttcccttttgtgcccacgtggtctttattcatgtctagtgctgtgttcagagaatcagtatagggtaaatgcccacccaagggggaaattaacttccctgggagcagagggaggggaggagaagaggaacagaactctctctctctctctgttcccttgtcagagcaggtctgcaggagtcagcctttccctaacaaagccctctatcctatcacccacacttgggaggctgggctgggctgcacagggcaagatgagagatgtgttgatttcatccacttgattgtcatgtagaattagatatacttgagaagttacatttttcagtagcgccttcatatctttattttagggacaggtatacaccaagcaccatctcagccacaatctgttactaacagtatgttttctgaactttggccacttaggaaaagtacagtttggctctctccaaagtgttccctgaaagtccaactttatgactaatactgtgatttccagaaactttgactatccatgttattgacaatgattactagcactgaagggcatgcatgcaagtaggggttatgaaatatttaaaacacggttctctaagatatgagcagcaaagtgtttctaccttctatgagggaaccgaaggtgccattaaaagtagagaaatctggaccaggcatggtggctcacgcctgtaatcccagcactttgggaggctgaggcgggcggatcacttgaggtcaggagttcaagaccagcctggccaacatggtgaaacactgtctctactaaaaatacaaaaattagccaggcatggtggcagtcatctgtaatcccagctacttgggaggctgaggcaggaaaattgcttgaacccaggaggcagaggttgcagtgagccgagatcacaccactgccctccagcctgggcgacagagtgagactctgtctcaaaaaaaaaaaaaatacagacatctgttgtgattctggtaactctaaattttcaaccgtctcttcactacatttaaaaaattattttctaaaccaaattagccaggtgtggtagcaggcacctgtagtcccagcaactcaggaggctgagatgggaggggtgcttgagcctggaaggtcgaggctgcagtgcactgtgattgcaccactgcactccagcctaggtaacagtgcaagaccctgtctcaaaaaataattattttcatgtttattatattaaaatgatgtatgaaatatgtgactcatcagggcttgaaaaactttgttgtatggagattattcttatgagttgatttttctctctcctaccttatagtaatgaaataaaccaggcatgaaagtcacaataagtaatacaatgaacacccatgggtccctgcccagcttaagtagaatattacaaatgcagttgaagccctctgtgcaactttcatccttacaactgatactgagtgaattgtactttaaatattttatagctcccactcccatgcatgcccctcagtgatagcaataattgtcaataacatgaaacacagattgatcatatagcatttaccatatatttactctataccaagcacttaacatatataattacatttaaaatttacaacagccctactacccaaaacactattagtatccccttttacaaatgcgataactgaggcgtagagagctaagtaacttactgaaagtcacacagccagcgggtggtagagcctagctttaaacccagacgatttgtctccagggctgtcacatctactggctctgccaagcttccgcatgatcattgtctgtgtttggaaagattatggattaagtggtgcttcgttttcttttctgaatttaccaggatgtggagaactagtttgggtaggagagcctctcacgctgagaacagcagaaacaattactggcaagtatggtgtgtggatgcgagaccccaagcccacctacccctacacccaggagaccacgtggagaatcgacacagttggcacggatgtccgccaggtttttgagtatgacctcatcagccagtttatgcagggctacccttctaaggttcacatactgcctaggccactggaaagcacgggtgctgtggtgtactcggggagcctctatttccagggcgctgagtccagaactgtcataagatatgagctgaataccgagacagtgaaggctgagaaggaaatccctggagctggctaccacggacagttcccgtattcttggggtggctacacggacattgacttggctgtggatgaagcaggcctctgggtcatttacagcaccgatgaggccaaaggtgccattgtcctctccaaactgaacccagagaatctggaactcgaacaaacctgggagacaaacatccgtaagcagtcagtcgccaatgccttcatcatctgtggcaccttgtacaccgtcagcagctacacctcagcagatgctaccgtcaactttgcttatgacacaggcacaggtatcagcaagaccctgaccatcccattcaagaaccgctataagtacagcagcatgattgactacaaccccctggagaagaagctctttgcctgggacaacttgaacatggtcacttatgacatcaagctctccaagatgtgaaaagcctccaagctgtacaggcaatggcagaaggagatgctcagggctcctggggggagcaggctgaagggagagccagccagccagggcccaggcagctttgactgctttccaagttttcattaatccagaaggatgaacatggtcaccatctaactattcaggaattgtagtctgagggcgtagacaatttcatataataaatatcctttatcttctgtcagcatttatgggatgtttaatgacatagttcaagttttcttgtgatttggggcaaaagctgtaaggcataatagtttcttcctgaaaaccattgctcttgcatgttacatggttaccacaagccacaataaaaagcataacttctaaaggaagcagaatagctcctctggccagcatcgaatataagtaagatgcatttactacagttggcttctaatgcttcagatagaatacagttgggtctcacataaccctttacattgtgaaataaaattttcttacccaacgttctcttccttgaactttgtgggaatctttgcttaagagaaggatatagattccaaccatcaggtaattccttcaggttgggagatgtgattgcaggatgttaaaggtggtgtgtgtgtgtgtgtgtgtgtgtgtgtgtaactgagaggcttgtgcctggttttgaggtgctgcccaggatgacgccaagcaaatagcagcatccacactttcccacctccatctcctggtgctctcggcactaccggagcaatctttccatctctcccctgaacccaccctctattcaccctaactccacttcagtttgcttttgatttttttttttttttttgagatggagtctcgctctgtcacccaggctggagtgcagtggcacgatctcggctcactgcaagttccgcctcccaggttcacaccattctcctgcctcagcctcccaagtagctgggactacaggcgcctgccaccacgcctggctaattttttttttttccagtgaagatggggtttcaccatgttagccaggatggtctcgatctcctgaccttgtcatccacccaccttggcctcccaaagtgctgggattacaggcgtgagccaccacgcccagcccctccacttcagtttttatctgtcatcaggggtatgaattttataagccacaacctcaggtggagaaagcttatagcatagttttgttcttccaactcttaaaactgcagtaaaatataacaaaatttaccatcccaggatttataaaggcacagttcagtagtgttaaacacattcatattattgggcaaccatcacgaccatcatctccagaacattaataactcaagttattaatgtaccaggggaaaagaaaagtcagggctagtgcggtgactttacggttattaatacacccattaataactccattatcctcagcccttatagcaatattattattttctaaatttttttgtagagacaggattgtactatgttgaccaacttgtctcaaactcctggcctcaagtaatcctcccatctcggcctccagagtgctgggattacaggcatgagccaccacacctagctgcattattttttaataacaaacttaatttccctcttcagttgccattgtacctaatggtagaacacttcatttgccagttcagcttggattccatcacatcaatgtgttgtcagccaattcaggcttttcctctccccatgtctttgaggtggcatctatgcttgagacaagtgagattgagggcgcactggcactcagggggaagaacccaggcagagtgtctcacacctgattttagccatcaggcagattccagctttgctgctggcatccacatctctgtatccagttacagatttggggtcctctgagttccaatggccagacccatgaggcagcctttttttttttgaggagtctcactttgtcacccaggctagagtgcagtggcatgatctcagcttgtggcaacctctgcctcccgggttcaagcgattctcctgcctcagcctcttgagtagctgggattacaggcacctaccaccacgccctgctaatttttgtatttttactagagacaggggtttcaccatggtggtcaggctggtctcaaactcctgacctcatgatccaccttcctcagcctcccaaagtgctgggattacaggcgtgagccaccatgcctggccaaggcagcttttttccagcctgttgtgtgtaccaccaaggatatgaggacacagtgggagctgtcctgcagggtaggaacacaggttcccttttgctctcctgctgtgcccctgctgggtcagggccacttctcctagaagtctgccaccccataggcttcacctggaaatgagcacaagtctcctctgctttctcttgccccaacctatctggtacatgaagtcctatcaggaaacctccagaatctaagttttttctctctcttttttttctgaggcagagtcttgctttgtcacccaggctggagtgcagtggtgctatctcggctcactgcaacctctgcctcctgggttcaaacgattctcctgcctcagcctcccgagtagctgggattacaggcgcccaccaccaggcctggctaatttctaagctctctttctctctctgaagttcccttattcttccagactttattcagactgtagagatggaatactcttcacctatcttctcaggttgttgttcatgggaccagagctcagccttttgatttccaagagaatcagctcttaaaagtcaaagccttggctttaagacaattcttcctatcctgagttctaaagactatactttggaaagcaaagcgaaaaatctgacttttttttttttttttttttgagacagagtctcactctgtcacccaggctggagtgcagtggtgctatctcggctcactgcaacctccgcctccggggttcaattgattctcctgcctcagcctcccatgtagctgggattacaggaatgtgccaccatgcctaactaattttcgtatttttggcagagacaggggtttcaccatgttggccaggctggtctcaaactcctgacctcaggtaatctgctggcctcagcagcccaaagtgctgggattgcaggcgtgagccaccataccaagcctgacttttcttttcccctgggagtttattctcattaagattacacatgccatgagtgagaagggagaggatgagatctcaaaatggctctccactggtgtattaatatacttgaactcccataacaaataccactgacagagtggctttgtgaaccccaaagagctgagacaagtctcagttaatttagaaagtttattttgccaaggttgagggcaccgtgacagagcctcaggaggtcctaatgacatgtgtccaaggtggttggggcacagcttggttttatacattttagggagacatgagacaccaatcaatatatgtaagatgtacattggttctgtccaaaaggtgggacaactcaagtagggagggggcttccaggtcacgggtaggtgagagacaaacagttgcattcttctgagtttctgattagcctctccaaaagagacaatcagatatgcatttatctcggtgagcagaggggtgactttgaatagaatgggaggcaggtttaccctaagtagtttccagcttgacttttccctttagcttagtgattttgggaccccaagatttattttcctttcatagcttaaacaacagaaattaattttcttacaattctggaggctggaagtccaagatcaaggtgtcagcagggttggttctcctgaggcctctctccttggcttatagatggatggctgttctctacatcttcacattatcttccctctgtacatgtctgtgtcccgatctcctctttttcaccctaatgacctaagcttagcttaatcacctctttgaaggccttatctccaaagacagttacattctaaagtattaggattagggctaggtgtggtggctcatacctgtagtcccagtactttggggggccaaggcaggaggatcacttgaggtcaggggttcaagaccagcctggcaacgtagtgaaaccccgtctctactaaaaatataaaaattagccgggtgtggtagtgcacacctgtaatcccagctacttgacaggctgaggcaggagaatcgcttgaacctgggaggcgaaggctgcagtgagccgagatcatgccaccacactccagcctgggcaacagagcaagactctgtctaaaaaaactaaaagttaaaaacaaagtattaggattaggactttcagatatgaatttgggggtggggacaccattcagcccataacatctgggtgtcaaccactctcccccactgacagctgactcttaaaaactgaaaagcccagaaatcggaatgcatgagctcattcatcctactaagcacctctacctgccaggtgtttgaatgaaaagtggaaggtggaaagtaactgagatgctgagatgagccaatcctgtttgtgcagccctccccatggctcctgttctttctctccataacctgctgcatcaggctttgggatggaagaagagggtggaggaagaagaaacaaagggaagaaaaacttttccttcatgaagctttcagaatgttagactcctcctccatctttgactgttccttctttgtttcttttgctggttccgccctttaatcccgacctctttttactttttattttttttgagatgaagtctcgctcttgttgcccggactggaatgcgatggcatgatctcagctcactgcaacctctgcctcccagtttcaaccgattctcctgcctcagcctcccgagtagctgggattacaggcgcctgccaccatgcccagctaatttttgtatttttagtagagacggagtttcaccaggttggtcaggctagtcttgaactcctgacctcaggcaatccacctgcctcagcctcccaaagtgctgagattacaggctagctccctcttaagattgaagcaccccagggctcagtttagggtctcttcttatctacttactcctttgggcatctcatctaatatcagggctttaaattccaactcacatatgctaatgaacctcatgtttatatctccagcctagtcattactcctgaactccagattcatatatcacctgcccccttggcatctccatttagatgtctattaggcatgtcaaactagcaggttgaacatctgaccttctctttcttcatcagacacaccaaatctgctcttttatttttattttttttgagacaaggtctcactctatcacccaggctggagggcagtggcaaattacagctcactgtagcctcaaactcctgggctcaagcaagaagcagcttgaacctcccaagtaggtgggactacaggtttgagccactgtgcttggtttttttttgtttttgttttttgtagagacagggtctccctatgttgatgaggctggtctcaaactcctggcctcaaacaatcctcctgcctcagcctccacaagcatgaaccattgcacccaggtaaatctgctcttcttttggctgaggaaactcaatccctctagttgcttgggccaaaaatcttagagttatcctttacccgcctgtctatcataccccatatccaatgcatcagcagcttttgtaggtttcatcttcaaacacgtagatccagaatcttcccatatttctcatcactacaactgtaatcggtctaaatgactatcgtcttgttcctggattactacaatagcagatgacctgcttctgttccctctacccatgcagcctactctcaacactgtagccagaacaatcccattaaaacacaagccagatcatgcctctttttctgaaaacctctatggcttctgcttcccatctcattcaaagtcaaagtcagagttcttacaaaaccccacatcgtcggcctccttcctccaccactgtgccttcatcccacaaatgtccctgatccactctactcaagcttcctcgctctccttgaatgcaccaggcacacttctacctttgaacctttgcactagttcttccctctgtcccaaatgtccacacacctaacttcatcactggcttcaagtctttgctcaaatgccaccttcctaaagaggtcctacagacctggagtcaaaggagatcattttggagctttaaaatttgaactgcccagctggatttcagacttgcatgggccctgtaacccctttgttttggccagtttctcttatttggaatggctgtatttacaaaatacctgtaccctcctgtatccaggaagtaactagcttgcttttgattttacagactcataggtggaagggacttgccttgtctcagatgagactttggaccatggacttttaggttaatgctgaaatgagttaagactttgggggactgctgggaaggcattattaattttgaaatgtgaggacatgagattttgaggggccagggatggaacgatatgttttggttgtgtcctcacccaaatctcaacttgaattatattcccataattcccacatattgtgggaggaacctggtgagagataatttgaatcacggggacagcttccctcatactgttctcatggtagtgaataagtctcatgagatctgatggttttattaggggtttctgcttttgcatcttcctcattttctcttgctgccaccatgtaagaggtgccttttacactccgccatgattctgaggactcccctcagaatcatgtagaactgtaagtccaatgaaacctcttattcttcccagtctcgggtatgcctttatcagtggcattaaaatggagtcatacacctacccagaccaccctgtttaacactacaaccaacctgcacttctaatctcccttaccctgtttcactgctttaacacatcttttccattatactcatcgcctcctgatgtataattcactgttttttcattgtgtatttgttttgtttttgagagagggtctcactctgtcacccaggctgaagtgcagtggcataatctcagcttatggcaacctccacctcccaggctcaagtgatccttgcacctcagcctcccaagtagctgggactacaggagcccaccaccacgcccagctaaattttttttgtatgtttttgtagatatgaggttgctacattgtccaggctggtctcaaactcctgagctgaagtgatctgcccaccttggcctcccatagcactgggactagaggggtgagccactgcacctggacttacattgtgtatgttttttgttagtctttccccattggaatgtaaactccatggggtagggattgattgttttgtacagtgatatatccctagaacagtgccgtgcttacatagtgggtactcaacatttgctgaacaaaggaacagagagaacatcctagaatgtgttcagaaaccaaatggaagtaaaacacaagaattattctttcccagcctgacctctctttgattctatttctaactggcggtgtgtccttggacatgtttaacctctgccccatcactgtttaatggaatttatttatttttttttttttgagatggagtctcactctgttgcctaggctgaagcacagggtgcaatctcagttcaccacaacttccgcctcccgagttcaagcgattctcctgcctcagcctcccaagtagctaggatcacaggtgtacaccaccacacccagctaatttttatatttttagtagagacagcgtttctccatgttggccaggctggtctcaaactcctgacctcaggtgatccacccacctctgcctcccagagtgctgggattacaggggtgagccaccatgcccggcctcatagaattatctttaatggcagtcacattctacaactgcaacatcccatagggtagccactggctgcacaaatctactaagcacttgaaatatgactagcatgactgaagaactgaatttatttcatttttaatgaatttaaattgaaatagtcacaagtggccagtggttgtcctattggacagcgcaggcccattcttcaccagactgaggagagggagatgtgtatgtccagcatccagctggcaatggcagacactcagtgcaggctccttccctgccccatgctgctgaaggccacaggtaaggagtccgacttccacaccaatggcacagccaactactatgggggtagaagaaccggagcactttttacttttaaagaaggaacattggttttattaaatgcatgggatcaggggagatcacagagtgtttaccctgactccacaatggtgtacagaagctttgactcctttctcataggggagccgagcacatttacaagggcaggcctggagacagaacacctacaaggactctaagaagcagcagacgaaataaaggatgacatgtggggatattttttatatgtatatgtatgccagaattatcacatttttgatgccttcgaacaattcagaagagccccggaagtccttagaggtgcactggggcccgtcaaggagcttggagaggactcaagcaatggacttctccacaacagaaccactctacacttggctgcttttcagggtagagttttctgttacagagtttgaaaatcacttcaaatctcccagaaacaaactttaaaaacactgtcaataaatgtgaaactcaaccaccttagccccagcacacggcatgggaatgcagctccaaaatatagggccacacaactgtagtgtctcaggttgcgttttgaaaatccagctacctcagggttcccaggacctgagatctttaaactctagactttaaaaggcctagacttttcactgattcagatttagtaataaacaacaaggcctgataactgtttattaatttaaatacaactgactacagcaacagttctatagcataacataaagatcaaaatatatgcatatcatatcagagacttggattaaaaaaccaaaaatgactaagtctattagcaagggtaaaccatgctctatggtggttctaggtgaagaaaaataggaaagaacaaagatcttcaagagtcttctaagacaaacctcaagaatgccactgaaactgttttctggagttctgtgtaagaattcacttcaaaataagttttacatcttaggagaccgtgggatcctcagctggagaaggaggtggggcaggaggtactgtgaggtaggtcctgtgagggggaggggcttgctccaaatccaagtgggagagcatctccttagcttcatcacttttctgggtaattatctcttttctaggaagaaaggcacattgaatgccatttgaataaagatagggttttaaataaacagaggaaaaggaaacagactgggcatggtggttcatgcctgtaatcccagcactttgggaggctgaggtggaaggatcacttgagcccaggagttcaagaccagcctggacaacatagggagaccccctttccacaagaaaataaaaattagccaggcatggtagcatgcacctgtggtcccagctacttgggaggccaaggtgggaggatcacttgagcctgggagatcgaggctacagtgagctatgattgcaccactgcacgctagcttgggtgacagagtgagaccctgtctcaaaacaacaaaaaagaaggaacaaaagaaataccccagatgccagcatctaaaaagaatagttaacatttcagaggacatctttccaagctcctccacccatactcaccttgcagaaatgagatatactttaattgtcagtcagctctcctcagagtgagctcagctgtccccgttggtgccatggacccaacagagttagagtctgcaccctcactcctccatccccatcctccaagggtatcttaggattagagcagtagttcttcccatcaattagctttctccatcccctactggccagctctctgtacatttcagcctgggacaggctgtgtctaaacgtttcatttgcattccagctattcacagggccagtccagcctcagtttcacttcacagctccctttggcctaacttgcccccatccccaggctgtggggttcgcctccccttctgctggagtataccagagtctccccatcctcctcagggctgggcaaaccttgccttcaagggcataggactagcctgtcaagcttttacaggttcagatttaattgttccctgaacatttactatgttccagggactagaaattacctagaaactaaccacatgtagaatctcagcccccacattaaatctttcagctgagcaagctgagacagaaggtgattaccca

SEQ ID NO: 1229 - DNA, 2082 bp, Homo sapiens
cacccatccaggcacctctcagcacagcagagctttccagaggaagcctcaccaagcctctgcaatgaggttcttctgtgcacgttgctgcagctttgggcctgagatgccagctgtccagctgctgcttctggcctgcctggtgtgggatgtgggggccaggacagctcagctcaggaaggccaatgaccagagtggccgatgccagtataccttcagtgtggccagtcccaatgaatccagctgcccagagcagagccaggccatgtcagtcatccataacttacagagagacagcagcacccaacgcttagacctggaggccaccaaagctcgactcagctccctggagagcctcctccaccaattgaccttggaccaggctgccaggccccaggagacccaggaggggctgcagagggagctgggcaccctgaggcgggagcgggaccagctggaaacccaaaccagagagttggagactgcctacagcaacctcctccgagacaagtcagttctggaggaagagaagaagcgactaaggcaagaaaatgagaatctggccaggaggttggaaagcagcagccaggaggtagcaaggctgagaaggggccagtgtccccagacccgagacactgctcgggctgtgccaccaggctccagagaagtttctacgtggaatttggacactttggccttccaggaactgaagtccgagctaactgaagttcctgcttcccgaattttgaaggagagcccatctggctatctcaggagtggagagggagacaccggatgtggagaactagtttgggtaggagagcctctcacgctgagaacagcagaaacaattactggcaagtatggtgtgtggatgcgagaccccaagcccacctacccctacacccaggagaccacgtggagaatcgacacagttggcacggatgtccgccaggtttttgagtatgacctcatcagccagtttatgcagggctacccttctaaggttcacatactgcctaggccactggaaagcacgggtgctgtggtgtactcggggagcctctatttccagggcgctgagtccagaactgtcataagatatgagctgaataccgagacagtgaaggctgagaaggaaatccctggagctggctaccacggacagttcccgtattcttggggtggctacacggacattgacttggctgtggatgaagcaggcctctgggtcatttacagcaccgatgaggccaaaggtgccattgtcctctccaaactgaacccagagaatctggaactcgaacaaacctgggagacaaacatccgtaagcagtcagtcgccaatgccttcatcatctgtggcaccttgtacaccgtcagcagctacacctcagcagatgctaccgtcaactttgcttatgacacaggcacaggtatcagcaagaccctgaccatcccattcaagaaccgctataagtacagcagcatgattgactacaaccccctggagaagaagctctttgcctgggacaacttgaacatggtcacttatgacatcaagctctccaagatgtgaaaagcctccaagctgtacaggcaatggcagaaggagatgctcagggctcctggggggagcaggctgaagggagagccagccagccagggcccaggcagctttgactgctttccaagttttcattaatccagaaggatgaacatggtcaccatctaactattcaggaattgtagtctgagggcgtagacaatttcatataataaatatcctttatcttctgtcagcatttatgggatgtttaatgacatagttcaagttttcttgtgatttggggcaaaagctgtaaggcataatagtttcttcctgaaaaccattgctcttgcatgttacatggttaccacaagccacaataaaaagcataacttctaaaggaagcagaatagctcctctggccagcatcgaatataagtaagatgcatttactacagttggcttctaatgcttcagatagaatacagttgggtctcacataaccctttacattgtgaaataaaattttctta

SEQ ID NO: 1230 - protein, 504 aa, Homo sapiens
MRFFCARCCSFGPEMPAVQLLLLACLVWDVGARTAQLRKANDQSGRCQYTFSVASPNESSCPEQSQAMSVIHNLQRDSSTQRLDLEATKARLSSLESLLHQLTLDQAARPQETQEGLQRELGTLRRERDQLETQTRELETAYSNLLRDKSVLEEEKKRLRQENENLARRLESSSQEVARLRRGQCPQTRDTARAVPPGSREVSTWNLDTLAFQELKSELTEVPASRILKESPSGYLRSGEGDTGCGELVWVGEPLTLRTAETITGKYGVWMRDPKPTYPYTQETTWRIDTVGTDVRQVFEYDLISQFMQGYPSKVHILPRPLESTGAVVYSGSLYFQGAESRTVIRYELNTETVKAEKEIPGAGYHGQFPYSWGGYTDIDLAVDEAGLWVIYSTDEAKGAIVLSKLNPENLELEQTWETNIRKQSVANAFIICGTLYTVSSYTSADATVNFAYDTGTGISKTLTIPFKNRYKYSSMIDYNPLEKKLFAWDNLNMVTYDIKLSKM

SEQ ID NO: 1231 - DNA, 21410 bp, Mus musculus
  misc_feature (1)...(21410): n = A,T,C or G
gtaggcttcctgtggtgccgttgtaggacgtggggcctgcacaagatctaaggcagacctgatcatgatgctatctgtgctggtaaagtgcttgcaagcgagccaggggacctgagttcagttattgtgtcccgtggaaggaggagggaaccaactctgccttcaagatgacctgctgtaggcctgtggatagagagagatgtctaataaggcatggcagagtccttgtgttgatgcagggcagttggatctacaggagaaaagtttagccctgcctaggactaggtgtggctagttcacataaggtcctgggttcaacccccagcacctgaaatgaaagaaggaaaatttaccttgtactgtgtgtcagcgttgacgcgtgccctgggagggtggtatagcacatatctgcagtctagcaactgggaggttgaggttattctggccctcattttgagaactcaagctgacccaataagacatgacatccgccgggaagtggtggcgcacacctttactcccagcactcgggaggcggaggcagaggcaggcggatttctgagttcgaggacagccagggctacacagagaaaccctgtctcaaaacaccaaaaaaaaaagaaaggaaggaaagaaagaagtggcacgccattctgcgatgggcacctgaagcgctgtgggtaaaagacagctgaattgtgccgcctcctgtctttgtctcctggtcctcgggttgtgtcacactttgcagctagtggtggtagctgtgtgtcttgttttgtcctgcagatcacttctgttctcaaactttccatctctgatttattttcatttttaagttacatttttgcttaattatgtgtgttcacgagtgttcatgcccatggacatgagtggaggtcagaactcgaagcaattctcttccaccctattggatcctgggcttgagctcgggttatcaggcttacgggcaggtgcctttgcctgctaaaccaccttgctggctctttttttgttttgttttaatttacattttaaaatgtttatttctaatgcatgtgtattttaatatatacagatgtatgtacctgtgagtatttgtgactgcatgcatgtgtgtgcctcagatctcttggatctggaattagaaacaattgtggtttgtcctgtgtatgttagtcctctgaaagaacagtctgaaccgctgagccacctctcttctttttttttttttctcttcttttgtttaaagatgtaattttttgggccatgcgtggtgctacacaccttaagtcccagcacaaggcaggcatagccttgtgggttcgaggccagccaagctacatggcaaaagcttttaaaatttgtgactgtgtatgtgtacatgagcgcagtccctgtggaggccagaagagggcactggatcttctagagctggagtcacagggagctgggagctgctgtctggggttgggaaccatgctgtctgaccactgaactatcttcagcctccctccagtgtctttatatacagctgaacaaagttgggccatgctgtagtcactgtgaccttgctttccatgaccctgtgacatcactcctgttcttgttctccacagggcatgccaccgatgcctcaggcaccccgcatcatgcaccatatgccaggacagcctccctacatgccgccacctggcatgatcccgccaccaggcctcgctcctggccagatcccccctggggccatgcccccacagcagctcatgcctgggcagatgccgcctgcccagcctgtaagtgcccctgccccaccacatggtctcataagcatgatctgcgagcagaagtggagcagttacagggggcttttaggttggtggtgggtggcgctggggctgagctctgtggtgagccgaccttgtcagaggggagttggtttgtgaattggtctgggagagcaggttgaagctaactaagccaaggtgtgcatccaggttagtgcacacactggggcccagtacagtagtggcaaaagctgaaaggtctctgctgtcttgggcctttggtctctgggagactggtgagagtgtgtgcgttgggggacatgtgagagagactcaacggggtggtgatgagagtgccgtacccagcacccctctcagggtaccctgatcatgggctcccatctctcccacagctctccgagaacccacccaatcacatcctgttcctcaccaacctgcctgaggagaccaacgagctcatgctctccatgctcttcaaccagtaagtggggcggcggccgggcgggcgggcgggcggggtcgggtcgttccggtgcccagcacctgaaggtgtgaagcaggaaaggaagatggtgcgtgaggacagacagtgctgtgggcatccatgcacaggtagtttgggttccgggctgccttttctgcttcagtgacatagagaggttcagaacaagggaaaagtgaaagaacagcaaaatgttgggcaggtttagactggtatgaaccagcctattcaaaagatggcaaggacattggggacactaggaactctgccctgccagtgagctggaacctgtagaccttgaatagagggactgcaaagtggagaagggctgtttgcctagtcttcaggtttccaagcacacctcttacagaattgtctggtcaagcctgggaggtagtgctgatgtatgcttgcaatctcagtatttggagggctgaagcaggaggactgagttgagggttatttttccactatgtagccaaggctctattctatgaggcccttagttgggcgtgtgacttgctattcatgcgtgaggctcttagccttgtctggtgtggagggataatcagccctggaatgtggaaggttttattggcatgcgacctaccccatctctctttttaaagattttcttcgttttacttttaattatgcatttatctgtgtgtgggtatgtgccagaagtgttggatatctctgagttcaaattttaggcagttttgagctgcctgacattggtgctgggaaccaaacttgggtcctgcaagatcaattcttgattttacctgctgagccctctctccagcccctcccttcttgtttatgatggaaacagatggtttattgagcaaaaatacacagtcttcatatgttactctggctagccaggagctggtgatctgcctctgccttccgtggaagtctaaccttccatacctgccttggatgattctttagaattatgctgaaggaaaatttgagaaaccaaataaaactggaagcagtacagcttgtatgccatctccataaaatagtgcatgtttctgagactgcttgtgggaaaagacatccattgacctggaggaaatgagggaattccaacagtcaccatggcatcttgtaatcccagggcttaggctgaggacctaaggtccagcctgagctagggatccagtccaacaaagcaaacaccagagacagagtagggattggtgacattttgtgggactggattggactttgggggaaggaaggggcgccagcgctgtttgaggccacattgtgattgttgagatttttcatttaatgctgtttacggtaggggttctccatgtattttgtccagataatctttatgtgtggggtctgtgttctacattatgggacgcttagcctctttggcctctgttactttggtgccaaaatattaggggaaagctgaggtgggtatctgaggtctgctattccctcctcccaggttccctggcttcaaggaggtgcgtctggtccctgggcgccatgacatcgccttcgtggagtttgacaatgaagtgcaggctggggcagcacgagatgccctgcaaggctttaagatcacacaaaacaatgctatgaagatctcttttgccaagaagtagcgcctttccctatggagtaccccagtcccttccccccctcccttggctcagtccctgaaggtaagtcccccttagggaccttctcagagccgtgtgtgtgtggttgccacacagcattgtacccagagtctgtccccagacattgcacctggcgctgttagattgtgattaaagtgagtttttgaggtttggttttttaccagtgttgtctgctttattttcctgcctgccttggttccctccacatcaaaagtctggatctagtggcgtctgtgggttcccagtctgagaaaacacttgggagtgtaatagtattaatgaggatcactgagtgcaggaacaagaccaccatggacaacccgcgcagggggatactccttcaagagcacatggcgaggctgctcctgatcctgcttttgcactctgcagtaaagaggagtggcgcagggaagactttgtccccaaggcatttgagtgaggaggacaaagctgttgcttgcatcattaagggactctcatgttgttgcagctaggggagaggaaacctctccacattggcccggtggctgtgtcacatggatgctgtagtcagccccttctggtttgtaatttgggatgtctatatctgtcacccaatgggcagttagtgtccccaaagtgagctttattttcttcctgtgtgaaaagggatcctctattaataccgtgatcataatgtctccactgtccccacaaacaggcacttcagtagattgagtacatgccgaataagacttggaagtggaagtcaacattgctcgcttggcctttggttctagccagaaggccgagagagatggggagattgccatgaggtctctggcagcctgagctgctgtggtaggtgccggggagctgggaacggttagggtgataaaggtgacctagggtggagctcttaggctcttctggtgcagggtgctgggtagttactcagtttcatgtccacctccgattctaagacagtgtgtgctcagtgacctgaccagctcagaggccagagtactcttaacctgctctgaccttggcaagtgactgaactctagagccagttttctcttcagcagggcagaaaaatgagagtcaaacgcagcagtgtagagttggccagggagtcttgagctgcctgctgcaggcagcagctgccagtgcacttctggaggcagtgcaaagatgctgaggtgggagagcttcagtggagcactgggggggaggggagggggtgccaccgtgccaggtagccatgtgctcatgagatggtgggcactgacggctgctctggtcacatggatcttgaatgaagtttgtatgtgattggtccccatcctctaacacacactggaaccctgtagactgagctggcctcaaactcagatccaccacctgcctctgctgcccaagtgctgggattaaaggtgtgtgtcaccaatttgttgatgctttttaaatcctcgtgtgtttgaactggtgacccacttgaaaaccccccttcttccatcccttcccctccagcagtacatttctgattgaatccagagttcaggaacctacagtactttttcccatcttcattattttaggtggggtcttagactgctcacccagcccccactcactgtagcctgagccaacaccccctcacacacaccaccaccactggagatgtttataagcatctcccatcacatccagcttcttccatcgccacggagcgtccatcacatgtaatggctgtaactctggcggttggagggaggtgtgatagtaaaactagcaacctttttttttcacaatttcacagtcttatttccatttcttccccctcatcctttgtagaaagcacaaaacctcttggctaatatactgccctgcccccacccagggtagggtggggtggaggatggagatatgtacgacttgcactttctggtatcccaagtttcgtgtcctggtgcccacttggggtcgtagctgtctgtctataactccagtcacagggggatctgctgccctctcctggcctccacaggcactgcactcatgcacatatacccatcccctacttacctaaacataaagtcttaaaaacattttttcccctctgatgtgggctatgcattctaggttgacttcaaattcacaatcctcctgccccagactcccagatgctggaactataggtatgtggtagcacacttggttcttccacataccgtgagtagccagcgacattagcactgtgctttgagtcccttataaagtatagtcatgacttggacacaagccacaagagcctcggtctgcttacatagatggtgcttggctgacatacacaacgtgcgtggataaaaatgtgctgaaatggaagcgggtgagatttcattgcattgttcaaaataacatagaattcataattaacaaattacgcctagtaagtttttatttaacatttccagaccaaagggtatctgaaaccatagtaagtcaaagggtggataagaatggtgaagggtttctggataataataaaaatgagatgttatatgcattattaaagacaaaggctgcctttcgttggctttggcaggtggcaagctgggagggctggggatgactcagtggttaagagcactgtctgctttcagaggaccagagttagagtctcagcacccacatgtcagtaactccaccccgaggggatccacgggcatgaatacaacatgcattccgactaaactcccatacacacagtcacacacacaaaactaggctggggagaggtccctgagtcagccctcctcatcacctccccctacccccatagtccacagtccaatttttacaagcaattgcacgcttcggggcgtttaccggggcttgggcgggcatccctcaagtccagccatcggatgaaagttccatatttcatgacctgttggttgcagcctcagacttaaagtcagacatacagctccaagatttctgacccaccaagaacctagtggtatatatatatatatattttttttttttttttctgttatgggcaccaaagtccacatgcatgtcaggtaagtattttggtgccgagtacattggaaacactgagtgggttttaagtaaattgagttttgggggaatagagacatttctacaataagacaatatggtgagtgtactttttttttttttttttttttttggtttttagagacagtttctctgtatagccctggctgtcctggaactcactttgtagaccaggctggcctcgaactcagaaatccacctgcctctgcctcccgagtgctgggattaaaggcagcgttcaccaccacgcccggctcgtgagtacctgcctgtttcttttgtctaggaaggcctgaattttcagctttgcacatggcttatgcagatgaggtatcctgtgtatctccaaatcgctggcagtactgaccatgcagttagttccctatattggaagcttactttttaattttagatttattttatgtgtgtgagtattttgccttcgagtatgtttatgtaccatgtgtaacctcagaggtcagaagagcatcagatcccccgtgactggtgttgcagatggttgtgagcccccaccatattggtgttaggaacttaatttgggtcctctgcaagagcagcaagtattaaccactgcagcccctgagggttatatttttgtttttttgagacaagcatgtgaatttgaagtcactgtaactgagggtgattgtgaacttctgtcctcttagctctacatcaataatcctgggattgtaagtggtacactgcctcacccaggtcatttagtgcggtgggtggaccccagggcccggcggatgccaggccaaggagtctaccaatagagctacatttagtcccctatgtattagttagttgtctcccagaggccttcagattttcatgccttgaatcttcacagtgccaagatttgaaactagtatttacagtaaaatatctactgcccaaagaaacactttgatgtattctaaattgggaaattcaaaacatgagaacaacatgctacctcatggtctctgctaccagcttcatttatttaccaacttgtgtctaaaacttctcaaggaaatcacctcctacacttattttacagtggtcttactgttttagtttttgtggttctgggcattgaacccagggctttgtacatactagacaagctcagtcctgggcccctgacatatattttagttataaattatcatacattattttttggcttgggaattgaacccaagattatcaggcattcaaccactatgttcctgtcctgttgctatgaagagacaccagaactaaagtaaattaaaggcagagcatttactagaggtcttgcttatagttgaagagaatcagttcgtggtgattatgacagcatggcagcaggcaggcatgatgccaaagcaatagctgagagcttaaacctggcaagatgaggcagtgaaaaggagaggaaatgtgtgggggtgtggtggggggtctggcttggactttttttttcattaaaaaattttttattagatattttctttatttacattttaaatattatcccctttcctagtttcccctctgaaaatcccctctcccctcccccatggcttgagcttttgaaacttaaaagctcacacccagtgacagaactctaccaacaaggtcatctgccaaccttcctaaacagttccacctactgggaaccaaacattcacatatactagcctattgggaccaccttattcaaactataaccattaagctatagtttcagcctcagtctgttgattgcatccttgtgaggtcactaaacatgctctttgggcctctgttccttgcacgtctgttcatggactgctccttctaagaggcatgtcaggtcagataacagtgatactaagaaaccctgaaataaatctttttttccccttcctggttcagttaccatagacatacattctttagctcaatttctttgtgaactgggcttgtcagggctactcctgaggcaattcagaccatccctgatatatacatatatgatttttacacatgcatatatatgtatgtgtatatatacatacatacatatatataatatatacacatatatattttgtgtgggtgtacatacacacacatgcatatgatttgctggtgcatgccttacccacgtttggaaaggcagaggcaggttgatctcttaagagtttgaggccagtctggtctttatagggagttccaggccagccagggctgtgcagtagtagatcggtgtctcaagaaaaaagagtgggctggaaagatggctcagcggttaagagcagagcacgagtgggtcttccagatgacccaggtttgattcctagcacctagctctgtagctccagttccagaagactcaagaccctcttctggcctttaaaaataccaggcacacatgcagtactcagacatacatgcagcagttgtttgctttcattgctttctttatagatgagtgggttgaagctcataagctagaatagcttagcttctagtgaggaagtagcctgtgaatgtgcacagtgagccaggtgggacagtgcctagcctgaggccagacgttgagtgtttgctcagtacctgggaaccctggctgtggctgctaatcaaagaactgccttgttctcagacctcagcacaggaaattccagggtggttttctatactggctcctctagcttggtctctggagggtccaggtacctaaaacgacttgaaggtggaatcagatagtccagcctgcctatctgcgtctctagttatccagggggtgatcgctacttggaattgcctgaattgctttgggctcgagtaggcattttctttggcccatagcccttaccctctctctaaaatggtactggctggagaacaaccttggggagtgggtgagggtgaaatttggtttggggcggagacaggatcgagaacacaggtttccttgatattcagcctggaaggagggcaggaggagcccagagacctcgttcttcacttggtcattctcagtccatgatggtgtggtccccagtgctccttggcatcgtcgtcttgtctgttttttcagggcctagcagggctgatcgagctatgcccaagctggctgactggaagctgtgtgcggacgaggaatgcagccgtaagagtcagggaacaagggaagggggctgaaggcttggactgctagtctgttttgcagttgctgtcatttccttctccctccccagatcctatctccatggctgtggccctccaggactacgtggcccctgattgccgcttcttgactatatataggggccaagtggtgtatgtcttctccaagttgaagggccgtgggcgccttttctggggaggcagtgtgagtcttcagagagtgataatgggaagggtgtggggtttgtttgggtttgtaaagccttgttttccatatgaagggaagatttggggggaggggaaaacgagatttgggggaaggaaggacattttattacttattgcatttttttttttttctttagaaattacagagaagcttagcgccaaagctctttttcatacccgggatacaacagtgaacaaaggggtagaggcaggcaaccagcaagccatcaaaagtggcagcaaacatgacattgtgaggattagttgtagtggcaacattctatccatgagcaaatggcatttaagctgagattcaagtaagagggaagattgtacacaggcgttcagcaagcataagtgccgtttccccagatggacttttaacttcttctccaggttcagggaggttactatggagacctggcagcccgcctgggctatttccccagtagcattgtccgggaggacctgactctgaaacctggcaaaattgatatgaagaccgatgtgagtgtcttgggggtggaggtgggagtaggatgatagttcctttatttgcttacctgtttatgagaagtaattatttttgttgttggtatgtacccaagctggcctcaaaatcactagcctccagtttcagcctcctgagggctgctgagtttacaggccctgcccagtgctgagtgatctctaattgggaaatggcagagggtgcagtactggaagctaatgtgttcatttctgggtgatcaaacctagtccttgcagctataactttgttagaaccactaggcgcattgcaatgtcatcactggttggttttctatctactctttttcagcaatgggatttctactgccagtgagctcagcctaccgctatccctgcagttacccttccggctctatgcaaatacagcagccaatggcaaactatttgtctctttggtttttggggttgggtgggtatgtgcaaagaatgtttcacgggtttctgaatatagccaattaatgccctgaatgttgtaacgtcagtggctactaggcagaatttcactttgcaagccctttgctccaaggtaaggtttgggacccccaagcaagggggtaaacagtacaatatatgtacgctttcctctcttttaaagggagttgaatcattggtatgagccaatagatcccgagaagcgcatagaacgtacagtttttttgttttgtctttgttttgagggtttctctatgtaggccctgactgttctgaaactcactatgtagaccaggttggccttgaactcagcgatacatctgcctctgcttcctgagtactggggttgaaagcatgcgcgaccccagagcccgaccaacagaggtttttcttgtagatagggataaatgtgcgcgtgtcctcagctttcctctttccggtctatggggttagaaattacactcagcagcctgagatccattcttccaactctgtccatcctgcccttgctccttcttggcattcttgtccccgccccgtgcctacgtataaccaatacggagtctagtctctgctccccgatatttgaccaaatccgtttccaccgctagggcagcaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgcttatcccgcccactgcttcctgaatccacccaatcactgcgttgggcgagcgtggcctggtatccgcagctcccgaaggctcgcgcgggaggggggggggcggtgaaggcggaagtggcggcgccgggtccagaagtggaaaggagctgaggctgcagcccgagtggagcggctgccagccgaggaacaggcgcggctgcggcgccatattgcggccctcagcggtcgccactgagccatggccgagacctacggtgaggctgatgggccgaagcagggggggctgggcccgtagtggatgtggatgtggaagtggggcggggctttctggtcaggtgggcggggtctgcccggatacggggcagggctaagtgggtctggggctgagctaatcgatttgggtggagcttgaagaggccgctgtacgggttaaaaagatctagggcgggatttaagggacctagtcttggtagattagggtagggggtaggccttgaagagggaagcaagccttcctgggcggagcatgagtggatagggcggggctgacggtgaccagcaagggtcaggttttatggactacagagagagcctcacagatgctgtgcaccctgcacactctgtgggctgatctggtttgagagggctggagtgatgttcttgagttatagatttgaaacttagcgtcaagaaatgcggcataagtttaaggatagaggccaggggttctggacagaggatggggagacaaggttcagagttaggcaatcagtatggatgtacagtgtcaggtgggtagaggtaggttggaaggcagtagaaatctctgacgacaatcagagacagctccattcattgaacactcatagaaaagccacagaatctggtgcacacttaccagaggaggtaaccagtttaggacataggcccaacgtcagaggccttgacagagtgaatgagtgagagggggtaggaggtgaagtgaagaggaatggaggtcagatttaattcttgttgaaatggcttttgaaatgcatcaggtaaggtcttgcattgtggagacctttagtttgggtttgtagcttagctgtgcctagctgtgtagtcttgctttcgtcagttaacctctctggcctcattttcctagtctggaaagtagaagtccttagtatacttccttctttcctttttaaatatttatttaatgtatatgagtacattgtagccgtattcagagccaccagaagagggcattggatcccattatagatggttgtaagccaccatgaggttgctgggaattgaattcaggacctctggaagagcagtcattgctctcaactgctgagccatctcttgagctgtataattttatctttagagctttatttatgattaaatgagtctttaggactgtgatgggcatgtatatggtaaacactatataaaaataattttgtgtgctataaccctctcatttgggaaaccgaggcaggaagactgcttcaagttagaggtcagcctggactacagagtaatactctttttcttttctttctttctttctttctttttttttttaagacagggtttctctgtgcagtcctggctgtcttggaattcactctgtagaccaggctgacctcgaactcagaaatccacctgcctctgcctcccaagtgctgggattaaaggcgtgcgccaccactgcctggccaaagtaatactcttaaaataagaaaaagagaaagaaagaaaagtgcagtgtgctggcacttccagcagtgggtaggctggggcagcaggattgcagttcaagaccagatagtgagtccctgagtaggaaaaagacagacagacagacagacagcagtgggtaggctggggcagcaggattgcagttcaagaccagatagtgagtccctgagtaggaaaaagacagacagacagacagacagacaggaaggaaggaagaaagtagaggatggcagcacagtcttttagaggctgaggtaggaggagtgcttggagtttgaggacagcgaggttagtctggaatacatagtgaagctttgtttcgaatatcagtaataataatgaaaaaagaaaaaagagtcctcttgagcccagtagtggtgcacacctttaatcccagcgcccaggagggcagaagaggcaggggaatctttgagtttcaggccagcctagtctacaaagtgagttccaggacagccagggctatacagagaaaccctgtctcaaaaaaaaaaaaaaaaaaaaaaaaaaaatcatcttgggctaggttggctagcatgcaggatttcccaagttctatcaacagccctgcagacttctggatttttttctttttttaagttttcctgttttcttttctttctttcttttctttttttaaatgcatgctgtatttatacttttgtgtaaaagtatacttttttattattatacataagtacactctagctgtcttcagacacaccagaagagggcatcagatctcattacagatggttgtgagccaccatgtggttgctgggatttgaactcaggacctctggaagaacagttagtgctcttacttgctgagccatctcaccagcccaaaagtatacttttttgtatttatacttttgtgtatacttttccttctgactttctgtttcttctcttattccctttgtctttctctccctctggatatcttcggcaccatctgctcagacttcctcttcaaattcctggtgattggcagtgctggaactggcaaatcatgtcttctccaccagtttattgagaataagtgtgagtttctggcaggaccctggaactgcggatgtggtcatggtgtgggtcagtggggcagcaggtggggtaggtagcaggtaccattgactaaagctagtactataggcttgcctctagctttggtggatggtctttgctaagttctctgccaacccagcagtgagaattggggtacagaaaaggaggaagaggtctgcaggatgggggggattccaggagcccctgcactgcccccccaccccgtttccctcctactctcagtcaaacaggactccaaccacactatcggcgtggagtttggatccagggtggtcaacgttggggggaagactgtgaaactacagatttgggacactgctggccaggagcggtttcggtaggtagcctgggttcccaaggaggggagagggaggaaggggaagaaaggtgtgtagtaagaaggtaatgatgaagtaagagcaaagagatgctgagcagggcaggcagatggggggtggggcaggggagggggtgggcatattcagctcctggagaatctagtctcagcatatcagcagcttttaattaagttatgtgtagattgagattatgtgaggtatggagaacccagagacagagagagggtgaaggagaagacaggcatgtgacaaggcctacattcacagtaactgtacgcatccctcaagattggtgacaaagggagttggcctgcctcagacatcagggagggacaagtagaggttgtatagcacttggtcaggacaggcagatgggagataatcagaaaatgctccctgagtgaatgaatgaaagagggaaggccaaagtgagcactgccatcccgaggacctaagtttgagctcctgaacccatgtggtgaaaggagagaagcaattgctgtaagagtcctctgaccttcacaatgcgcgatggaacacggacacccacctacataaaagaaacaacgtgccagcttgcctaggatatgttggatgggagtcagcctgggtgagatagcatgaccttgaattaaactaaaatgaagggtcagggtgtagctctgtgtagagcacttacctaacatgtgccaggcccttggctccaatcccaagaacctacgggtatggtggcggaggcagggaacctgaggccagcttggactatagagtgagactctcaaaaagccaacctgaataatactaattgagaaagactctgaggccgagaaactgtatctcaagaagatggaggtcaggctctagggaatgggccaacagtaaagggggcctccgaaccagtagcctctctccacagaggggggcagtcctggggcagatcccagccttgggggtgactgggtccccctggcctcacaggtcggtgacgcggagttattaccgaggggcagctggagccctgctggtgtatgacatcaccaggtgggtgcagggcctgggtggcgtgggagaggccgggcctgggtggcgtgggagaggccgggcctgggtggcgtgggagaggccgggcctgggtggccccactcctgtgctgcctccctcttttgtccactcttcacagccgggagacatacaactcactcgctgcttggctaactgatgcccggacactggccagccccaacatcgtggtcatcctctgtggcaacaagaaggacctggatcccgagcgtgaggtcactttcctagaggcttctcgctttgctcaggagaatggtgagggctgtgctatggctcagatggtagatggagggagggatggccagttcactgtggcccatgtgcctcttagctttggctggaaggttgtacagcaaacatggaggcttcagcaggcctggtttgacgctaagtgctgagtcatgtgactgccgtgtcttcaggttcagctggaagggggatgaacagtctactagcctggggtctgcccgtcacacccttagctcttcctggtacagagtagctgctgataaacttcccccacgatgggggaggcagcataaagcagtggtttaaggtagataccacaaactcaggtggccgtagggatggattacctttgtaaataaaggagatgaaccaggatgggacccaagggcacaggcactgatgcttaggagaggacagaaactgacctactctgtcagaagttttgcaagcctggctgggggtgtgctgtggggtagatcacttgcttagagtccaccagtgaagggctgggaggtgtggctcagcctagtacccagggtgctagggtggaggtggaggcaggagcatgaagaaaaggattttataaacccgtttgaaaacctgggttgtctagactgctcacatctgttgacttgggatcgttctatgttccgtttttctttctctctctcccatttttaagtttagctatctgttatttttgagacagagctttgtgtagcctaggcttgcctcaagctctttctacctgagaatgaccttgaattcctagttctcctgcttctttagtgctgggattgcaggcatgagctaccatgcccaggttacatggtgttatgggtcagctaagtacatttgcagctctctctaaatattattcatctgtttatttttttgaggctagctttatacttgctatgttgcccaggctgacccagtgttgcgtctctgcctccttaggattacggagggtgtccaagcatatcctactcatgccctcctcgttttcaggccccaagtttagaagaggttttgctgctaggcagatgtggattcgaatcctgagtacaacttgagcctccagtgtgagacctgtcatgtgacctctggtgggcttggagttgtactcagtgagtctggggaccttgacaaactcctgaggttcacagtgctgtggtagaggcagggaggcaaatccatttgctgacagtgacatcagagagaagtctcagctaagccaggggaggcacaggaggctggtggagcccagaagggcctcctgactcaggctgggtcctcagtgggggtttctggggaagggccataggaatagtctcagaggaagggctgggtgagtgtgaggtaggaagacagcattccttgcaggggtatcttgtgtcgtggcctaaggtgaagggcacagagttggcgtggagggtgggaactgatggaggcactgcccctccagagctgatgttcctggagaccagcgctctcacgggtgagaatgtggaagaagctttcctcaagtgcgcgcgcaccatcctcaacaagatcgactcaggtgaggcccacctgctctctgagagatgggggagtcgggcgaaaggcagggtcctgtgggctccgaggaacatgtctggcctttcccctcccacaggtgaactagacccagagaggatgggttcaggcattcagtatggcgacatatccctccgccagctgcggcagcctcgcagcgcccaagccgtggcccctcagccctgtggctgctgagatgtgcagaaccaggtaggatgctaggggctcaggaaacaagagaggttcctgtattgtgtggggtgggacacagaacagccatcaagacttgggaaatgtgacaagagaaactgacaaaagacacaaaagcccatgacccaaaggagccatcttcccagccccgggacaccccagacctcttccagcctcagcccgcacctgacccattattcatggttatcactgctgcaatgaacttctgttgtgtgctaagcccaggtgaggcctctggggagacagcagtaggtaaaacagaccaaaaccaaccaaacaaaaatttctgtttgtgtagtactacattgtcttgggagaagacagaccacagattaaatattcatgtaaatgacatagtagttgggggcagactgtggagaaaaacagtctgataaggaggataggatgaggaatgccctttgaaacagggcaccgaagaaggtgacatttgagcaaaaacgtagagcaggggagtcagagaaagcagatgaaaacagtgcagagaccctggcataggtcctgcgcggtgcggccagagtagggtctgtgtgtgcactagggtacagcatgaggtgggggactgagcagtcagtattgacagccctggggcagtctctcattataccttgtatctatagtagtcatagggaactaccaagcagggcagaagatggagaggctcagactttgtgcatcacaggcttcctctgtctggataggaggagactgtggagcaggaggcattgctgggtgccagtgaaggagctgctggggactgctgtgaggagggggtaggatactaggtatggcgttcaggtgataagtgcttgcctagcatgtgtgccagaagcacaggctcccatactgagcactgggtaggctggtggtaatggtggtagtgtgccttcaggaagtggccttaactatggagtgagttggaggccacccttttggggataggagaaataggcctacagccgggggtgggggtggggtgggggggtaaaagggtagtgctgaaaagtggctggtttctctcgtccttgttctctttctccaggcttgctccctttagtggcagtcagtggcactgtctaaagctcagatctgaccatggctcctggggtccatggggctgggctgaagttgctgagcctggtgtgttgcttggccctctgcagggcctgggccctatcactggctccacagggccccttacacctttccctactcccttcactcttccagtcacagaaagttctttctgtttctttggctctttttttttttcaggccatgttttcttcccctttgccctggtaacctcctcccggaagctttgctggtttttccatgcatggtccagaccccagggcagacgtgcaggaccctgtagggtttggtcccctccccacctctgtgactgtaggtatccttgccaattctcccctcccagccactggcatgtcctgggtggctgtgaggtaaagtccttaggcttgggtccatcctgcaggtagagccagcatggttcttcttgatggaatgcctgtgggatctagaagtgagaaaagtccaggatgagcccgtaagccagtggcctctgcaattgctggtctgaacctgtttcctcctctgtagaatggggtcagtcatggtccctgatgagtgtgggggtgtgtgaactgtagagttcgtagaggagggcctaacatttgatggaagttccagccagagtgctgcccattgctttccttctcgcccatcttaaagaccctgggagattacgtgtgctggctctgtagctctgtgtagtaggccgtttgccccacatgctggtagccttctaaggtacagtcccagcaccacaaaataccaaaccaaagctaagggaacatttgtctgtgtggaaagagaaaggtgtgcaccttggaacttagcattgagttttttccagagttttccctcagtgagtcacatgcagcacttgtacaggctctattaaccactaagtcatatgttatctgacatagtcatatctacagagaaaacttttttttttaactttttaaaaaactccctttgttttttgtttttgtttttgtttttttttggggggggtggtcttgctgtgtacctcaggctaatacagaacttgctgtatagcccaggatagcttcagacttgcatcagtcctcttgccttagccttttaagtgctgagattataagtttctactgccatacctggttaccaacaggtcttttattacttttgagacaggttttctctacatagccctggctgtctggaacttgctctgttaaccaggctggcattgaactcacagagatccacctgcctctgcctccctagtgaagggatgaaaggtgtgtgatcaagtccagcctgataatttcttttattttaaaaattttataagaatatctccccctctgcccttttcttttttctttttctttttttcccagagacgtgtagcccagactggcctcagacttgctgtgtaatcacaggtgaccttgatttcagattccttgtcttttgttttgttttgtttttttttgagacagggtttctctgtgtagccctggctgtcctggaactcactctgtagaccaggctggcctcgaactcagaaatccacctgcctctgcctcccaagcgctgggattaaaggcgtgcgccatcactgcccggcagta

SEQ ID NO: 1232 - DNA, 569 bp, Mus musculus
ttggggcggagacaggatcgagaacacaggtttccttgatattcagcctggaaggagggcaggaggagcccagagacctcgttcttcacttggtcattctcagtccatgatggtgtggtccccagtgctccttggcatcgtcgtcttgtctgttttttcagggcctagcagggctgatcgagctatgcccaagctggctgactggaagctgtgtgcggacgaggaatgcagccatcctatctccatggctgtggccctccaggactacgtggcccctgattgccgcttcttgactatatataggggccaagtggtgtatgtcttctccaagttgaagggccgtgggcgccttttctggggaggcagtgttcagggaggttactatggagacctggcagcccgcctgggctatttccccagtagcattgtccgggaggacctgactctgaaacctggcaaaattgatatgaagaccgatcaatgggatttctactgccagtgagctcagcctaccgctatccctgcagttacccttccggctctatgcaaatacagcagccaatggcaaa

SEQ ID NO: 1233 - protein, 166 aa, Mus musculus
WGGDRIENTGFLDIQPGRRAGGAQRPRSSLGHSQSMMVWSPVLLGIVVLSVFSGPSRADRAMPKLADWKLCADEECSHPISMAVALQDYVAPDCRFLTIYRGQVVYVFSKLKGRGRLFWGGSVQGGYYGDLAARLGYFPSSIVREDLTLKPGKIDMKTDQWDFYCQ

SEQ ID NO: 1234 - DNA, 22021 bp, Homo sapiens
tcttggcattttgaggtttgcaaccttggggaaacataggatagtgtagtaatattgttcaaactcaggttacaatgactactttggcagttttgtatgttgtcccaattcacagcaggaaatggaatcctgggtcaggaaatggaaagtcagggctgccgcgtacagttaggcaggatgggtactgcacaagaatggcaccttttaagggcacaccattcactttgtaggcttacaagtttatgccaccacttttctaacagatgacaagagtgttcagggagaggtgtttcttcaccttttttttactcttctcaaaagtgcagcctgttgtagcaatggccccagagaaaccacagtaggtagttcaaacagaaaggaatttaatacaggaaacttggtgctgctgaaatcatggggcgtgtgggtggtaggagtggcggtctgggtttgagactcttgagttcgagtttgcagcccccgaatgagctcctagctagagttcagcgggatgccactctggcttccggcagtgcctggactcatttggtcactcctgggaagctactgacttgatgctggtatgaggggtgtggccgcctcacacacaggtgatctactttcctggccagtggccagccaggagcttcaggcaggtgcctgaccccaattcccctgcagtgtctagctgcagggaagtctaggatatgtgacttctggctgtacagccacaaacccagctgcagctctggattagaaagggagattgggcagggtggctcacgcctataatcccagcaccttgggaggccgaggtgggcagatgacgaggtcaggaattccaaaccagcctgaccaacatggtgaaaccccgtctctattaaaaatacaaaaaaaattagctgggcataggggtgcgtgcctgtaatcccaactactcaggaggctgagacaggagaactgcttgatcccaggacggggaggctgcagtgagccaagattgagccactccactccagcctgggccacagagcgagactcaaaaaaaaaaaaaaaaaaaaaaaaggttgagtcaggcgtggtgtctcacacctgtaatcccagcactttcggaggccgaggcgggcgcatcaccagcggccaggagttcaagacaagcctggccaacatggagaaaccccatctctactaaaaatacaaaattagccaggcgtggtggtgtgctccggtaatctcagctacttaggaggctgaggcagaagaatcatttgaacccaggaggcggaggttgcagtgagtcaagatcgtgccattgcactccagcctgggtgacagtgagactccgtctcaaaaaaaaaagggaagggagattggttggggggaccatccttaggagtttgtcacatccctgtcctggggaattttaaattgaccaaaaataatatgcacatggcccggtgctgtgactcacgcttataatcctagcactttgggaggccgaggtggacaggttgtctcagctcaggagttcaagaccagcctgggcaacatggtgaaaccccatctctattaaaaatacaataaattggccaggcgtggtggttcattcctgtaatcccagcactttgggaggccgaggtgggtggctcacctgaggtcaggagtttaagaccagcctggccaacatggtgaaaccccgtttctacaaaaatacaaaaatcaaccaggcacgggtggcgggtgccaatcccagctactcgtgaggctgaggagggagaatcgcttgaacccgggaggtggagattgcagtgagccaagatcacgccattgcactctggcctgggcaacagcaagaatctgtctcaaaaaaaaaaaattagctgggcatggtggtacacacttgtcccagctacttgggaggctgaggcataagaattgcttgaacttgggaggcagaggttgcagtgagccgagattgcaccactgcactccagcctggatgacaaaaagagtgagactccatctcaaaaaaaaaaaaaaaaaaagtgtgtgtgtgtgtgtgtgtgtgtatatatatatatgcgcatgcgcatattacttaagaccctttctcacaccaggtacatggaaaaaggcaatcttttggcaaaaagtagatctaccactaaatacagtaggccaggtgcggtggctcacgcctgtaatcccaccactctgggagccaaggtgggcagatgacgaggtcaggagatcgagaccatcctggccaacatggtgaaaccctgtctctactaaaaatacaaaaattagttgggcgtggaggcgcgtgcctgtaaccccagctacttgggaggctgaggcacgagaatcgcttgaacatgggaggcggaggttgcagtgagccgagactgcaccactgcaatcaaccagcctggtgacagtgagactctgtctcaaaataaatacatacatacatgaatacagtaaaacatactaaatttttccttgttttttgagatggagtcttgctctgttgcccaggctggagtgcagtggcatgatctgagctcactgcaacctccgcctcccaggttcatgcgattctcctgcctcagcctcctgagtagctgggactccaggcacccgtcaccatgcctggctaatttttttttttttttaaggcggggttttgctcgtcacccaggctggagtgtagtggcgcgatttctgctcactgcaatctctgcgtcccgattctcctgcctcagcctcctgagtagctgggattacaagtgcatgccaccacacctggctaatttttgtatttttagtagagacagggtttcaccatattggccaggctggtctccaactcctgacctggtgatctgcctgccttggcctccaaaagtgctgggattacaggtgtgagccaccgcgcccgggctttttttttttcttttttgagacagagcctcactctgtcacccaggctggagtgcaatggcatgatcttggctcactgcaacctccgcctcctgggttcaagcaattctcctgtctcagcctcctgagtagctgggactacaggcacccgccaccatgcccggttaatttttgcatttttattagagacggggtttcaccaagttgaccaggctggtctcaaactcctgacctcaaatgattcacccacctcggcctcccaaagtgctggaattacaggcgtgagccactgtgcctggctaaacatactaaattcttattttcctgccaaggctctaggcccaatcctgctcatgccctgctctccctgttcacgaggaatgtcaatattaaaagcagtgaagatacagggcaccccatgcagacctcctccacttgtgatgggaaagatgggaacgacaggaattgccctctgcagtaaatgacgtttattgctgacaggcaaggggaaacatctcgcccaccatactggcaaccacaggcctactggctattaagtatgtgcgttccgtggtcagctggtcctggtttctgctttctggggacttcatagctgttagcccatgggcagttgatgtccccagtctgagttttgtttacttcctgtgtaaagagtagtccctctatattaataccatgatgatgtttgtactcattacccatcccctagcacacactctctccctttcagtcacttagcaagcactcaataagttcagcaaatatttgctgggtacctattgtgtgctgcatacttttgtagggacaaggtatgcagtgattaataaaatagagaatttccagtattgtgttgtgatgaaaacaaaactgatgtggtggggccagcatactgagaggccgaggtgggagggtcgcttgaggcaaggagaccaacctgggcaacaaagtgagacctcatctctacaaaaaaaaaaaaaaaattaaaaattagccatgagtggtggcatgctagttgggagcctgacccagggggttcactggagcccagttcaaggctgcagggagctatgatggtgccactgcactccagcctgggtgacagagtgagaccccatctccaaacaaaaaacaacctaggctgggccaggcacaggggctcacacctgtaatcccagcgctttgggaagctgaggtgggtggaacacttcagatcaagagtacgagaccatcctggccaacatgctgaaacactctctctactaaaaatacaacaacagccgggcgcagtggctcatgcctgtaatcccagcactttgggaagccgaggcgggcggatcacgaggtcaggagatcgagaccatcctgactaacccggtgaaaccccgtctctactaaaaatacaaaaaaattagccgggtgtggtggcgggcgcctgtagccccagctacttgggaggctgaggcaggagaatggcgtgagccattcgggaggtggagcttgctgtgagccgagatcgcgccactgcactccaaaatccagcctgggcgacagagcaagactctgtatcaaaaaaacaaacaaacaaaacaacaacaacaacaacaaaattagttagacgtggtggtgcatgcttgtaatcctagctacttgggaggctgaggcaggagaatcacttgaacctggaggtggaggttgcagtgagatggaggtgcagtggcactgcacactccagcctgggtgacagagcaagactccaaaaaaaaaaaaaaaatcctgatgtgaagcgggtgatggggttgggaacagtaatgagtggtccagaaaacccttctgagaaggtgcatttgagctgagctcatggtgcttggtgttgggtttgtagacatggcacagacctagtcttcatccctgacaaactcttccctggccccaagcctgtgtgtgtccatcctcttctaaaaaaagcttggacttgccagtctagaggtgagggtccctgggagcaacgtggaccctctggagaaggacgcttagcctgtggatctccgaagcacactttggaggtgagagatgaaaaaaaagaggccgggcacggtggctcacctctgtaatcccagcactttgggaggctgaggtgggcagatcacttgaggtcaggagatcgacaccagcgtggtgaatatggtgaaacccgtcgctactaaatatacaaaaattagccaggcatggtggcacgtgcctgtagtctcagctacttggaggctgaagcagaattgcttgaacccgggaggcggaggttgcagtaagccgagatcatgccactgcactccagcctgggcgacagagtgagattctgtctcaaaattttaaaaaattaaaaaaaaaaattgtgcttctcagtggccctgctcctgtggctgcaatatggaggaagagtacaaagggtgggtacaaagactggcctctgtcttgctgttgggaaatccagctgccacgttgtgagcttgtgtctggaattggttccttctggtgggttcttggcgtcgctgacttcaagaatgaagccatgcaccctcgcagtgagtgtcacagttcttaaagatggtgtgcctggagtttgttccttcagatgttcagatgtatctggaatttcttccttctggtgggtttgtagtctatgctgagttcaggagtgaagccacagaccttcgcggtgagtgttacagctcataaagataatgtggacctatagaatgtgcaacagcaaaatttattgcaaagagcaaaagaacaaggcttccacagcatggaaggcgccctgagccagttgcagctgctggctagggtggcctgcttttatttccttatttggtcccacccacatcctgctgattgatccattttacagatagctgattggtccattttacagagtgctgattggtctgttttacagagtctgattggtccgtttttacagagagctgattggtgcgtttacaaatctttacctagacacagagcgctgattggcgtgcttacaatcctttagctagacacagagcgctgattggtgcatttacaatcctttagctagacagaaaagttctccaagtcccctacctgattagctagacacagagcactgattggtgtgtttacaaacctttagctagacacagagtgctgattggtgcatttacaatcctttaggtagacagaaaagttctccaagtcctcaccggcccagaggcccagccatcttcacctctcaagctgtctgtagaggtccacgtgtcaagaaaactgaggacagaggccctcagtccagttcccacaagcaactgcatctccccaacagctgcctgaatgagtttggaagcagtcctcccaccattcagccttcagatgaaactgcacccctggctgacaggctgattgcagccttatagcagaccttaagcctgagacattcgacccacagaaaaggtgataattttggtctttttttttctaaacaggttcttgctctagagtgcagtggcacgatcatggctcactgcggcctctacatcctgggttcaagtggtcctcccacctcaacctcctgagtggctgggactacaggtttgtaccaccatgcacagctagtttttctctttttttcttctttttgtaggtacaagggtctccctgtgttacttaggctggtctcaaattcttaggctctagcaatcctcctgtctcagcctcccaaagtgttgggattacaggcatgagccactgcactggggcaatgttggtcttaggctaattatgcagcaggagatacatgcactgtgctttgggaattgaagtcacttctatttctttgtggcttcatcagtaatatggggcagggggcacggttcccacagctgattcttgagtgttctttctgagtatccttaatacttcacacactatcatatatctgaactttgttcattgattatctcccctttaattttcattccttgatgaatctccagggtctggattaagtcctaggatactttatgtactcatgaaatcttcaatgaatgaagaaatgattttttttttttttgagacagagtctcactctgtcacccaggctggagtgcagtggcatgatcttggctcattgcaacctccacctcccaggttcaagcaattcttctgcctcagcctcctgagtagctgggactacaggcatgcgccaccatgcctggctcatttttgtatttttcagtagtgacagggtttcaccatattggccaggctggtcttgaactcctgacctcaggtgatccacccacctcagcctcccaaagtgctgggattacaggtgtgagccactgcatccggcggatttttttttttttttttttgagacagggtctcactctctcgttcaggctggagtgcagtggcgtgatcttggctcactgcagcctccacctcccagtttcaagtgattctggttcggcctcccaagtagctgggactacaggtgtgtgccaccatgcctgtctaatttttgtattttcaccacgttggccaggctggtctcaaaactcctgacctcaagtgatccgcctgcctcagcctcccaaagtgctgggattacaagagtgagccaccatgtctggcctgaatgaagaaataattttttaaagagtgttttaaagtggggccgggtgcggtggctcacacctgtaatccccacacttttggaggccaaggtgggtgggtcacttgaggtcaggagtttgacaccagcctgaccaacatggtgaaaccccatctctactaaaaatacaaaattagctgggcatggtggcagatgcctgtaatccccgctacttgggaggctgaggcaggagaatcacttgaacccgggagggggaggtcacagtgagctaagatcgtgccattgcactccagcttgggtgacaagagcgaaacaatgtctcaaaaaaaaaaaaaaaaaaaagaaattgcatttcaaagccaggtgcagtggctcacacttatagtcacagctacttaggaggctgcggtgggagaatagcttgagcccagttgttcaaggctgagtgagctgtgattgtggcactgcactctagtctgggtgacagagtgagaccctgcctgtaaaaaaaaaaaaatctttcaggccagacgcggtgactcactcctataatcccagcactttggaacgccgaggcgggtggatcacctgaggtggggagttcgagaccagcctggccaacatggacaaaccctgtctctactaaaaatacaaaaatagccgggcatggtggcacatgcctgtaatcccagctactcgggaggctgaggcaggagaattgcttgaactcgggaggtggaggttgcagtgagctgagattgtaccactgcaatatgagactccatctcaaagaaaaaaaagaaaaaaaaaaaaagatagcatagcaatggctgtgggcctggatacaagtcttagcctctccacttctccacttcctggctctgtaagccttagacaagttccttaactccacacttccatttccatgtaacaaggggttataggccaggcattggtggctcatgcctgtaatcccagtgctttgggaggccaaggcgggaggatacttggggacaagagttcaagaccagcccaggcagcacagtaagacattggctctagaaaaataaaaataaaagaaatcatccaagaatggtgacttgcctactattctactcgagaggctgagaggggaggatttcttgagcccaggagtttgaggatgcagtgagctatgatcacatcactgtacttcagcctgagcaacagcaagatcctgtctcaaaaaattaaattaggctgggcttggtggctcatgcctgtaatcccagcactttggaaggccatggtgggcagattgcttgagcccaggagtttgagacgaggctgggcaacatgacgaaaccccggctctaccaaaaaatacaaaaaattaactgggcataatggtacatgtctgtggtcccagctactcggtaggctgaggtgggaggaatgcttgagcccaggaaataggggctacagtgaaccaggatcatgccagtgcactccaacctgggcaacagagcaagactctacctcaaaataattatttaaaaaaatggattaattgggcataggtggcttgtgcctgtagtcccagttactcaggaggctgaggtgggaggattgcctgagtctaggaggttgaggctgcagtgagccgggatggcaccattgcactccacctgggcaacagggtgagaccctgtctcaaaaaagaaaaaaaagggaggggttataatcactcctcctgacatgatacagagtatccatttgagttcataacataaatatgtacttggtgaatgctctgtaactattggcttttttattgttcccattttacatataaggaagctgaggctttgtgaggagaaatagcttagcccaggtcatccagtgggaagcgtctggtgcagaggaatagtgatcatggtgggactttgcctagcctaaggttcagcatacaatattcagtcagtactcaagggctgggctgtttctggtaatcaaagggctgccttgttctcctgccccacagcacaggaaattccaaggtggttttctttacaggctcctccgcttctgtggccagaggggacagcggaggagcccaggtacctaagccaactcaagagaagatggaattgaatatttcaaccaccttatctaggcctctgtgattgttgaggagggggctgtcactgggaaagttgtgagctgctttggaccttatctgggaatttccttgggcttacagcctttaccctatccttgaaatggttctggtttcatagcaacttctaggtggtgtgggcgaagtttgggactggtttagggcggggacaagaccaagaacacaagtttccttgtactacgggagagagggaggggaggaaattggagaccccagcacccccttgctcactctcttgctcacagtccacgatggcccggtccctggtgtgccttggtgtcatcatcttgctgtctgccttctccggacctggtgtcaggggtggtcctatgcccaagctggctgaccggaagctgtgtgcggaccaggagtgcagccgtaagaatggggaggggagaattgggggcttgggcgttagcctgtgtggagggtgctgcattcccttctattccttccctagaccctatctccatggctgtggcccttcaggactacatggcccccgactgccgattcctgaccattcaccggggccaagtggtgtatgtcttctccaagctgaagggccgtgggcggctcttctggggaggcagcgtgagtcttgggagagtgaaagagggaagggtacagagctggggtagactcattatccccatgaagggaagatttgaggggggtgaactgaaatagacattgtggggggatattgttacttactttattttatttgcttattattttttaattttttccgagacagagtcttgctctgtcacccaggctggagtgcaatggcacgatctcggctcactgtaacctccacctcttgggtttaagcgattctcctgcctcagcctcccaagtacctgggattacaggcatgcaccaccacacctggctaatttttgtatttttagtagagacagggttttaccatattggccaggctggtcttgaactcctgacctcatgatctgcccgccttggcctcccggagtgctgggattacaggtgtgagccactgccccccagcctattttcactttatttaccaattttaggacctgatatggtcccatgttctgttctagacaccaagatacaacaacaaatgatcctttttattctaatggagggaaatgaacaaaaagcaaggcataaaaaatagcagcagccgggcacagtagctcacacctgtaatcccaagtaaggccaagttgggaggatagcttgagcccaggagttcgagaccagcctgggcaacatagcaagacccccatctctataaaaaaaaatttaaaattaactgggcatcatggcatgtgtctgtggtcccggctactcgggaggctgaggtgggaggattgcttgatcccagaagttgaggctgcagtgagccgtgatcatgctactgcacctcaacctgggcgacacaatgagaccctgtttccaaaataataataataataaaagcaaatatgcgctgctgtgagaattaacagagacttacttgggtgttcagaaagggcctctgaacaggtggcatttaagctgagattcatatgacaaggatggagcagttatgtggagatcagggagaagggagaatgcaaaggccttcagcaggcacaagcttgccatcttcccagaccctagcttttaactcctcttccccaggttcagggagattactatggagatctggctgctcgcctgggctatttccccagtagcattgtccgagaggaccagaccctgaaacctggcaaagtcgatgtgaagacagacgtgagtgtcatgggggctggcaagaaatgtggggggaggacccttaggttgtggggatgggcaaaaatgctcccacacttggctccctggcagcctaggtatgtgcgctgggagaaattctttccctgcctcaattttctcaccagtaaaatgggtccagttgggaggtgcaaagattagagggctctaggctaatttgcatagcacttgtgtggccagacctgggccctgcagctgcagcctttgctaaaaccactagatcctttgtggtgtgaccgctggttttctttccactgtttcccctttctctttttcagaaatgggatttctactgccagtgagctcagcctaccgctggccctgccgtttcccctccttgggtttatgcaaatacaatcagcccagtgcaaacggctcgtctccgtggtctttggggtggggtagggtagggtggggactgtacaaatgaaatgtttctctaggttgctgaatctaaccaattaacccgctgcctgtggtaacgtcagtggttgctaggcagagtttcactgatgaaagccctgtgcagtaggagcgctcctaagcttaggtttcggacacaagcaaaggaaaacctaagcagcccaactaggggattgtagtgtcctctctagaccagtgggagggagccaatcggactacgcggaggatataaatcgcacagtaaaggttttcttggaagattatctggaaagggaggtgggaagtaacctgcgcctatctgcccagttttcctccttttcgcctttgagaacagtaatcgctcccgccagctcaagatcagctcctcttccagcctctttctgtcaatcctgcccgtgcccccttctttgcatttgtatcccctcccccaagtccgctccgatccaatccggagactcgactctgccccccgtactccagactaaatccgttcctcggctcagctaagcagctctgcacgtcccttcccacttgctcagccaatcgctgggctcggccccgcccctttgggcttggtccttctcacgccaccaatccgcgcctcttgtcccgccccctgcccgcgagtccgccaatcccgcccttcggaaagcgtcgcctggtatccagctgccggagcgggtcgcgccggaggggggcggaggcggaagtggcggtgccgggcccggggagtaggaaggagccggggctgtagccggagtggagcggctgccagccgaggagcaggcgcggccgcggcgccatattgcggccctcagcggccgcgaccgagtcatggctgagacctacggtgagggtggtggacgaagctggggtcctgggtctgggcccagggaggatgcggcctgtgggaatgggcggggctttgtagatcagggggcggggtctggtgtgatggaggcaggacctaagtggatgctgggaggggtttagtgggtctgaggctgagcttaatcgatttaggtggagcctgagggtctggtgcgtgggttaaatagatctggggcgggatttgagggagctggtcctgaggggttcagggaggccctgagggaagaggtgggccttaatggatctgggcggagcctgagtgaaggggcggggctgactgcatgaatggcaggagtcgggcttatgggctagagggaacactgaatggaagctcgggaccctggggctgatctggctggagagagctctggaatgggtttggggatgggctgtccttgagttaggggcaggacttagtggcaaagggtgggacttatgcatgagaatggagccgggttctgggcagagggagggaaggagaggtcgggaagtggaaaatcagtagggatgcaccataggaggtggtgattggaggcaggggaagtgcaggtttaggagtcagagggagccgcattcactcaacaaatatagaagagaagggagaagagtgcaaagaccctgaggtgagaaccagcttgtcattttcagggaatagactgaaggtcaggagctatagtggagtgaatgagtcagagggtggtaggaggtgaagaggaacaagggctatatcgtagtccttgtttaaatagctttcaagagactttagcgacaaaatagctaagatctgggactctggagcccttggcctaggtttgaatctcacttctgcccagctgtgtcactttgggcaagtcagttaacctttctggcctgttacctcatccggaaaatgggaataatttttagtctacctccctcatagagttttcctgaggatgatgtgagctgttgatgtgagtaaagacctttagaactgttcctggcccacaacaacacacaattgacccatgtaacaaacctgcacatgtgggctgggcgcggtggctcatgcctgtaatcccagcactttgggaggctgaggcaggcggatcacctgaggtcgggagtttgagaccagcctgaccaacatggagaaaccccgtctctactaaaaatacagaattagctgagtgtggtggcgcatgcctgtaatcccagctactcgggaggctgaggcaggagaattgcttgaacctgggaggtggaggttgcggtgagccgagatcgcgccattgcactccagcctgggcaacgaaaagtgaaactctgtctcaaaaaaacaaaaacaacgacaaaaaaacccctgcacatgtactccctgaatctaaaataaaagttgaaaaaaaatatatagaatgtgcctggcacatggcaagtactacataagagttatctgttactgttacctattggtttgtttctgcctatgtctgtttctctccctctaactgtgatggttagagagagagattggattggaatccatcttttttccctgtatctttctctccctgtgggtatccctgattttggctccatctggtcagacttcctcttcaaattcctggtgattggcagtgcaggaactggcaaatcatgtctccttcatcagttcattgagaataagtgtgagtttcccgcagtggtcctgggaaccctgagctgtgtttatgcgcatggtgtgggctggtgggcagccggtggggagggcagggctggccataggtacaagtccagtgctggctttttggtccttgctttgtcgtatgtcctttactaggttctccttgacctcaagtcactccagcaaggagaatgggtttgtagagactgagagggccttggaggatgggggatcctctgagctgtctcctctctccctgtactgccccttctgttcctcctactcccagtcaaacaggactccaaccacacaatcggcgtggagtttggatcccgggtggtcaacgtgggtgggaagactgtgaagctacagatttgggacacggctggccaggagcggtttcggtaggtgggctgggctcccaagggtgatggggagagagagtgagaaggaaagagagagatgtgtgtgtagagtcacttggagacactgagagggcagacaaggcagacagagagagatgagacaccgtagttagcaggtatatatatccaaggagagagggagtactggagagataaagagatggtggaagaaaaagaggtaggggccaggcgcaatggctcatgccggtaatccccgtgctttgggaggccatggtgggaagattgcctgagcccaggagtttgagaccagcctgggcaacatagtgagaccccatctcaaagaaagaaaaagagatagagaaaagtggcttgggggtggggaaagggatggagactgagagacaccgaaacagaaagagaaggggaaacttgagagactcacactcagaaaggaaaagagcaagagagacagagactaagagagttgaagagaatgataagggaggtaaggaggcctggcacggtggcttacacctataatcccagcactgtgggaggctgaggcaggtggatcacttgaagtcaggagttcaagaccagcctgccaatatggtgaaaccgtgtctctactaaaaaaaaaaaaaaaaaaaaaaaatcaaaaaatgtagccaggctgtggtggtggatgctagctacttgggaggctgaggcaggagaattgcttgaacctgggaggcagaagttgtagtgagtcaagatcgcaccactgcaccccagccggggtgacagagcgagactctgtctctgaataaataaataaataaataaatgaataaataaataaataaataaataaataaataagggaggtgaggagacacagagaaacagaggtcagaggcagagagggagacagggtgagtcagacaggtgtagttggacgttgaatgaatgaatgcacgaatttacgggaaggcaagggtgagcatgagagccacagagatggaacagaaagagagacagtgagaaatagggaactgaagacacacacgccaaggcaggagaaccgcttgagtccaggagtttgagaccagcctgggcaacattgtgaaatcccatctttccaaaagagagatggagaaatggacgtgttgtgggagagagagagagagaaatgcgtagggctcaacacactgtaggtcttcaggaaatgcctgcagagcagaaaagttgatagacacatagaaaccttaggagaggccgggcgtggtggctcatgcctgtaattccagcattttgggaggccgaggcgggcggatcacgaggtcaggagatcgagaccatcctggctaacatggtgaaaccccgtctctactaaaaatacaaaaaattagctgggtgtggtggcagacgctggaagtcccagctacttgggaggctgaggcaggagaatggcatgaacccagaaggcggagcttgcagtgagcccagatcgcgccactgcactccagcctgggcgacagagctaggctccgtttcaaaaaaaaaaaaaaaaaaaccttaggagagtcggagaaacagagagcagggagagaaatagagggaattcagtccacggaaaagtgtgatctatggcagcatctagtagctgctgagttaattcttgcgtatggattaactgcctgaggtgcacagagcccaaaggcagagagaggggctgaaggatagacaggtgtgtagcatgggctaggtttacggtgagtgcttagtaaatgctgtggaatgattgcatgagttccagaaggacccagactggtgagacagagaatgcagaattggctacactgggaaggagactccacctgacacagcaggagaaggataagcagatgttgtatagtgcttgggcagggccaggcaaaggggagatttgctcagaaaatgttgaatgaatgaatgcacaaatgcatgggaaggcaaaggtaagcatgagagagccacagagatgaaacaaacaaacaaaaaagacagaaatagggaattaaatagggccaggcacggtggctcacgcctgtaatcccagcactttgggaggcctaggcgggcagatcacttgaggtcaggagttcaataccacactggccaacatggcgaaaccccatctctactaaaaatacaaaaattagccgggcgtggtggtgcatgcctgtaatcccagctacttgggaggctgaggcaggagaatcacttgcatccggggggcaaaggttgcagtgagccaagatcacgccactgcacttcagcctgggcgacagagcaaaactccatctcaatcagtcaatcaatcaatcaatcaatcaataaaagacatgtagggccgggcacagtggctcacgcctgtaatcccaacactttgggaggccaaggtgggcggatcacttgagctcaggggttcgagatcagactggccaacatggccaaccccatctctactaaaaatacaaaaattagcctgatgtggtggcgtgcatctgtaatcctggctactcgagaggctgaggtgggagaatcacttgaacccgggaggtggaggttgcagtggttgcagtgagccgagatcatgccactgcaccccagcctgggagacaagagtgagattcctactcaaaaaaaaaaaaaaaaaaaaaaaaagaaaaaggaaaaagacacataggttaaggcaggagaatcacttgagcccaggagttggagaccagcctcggcaacctagcaaagccccatctttacaaaaaatattaagaaattagccaggtgtggtggtgcacacttgtagtcccagacactacataggctgaggtgggaggatctctccgttgggatactgagcctaggaggtcgaggatgcagtgagccaagatcgtaccactgcactccagcctgggctacagagcaagaccatcaaaaaaataaaaaataagacacacatgaaagagacacagagagaaaaacagacgaatggaaagatagggacacagggagagacaaaaatggagattcataaatagagacagctggccagctaagtgagatagaagctgagagaggcgaagagagagggacttcaaggatgcaagaagagagaggaattgcatggtgacccgaccaaggccaggttttgggggatgggccagcagtgaaggggggggcctccgaaccaccagtctgtctctgtagaggggggcattctcggggcagaccccagccttgggggtgactgggtccccctggccccacaggtcagtgacgcggagttattaccgaggggcggctggagccctgctggtgtacgacatcaccaggtgggtgcccggggtgggtggggtagggcatgggtggttcctctcctgcactgcctccctcccttctcccttctccacagccgggagacatacaactcactggctgcctggctgacggatgcccgcaccctggccagccccaacatcgtggtcatcctctgtggcaacaagaaggacctggaccctgagcgggaggtcactttcctggaggcctcccgctttgcccaggagaatggtgagggctgtgtcgtggaccaggtggtggtgggggtggacagtccacagggaccatgggtttactggctctcagtggctgtacccagcaggggaacgtggaggttcagaagtctgggttcaaatttgagtgttggctgggtgtagtggctcacacctgtaatcccagcagtttgggaggccaaggtgggaggactgcttgagcccaggagtttgagaccagcctggacaacacagtgagatcctatctctataaaaaatttaaaaaattagctgggtgtggtggctcatggctgtagtcccagctacagtggaggctgaggcaggaggatcacctgagcctgagagtttaagactgcagtgagctgtgatcacgccattgtactccagtctgggagacagagcaagacactgtctccaaaaacaacaacaacaacaaaacaacaacaaaactaagtgttgccatcagtgagctatgtgattacactggttctcagtttcttcatctggaaagtgggatcacagtgtttctgccccacagtgtgctgtgatgattaagggagattgtggaaagtccttagcacccgccacagagtgggtgctagattaatgttggccgctaaggtttcgcctaccgtcaggaggccgcacagggtattggttttttaaattaattattttatttattttttcctcctaccgcaccttcctgggtattggtttaatgtagagattgcaaccctagatggccctaggtgaaaggcacttttttttttttttttctgagacggagtcttgttctgttgcccaggctggagtatagtggcgcaatctcggctcactgcaacttctgcctcagcctcccgagtagctgggactacaggtgtgcgccacaacgcctggctaatttttatatttttagtagagacggggtttcaccatattggccaggctgatctcgaactcctgaccttgtgatccgactgcctcggcctcccaaagtactgggattacaggcgtgagacactgcgcccggtgaaaggcacatttttgaatacaggagatgggatggggtagatccttgagtaacaggtactggtgttaaggggagtgcagcatactgacaacccacaccaaaaggtttgcaagggccaaccacaatggctcacacctgtaatcccagcattttgggaggccaaggtaggagcatcacttgagatcaggagttttagaccagcctgtgtaacagagtgagaccctgcctctacaaaaaaaaaaaaaaaaaaaaagcctgggtgtggtggtatgtgcctgtggtctggggtactcaggaggttgaggcaggaggatcacttgtgcccagaagttcgaggctgcagtgatctgcaatcacaccactgcactccagcctgggggacagagagagactttgtctcaaagaaaaaaacaaaaaaggtttgcaagtataaactcatttgaaaacattgtgttggccaaaccacccacatctggtggcttgagatctgcctgtgttcccctgttttgcaacctccaggtttaaaggaggttttgccatcagagaggtgtgggtgtgaattcagctctgattttctgactgtggggccttgtcatgctgctgatgggtagactctggttggcctgttcctgtcctagatggtgctagagacacagtgttggagacagccctaggcccaaccttcatggagctcacagttcagtgggtgagggtggaaggacagacccacttccagacagtgacacctcaggaaggtcagggcttgatggtgaagcaccgggagacaggggtcagagccagcaggggagagccccagagggtcagggccagtactgggggggcaggcagagggatcggggtgggatggagaacacaggcagaggggtcagggctgggatagggcaggcagaggcagaggggtcagttgggatgaggggacacaggcagaggagttacatgggatggggggcaagggcagaggggttggggtgggatggggggcccaggtagaggggtcaaggccaagtttgggaggcacaggcagagcggttgcatgggatgggggagcatgggcagagggctcaggggtggaatggggcaggcctaggcagaagggtcaggggtggaatggggcaggtccaggcagaagggtcaggaaaggaatggggcaggcccaggcagaagggtcaggggtgggatggggacccaggcagagggttggggccaggatgaggaagcacaagcagtggggtcagggccaggatagggggccacaagaagctgtgggagccctaagtcggtacctgactcagcccaggaagtcagggaggacttcttggaggaggagctgtgtgagctgagctctgaaggaagagctgggtgggcatgtcgggaagcggacattagtggcagggaaatggcatgcgcagaggcctgaggtgagggtaaggggggatggaacattggaggaacaggatgagagtcagcaggtgagagctcagtggagggtggggactaactggggccctgacctcagagtgtgtgcccctgcagagctgatgttcctggagaccagcgctctcacaggcgagaacgtggaggaggcgttcctcaagtgtgcccgcactatcctcaacaagattgactcaggtgaggccccgaccggcccgagtgggagcgaagggcaggcccgggggtctccaggcaaccaatgctgacctctccccttccccacaggcgagctagacccggagaggatgggctctggcattcagtacggggatgcgtccctccgccagcttcggcagcctcggagtgcccaggccgtggcccctcagccgtgtggctgctgagctctgtggagccaggtgggacactgggggctttagggaggcagggcggcctcttgggcatgggggagatggtgtggagatagacactgaacatgtgatgacaagagaaacagagtgagagaaagatgcaaaaacacacaagctaaaggaggcatctggctgggcgcagtggctcacgcctgtaatcttagcactttgggagtccgaggcgggcggaggcagttcattgggtgggggtggggagacagacccacttccagacagtgacagctcagaaaggtcagggccaggcctggctcggtggcttatgcctgtaatccctgtactttggaaggccgaggcgggcggatgacctgaggtcaggagttcgagaccagcctggccaacatggtgaagccccctctctactaaacatacaaaaattagctgggcgtggtggcaggtgcctgtaatcccagctactcgggaagttgaggcaggagaatcacttgaacctgggaggtggaggttgcagtgagctgagatcac

SEQ ID NO: 1235 - DNA, 539 bp, Homo sapiens
acgggagagagggaggggaggaaattggagaccccagcacccccttgctcactctcttgctcacagtccacgatggcccggtccctggtgtgccttggtgtcatcatcttgctgtctgccttctccggacctggtgtcaggggtggtcctatgcccaagctggctgaccggaagctgtgtgcggaccaggagtgcagccaccctatctccatggctgtggcccttcaggactacatggcccccgactgccgattcctgaccattcaccggggccaagtggtgtatgtcttctccaagctgaagggccgtgggcggctcttctggggaggcagcgttcagggagattactatggagatctggctgctcgcctgggctatttccccagtagcattgtccgagaggaccagaccctgaaacctggcaaagtcgatgtgaagacagacaaatgggatttctactgccagtgagctcagcctaccgctggccctgccgtttcccctccttgggtttatgcaaatacaatcagcccagtgcaaac

SEQ ID NO: 1236 - protein, 131 aa, Homo sapiens
MARSLVCLGVIILLSAFSGPGVRGGPMPKLADRKLCADQECSHPISMAVALQDYMAPDCRFLTIHRGQVVYVFSKLKGRGRLFWGGSVQGDYYGDLAARLGYFPSSIVREDQTLKPGKVDVKTDKWDFYCQ

SEQ ID NO: 1237 - DNA, 75101 bp, Mus musculus
  misc_feature (1)...(75101): n = A,T,C or G
atattgagtgagaatactgaaatcatagattaattttgtgaaaactgacttcttcctgtctccctgcccccagttgctagagtttcccattttctaaaagtactacagatttgaaattggggcctcagacttgggtctgagcacatttacccacaaaactatctttcttttttctcaacaccaagatttctttttgaactccacaaaatgtaaagtttacccaaagaattcacagaccagtacaaagtctaaagtaaatagaataaggaactattgactaaccctaccaatgctaaaatcataaagcaatgtaaaggaaaatgcaatatacacatcaagagaaaataattagacaaatcaaagtctcaaatatgtttgaagtaataataagcatgtctttgaactcctatctaaagatatttaaatttccattactttaaaatatttttatttttgtatgatgtgtatgatgtgttttggatgattataattatttcaaacatgttcaaaattatgctatctatgttattgccaaggagtataaactgcctaaaaccagattgttctgaatctgaactgtggatgagcaaaaaactcaacagattaacaagcacaaggaaaagggcagtccacaagcataaagatgtccttataaaaacctaagagccaaacctggcattatggtagatgcctgaagacacagctaatcaggcggccaagacaggattatttcaactcagaagttcaaggtcagcttgggtagcaaagcaaatccttgtctcaaacaaacaaaaatgcacaatatattctagaatggaggctacatcagtggtgtagcacttgtctactgtgagcaaggacctgggttccatttcattcctatactgtcatcctgcaggcaggcagaacacaggcaggcaggcaggcaggcaggcaggcaggcaggcaggcaggcaggcgcgcacgcacacacactctcacagaggcaagcagtccatgtttcaagtacacaaaaagaagaagaaaatcaaaatcgtccggtagccttgacttttccttttgtttcagactaaggtacttaaggatttatgtctgtattataacacatcctataaaccaagcactccaaatttctaattcatatactttttctagcactgaaattacttccaaacttccttccctgcttacttgttaaaaaaaacattcttatatccaatagtacctggaactaaaatgctatcatggacaaaccaatctccgtgtctacttttccatcctcacaaaagtcccaaagaacgagcaggactttttttctgaaagaagtgctttgataattcactgctatttcaataacatgagtacacttctttttttttttttttcaaaaactattcaacactaattgccatgtattgtattagacctcttctatatcaaacacactaaagctagctcataggctcttttacatactcaacaaacatccactactccaggaatgaggtagagagaaacacaattctattaaacttaaatgtatacaggcttacaagggcctcacagtttaaaggcgacccaaagggacatgcacttgagtatcacattctgaatccatcagcaactcctagccaggcatggaagtccatgcctgcagtcccaggaccacattctcaaaaagagcccgagctccagaatgagtcagagctaagcctgcaagaccctgtctcaaaaacaaacaaactcagtaaccaaaaaataaaaaataaaaataaataaaaaataatatccagaacaaaaatatatattttaaaggaaataggagggggacctcctggttgaagtgaaacatcattaaatcactgaaaaaaagtttatatagtagggtttgagagagcaatgtggaaaaagaacaatccacaaaagagggtagtttaatgggagaaaaaatacacctcttttggaggggcaggttgagatgggtcttggtaactagtcctacctgtgtaacaactaccttcaatttgctgggatcctcctgcctctgctttcacaggattgcagacaggaaccaccacatccaataaaaacttataataaaaagcaaagttggtagatataatagctcagatgttataaataggcaaatatgccatgcttcactattatctatgtaaaaattatgaactaaaacagactaatatagtcgggtagtggtggcgcacgcctttaatcccagcactcgggaggcagaggcagtcggatttctgagttcaagatcagcctggtctactgagtgagttccaagacagccagggctacacagagaaaccctgtctcgaaaaaccaaaacaaacaaaggaacaaacaaaacaaaacagactaatacagccaggcatggtagtgctctggagggagagtggagggagaggcaggaggatctctctgagtttggagtcagcctggtctacactgaaactccaggacagccagaactacatagagagatcctgtctcaaaaacggggaagtaaggtgtagagaatatgaatgaataaataatacagcttttcctttaaaataaatgttatggcatgagtatattttgaaaattactattacagggctaaggatacagcttagtagtacgctctaggcctggcgtcagattgccagcagtgaggtgtggtgggtgggaaacaacagccaacaaactgactacaaatggacttctcattgtaaaatgagctgggcctggggcaactgcaacaggaagagagctggggcaaaaggactgaagccagcctggtcagcaagaccctgcttaaaacattttttaaaataaaatgtaggctggagagatggcactgtggtaaaaagcattggctgctcttccagacaactcaggtttaattcccaatacccacatagcaactcaggagattcaatggcctcttctggtcttcaatgagcaccaaaatacatgtggaagacagacataaatgtaggcaaaacacccatacatataaaatcaaattaaaatttgaaaataaatacaaattgtttcttatatctagaaatcagagtaagagaaacaagcaaattactgataataaaatttccaccactataatacttaaatttcattaaatgtaactaggtcagaataaccttgaaaaatctatttatttaaaatgttcatcaagctgggcggaggtggcgtatgcctttaatcctagcaatctggaagaagcaggtggaggcagatgaatctctgttgagtctgaggccagtctggtctacagaatgagtcccaggacagccaaggctacacactgaaactctgtctcaaaaaaactagaaaagtaaagtaaaatgttcatcaaaatagaggaaaaacttaggcaaactaaacaatgccccatgacaaccacatcagtagcattttcttcaaactgtatattcattgcagaaatgtaatgttataaagtattttaagggctggtgagatggctcagtgggtaagagcacccgactgctcttccgaaggtccagagttcaaatcccagcaaccacatggtggctcacaaccatctgtaacgagatctgactccctcttctggtgtgtctgaagacagctacagtgtacttacatgtaataaataaataaatcttaaaaaaataaaaaataaaaaaaataaagtattttaaattcaatacctacactgaacatccaagtaatcactccttttctagtcagcccaaattttaggtaaaaatccatcatcaaacccaactgctccatatataatatggtgtatatataatgaaaaccatactagatatcagaaatatggcttttgttcctgcccaatagcaacttgggcagatcatttcattctcagctattcataccctcaaaatattcaaatataaagcaaaactacatctatatatggctatacactctaggattctacaaattacaaattgtaaacaatttattttaaccaatttaatttgtttttgagatcacagctaaaagttaacaacaataaggtattaaactgaagaactacacaggcacacatcagtgtgcttgccatgtctctgactttcaaaggcaagtgggtagaggacacaggttgtatctgaagactacacaagtagcttgcttgccttccttccttccttccttcctgccttccttccttctttcttttctttatggttttttgtttgtttggttggttggttggttggtttttgtttttcgagacagggtttctctatatagccctggctgtcctggaactcactctgtagaccaggctggcctcgaactcagaaatccacctgcctctgcctcccaagtgttgagatgaatgttatccaagtaactttctgaccacaggagttcctggggtagcaaaaatggctcagaaatatggtaaatgttcaaggaaaaaaataaacaagaccacaaaaataccaaaataaaaccaggtgatccacgtagctgctgctatgctgcagtggttttcatagtttttcaacattcctaaggaggcctgatagagaaagaaaccccctcttaaccattaaaattactttttgtatcctcaaatacaagaacaaaatatcaattactctgactacggagttacttgtatctataattcatttaaaactaaaaaaaaaaaaatttaaactaaaagctcttatttttgcctttatagcatttaacataaaaagtacttcatactagttacaacaactaaataactgaaaatatacacgtctctgatctttaaataagtctgttcagagcacttctgatcagcctttattacttgcttttacaccatggtctaataaaatatgtgtgaacaaaagaacagatgaagccaggcgctacagtgcccacctgtactttcagctaagtagctgtgacataagaatcgactgagctcagttctaggcagtcagcctggacaacatagaccatctcaagttagtaacagagatggtaagatgacttagtagataaaaacccctgcatcaaggctgccaaccaggtgctcaaacgactcctgaaagctgcccttcacttcccagacctgccatggaacatacacactcgcaataaacaaacaaatgtttgattttctctgtgtagccttagctcccttcataaaccaggctggcttcaaactcacagagatccacttgtctctgcctccgaagtgctggaattaaaggcatgcaccaccaccacccagcataaatgtatttttaaatagttaaaaaaaaaaaagatgggggtaactaaatgcataagaacagtaccatttccaggaccaataaaaatatgaaaatacaactaaaatagattaaaagatataattaaaaatgaataataaaacagaggaggggaaaggagagatctaaaaagtaatagcatgatattcacctccatcaatctctggcctaaacaaaggcctttgatttctaaaacaagtgacaatgacaaaaaattcattatgtcacaaaaatgagtaaataaatgcatgagtaaatcttcaatgctataaaaactggagtgacctgaatttgcctggtccagaacaaactacaatccaattaaatccaaagaggttaacttcctgcattttctttttcttcatcttgcagacagtccaacactttgagttcactatgtatttgttcatttttattttatgtgtaataactgtttgcctacatgtgtgtatatatatgcgcatcacatgtgtgccttggaggacaagaacatcagatccctagaagtggggttacagacagcagtgagctgccgtataggtgctgggaaccaagcctggatcacctgcaaacaaaagtgctcttaaccatgcaatcatctatccagtcccaagtttattttctttaatacaagagacaccaaaagatggcctagtaagccatcactgcaaagagaggcccattggacttgcaaactttatatgccccagtacaggggaatgccagggccaaaaagggggagtgggtgggtaggggagtgggggggggtgggtatggggggaccttttggggatagcattgaaaatgtaaatgaggaaaatacctaattaaaaaaaaaaaatacaagagacacagttaaaattatatattaccagctggaccggatggctcagtggttaagaggactgactgactgctcttccagagatcctgaattcaattcccagcaaccacatggtggctcacaaccatctgtaatgggatccgacgctctcttctggtgtgttctgaagacagtgacagtgtactcacatatataaaataaatctttaaaaaaaaaaaaatatatatatatactcctttttcttcctctttcttgagacacaatctcactgcttaaaccttttctggcctaaaactcactatgtagaccaatcttgcctcaaactcacagagatctgtacatacataatgttaagattaccatgccaggcaatataatcttttttaaaatttataggacagaatcatagctatataaatacatgagcaacaggtatattctgatgagttgtaatgtgaatacttattcttctaactgcaccgtgagatttgcagataaagcattactctcacagaagcataatccttttaacctgtttaaagcattttcataatttttttgaaagaaggtcatgaatatcccagattggcctcaaactcaatatatagctgtagacaatcttgaacttctaatcctcctgcctccaactcctgagtggacatgtgtctgcttttatgtggtgttgggaatcaaatctggggctgggtgcacactacctaagctctctaccaaatgggctgtagccccattccagtttcataactacttactcagagtagactcacaagaacaaaacctgtgaaaagagttttcctaattttatagataagaaaactaaaacacagaaaagtttaacatgttctaaatgccagttaattgcagagagaattacaattcatagtattacagtttcccaggaggagtattacaacatacagtaagcttttgctaaaagataagaagtgttttggtatggcaagtaatcactttctagatattagaacacacatacagtttgattttcattaacaggtgcacttaagacaaagcaactggaagctataaatattaaaataaactaaacaaccactggagttttcttttcttttttctttttttttttttcttttggtttttgacacaacaaagtttctctgtctagccctggctgttctagaactcactcagtagatcagcctggccttgaaatcacaaagatctacctgcctctgcctctggactgctgaaattaaagctgattcaacctctgggctgtaatagaatgagaatgtaagatttttatctagttacttagctttatttcttctgtaacttttacacatatctaagtaagtcagagcttgagcccagacaaatatgaactgtctcatccagtaaatgtatgttaaattttaatatattaaatgggggacatggagaaatattaaaacatctccccaaactattaaaaattaaataaagtatggcaggtacaagcattaccacataggcagtgacaaagggagttccaggccagcaagtgctataggcgtaaatggtctcaagcaaacaaaattaattaatttaaaacatcagctcttcatttatccaccagatactatccttgtgaatgagaatcatcatcaagtattaatcaagataccctgaacatatgaatgactgtgtgtagggcagttttacatcccaggcctgttgctctttgtatacagccatgtttaggctcccaccaattctctcaccagggtgcacacaaggaatgtacatttcaatacaacaggatataattaggatagcaagcaaatctggtgcaggtgaatatactagactcaaagattaaaattacccataacgctactcttcaatgttgaacaggcactgtggcagatacaacctggcatttcttaggcaaaaatactttccacaaacatcacttattaccatccacttctttgcatgactattcttggtccacactaattctaagaacgcagtatcctttccgttaaggttgctttctcaagtactttctcaaattccggtcgtcgttgtctcccaaaaaaaaaaaaaaaaaaaaaaaggggggggtgcaatctcccacttggcacaagaaaacaccaataacaaacggcagaaggcagagggtgctgctcttcgcagctgcaccactaccaacccttcgccattatacctcaagtgggccagttagaaaggtgaactagtttgctcttcacacttgtccatcgctgtcaccctccttaaccccttccatactagtcaaacagccaccaactctccctcagagtgggcctaggacggtcacctgcgccggccccacccgaggccctccatcctcgcatccccttcgctgatcccgcggtggcaccgcacgccccttcccaaatggacagatacctcgggctgatgtccgcccgcctaaggccattcttcctccaaactccaggagcctccactcgtctagcctgaactccccaccgcacccgactcgcccctgggggagggagaggaaaagacctgcggtttggacgggccctaaccctgcgtcctccgcgacgcccctggcctggccgatccgaagctggcgccctgggagcccgaggaagctcccgggcgagcagggcccggaggccggggctgcaggcgccgagcctactcaccgggagctggcggagtgagagccggcgcgccccacggccggacgaccggggcgcggccccggcgcgcggccctccgcccggccctcgctcggcagcgcggcgagctgggcgctcactccagccgccgccgccgcagcttcgccaccttagccgccatcttgcctcaaccccactccctccccctcaggccgggcggccgcgctgaggcggctcagacttgggctcctcctccttccggagggttggggagacgactccctccccgggagaacggagtgcggctcttacctcggcctcgcttcctgggtcgcggacgccgcgccggttcttttcaagttgtccctcgcactcatgcccgccccggcagcgctgcctccggcccgacccgccgccgccgtggcagccatcgcgtcctcggcctggagcgtccccgcgagcctgccactcccgcgcgcccggggccttcccctcaggcgtgggaaaggaccgggagcccggcgcgaggttagccttgcgacccctgcgcgccgccaaagcggctaccccgtcccctcgccgccaaagagaaacctcagcccacgtggctgggacgcacgttaatttcacaccgagtgttcctcggcatggcgggcgaggcctcctccacggcgtggctccttaatctctgcctcttaagaaaacttaaggggcctgccgacctcacccttcgagtgaaatgacatttcctcttagccgcttacgttttcctcttgcaaagccgccatctgagaaagaacaaacggtgacccgcttcggaaaaacttttattccggataacgggctgttttatacaaagtttgaagtcataaaacgagttgaaaggagaatgctgacgtttgttttagaatgcttcccttttggccggcgtgctgacacgcctgaaatcccagctcaggaggcaaaggaatgggaatcattgcaaactcgcatggtctgcatatagtgagttttaggggaacacgcagagagagacgcgatctcaaaataactctaaaaatgcttccttccttttaagcacactgaacggtaagaaagacacttaagaccgcaaagtgcggctgagctctgaaactggagcagatagaggattccgccaccgaggagacggggcagtatgggtggaagtttccacgctagaccacgaatcttggtctccagccgccgccgcactctgacccacggaacgcagtttcagccggttccgttttcccgcagggaacccgagtccacccgcagcctgccttcctgcgcaggcgcagtgccacttacccggcatggaattggtgggtttcttgtgtgtggccgtggctgtcctgacttggggcttcctccgggtttggaactcagcggaacgaatgaggtctccggagcaggcgggcctgccgggagccggaagccgggcccttgtagtgatcgcgcacccggacgatgaagccatgttctttgctcccaccatgctaggcttggcacgcctggagcagcaggtgtccctgctctgcttctcctcaggtaggagactgtaggagggtcgctgggttagggaactaaccgatcttagttaacttcttccggaaaggttttctgtcgtaggtagctactttctctgtgctggtcagtctggggacagaaacagccgacttcccagataggttagggaaccccgagcgaattccatcctagccaaatcgaggagcagaaaagtggttgttcatcattggttccgttcagtaccttcatgttcctttgggaactgcgactgtactggatgttttgggttttttataaagacagtctcactgtaatctagcatcccaggcgtgagccgctgtgcctgacctgttatcctgaggaaccgtctatttgcaaaaggatcaaataaaatcatgcaccagacaatttgagctgtatggtgtctgctcagcccaccaactttctttcctaataatagcaaaagaccttcctgctgctttgaaacccattttctgctacaaagattcatgtgtcaaattgggagattttttgtttaacttcagacaaatagaaatacatttatagataattttagagttcatctgtacccagctattattaaaagaattcttcaaaaatgagacttgaataatgatacagacaaaaacaaacgagaaaaccaggataccctaaatatggtgatgactggacaatgtgaagtgtatacatacagtgggtgaattttatagcaaagtatacctcaataaagctgattttcaaaattgctcaggaccttttttcccatgtggttgttgtgttgttctcttttggggggccaggggtgtttttgttgttgttgttttgtttttttgtttttctaaacagggtttctctgtatagccctggctgtcctagaactcactctgtagaccaggctggccgagaactcagaaatctccctgcctctgcctcacaagtgctgggattaaaggcatgcgccaccactgcccagcttcttcgggtgtttggttggtttggtttggtttggtttggtttggtttttcgagacagggtttctctctgtgtatagccctggctgtcctggaactggctttgtagaccaggctggcctcgaacacagaaatccgcctgcctctgcctcctgagtgctgagattaaaggtgttcgccaccacgcccggctttctttttttaataactgatcttaaacagaaatcatcaggattgatttataaaattggctgaatttgggagaattatttctggtttttaaacagaattaatgtagatttattaaagaaaaaaaaaaaaaaactcctgagagtggagaggctccaaacaaggaaagagtaccttcttttcttttctttttttaatttacattttatgtattagtgctttgcttgtatgcatgtatgtgtagcacatgaatgcatggtgtgcacaaagactaaaagagggtgttggattccctggaacaggagtcatagccagttgtgaactacaataagaatgctgggaacttgctgggcaggggtggcaaatgcctttagtcccagtgttccagaggcaggcagatctctgagttcgaggccagcctggtctacagagggggttccaggactgcccagggtacacagagaaaccctgtcttggggggaggggaggtcagtacaggaacctgaattctgggtctccaggaagagcatagattactctaaacctcagccatctctcttgcccccttgttttatgttttataattattagaattgaattattcacaaatatgtttcaagatttgcatcatagctgtatttgtttgcaagatagtctgggttcagtatgtcctctaatattttctagattatttttaatagaacttaaaatttttgggtcaagccaggtggtggtggcacacgcctttaatcccagcactcaggaggcagaggcaggcggatttctgagttcgaggccagcctgatctacagagtgagttccagaagccctgtctcgggaaagaaaaaaaaaaatttggatcaagaaatcaatttgtcctttttcagttcttaggtttgagtcaaaggtctcaaacatgccggacacccagcctcccaaaatctttatctaataaaagatataaacattcacttagcagttagtacccctactgttgtctttatttcctctgaatccaacttgccatttttaattggtcgctgttgtagtaaaaagcaagaatatagtaatgtttaatataccgtagtaaaggctggagagatggctcagccattaaaggctaggctcacaacaaaaacaaacatagagcatagtatagagaaaactgtagcagtataatggagagagtgcagtgggcaggcagtagagaagagtaccgattctcttttcagaagttttccaggcccattggacatgcaaactttatatgccccagtacaggggaacaccagggccaaaaagtgggaatgggtgggtaggggagtgggggggagggtatgggggacttttgggatagcattggaaatataattgaggaaaatacgtaataaaaaaaatattaaaaaaaaaagttttccttaaagaaggctccaaataggttttcttttgatctgggcttcaaaaaagaagcatatatatggaggagggataataaactttctaggcagttaagtcttgttcaaatagtttatcccaactacatcctcagttcaaggggaagggagaagcaaaaaaaagggggggggattgttctggaggtagtgactcggttttcctcagccatccaatgagatgatactagtttcatttcccaaatagacactgaatcattaagagtttaacaagaaagagctaagaccctgtggctcctagttgcactaaaccatcacacccagactgcccagttgcttcccgtgccgtgtcagttgatgaaatatctaaatacgttttaagaaacattagttcatcaaactgttgttttcatctgttacattcatttgtgggagaagagcctgcatgccatgaaccatacatggtagaagtcagcttacaggagttggttgtctccttccactcttaacagtcactggggttgaacccaggccatcaagcttggcagcaagtgcctttacccactgagccatctacctggccccaaaaagaagtgcctcagcagtgaaaggggcttgctactcttatagaggacttaagtttggttcccagcacaaacttgaagaggcttttaactgcctgtgtcggattcagcaccctcctggtttctccatgcacctgagctcacatgtacataccaccccatgacacacattagacataaatgaaaataaaattaaatcttaaaaagtggccgggtgtggtggcgcatgcctttaatcctagcactcgggaggcagaggcaggcggatttctgagttcgaggccagcctagtctacaaagtgagttccaggacagccagagctatacagagaaaccctgtcttgaaaaataaataaataaataaatagtgtagccgggcatggtgacacatgcctttaatcccagcacttgggaggcagaggcaggccaatttctgagttcgaggccagcctgctttacatagagagttccaggacaaggagagatacacagagaaaccctgtcttgtaaaaccaaagggaggggtccggggagactggaatcatgaaaggcaacattttccctctaaattgtgccactaactcatttgggatcctatactctgactcgtgtgtggtgttggtgtgtgtgtgtgtgtgtgtgtgtgaagatttatttatgtattatatgtaagtacactgtagctgtcttcagacacaccagaaaagggcatcagattccattacagatggttgtgagccaccatgtggttgctgggaattgaactcaggtacctctggaagagcagtcagtgctcttaaccattgagccatctctctagcccatctccatactcttcttatggtcaaaggttcctctttttttttttttttttaacctttatttgtacagttgtttttcctgaatatgtctatgaatcactctgtatgtggtgcccaagaagaccaggaaagggcattggatcctctggaactggagtttcagacaatgtgaacctctagatggatgctaggtactgaacccagatcctctggaaaagccataagtgctcttaaccgcagagccatctctccagccctgacatctctggtttaagtactattaacttaaaaaaaagttatttttaccaggcagtggtggcccacacctttaatctcagcacttggggaacagagacaggtggatctttgtgagtttgtggacagcctggtctatagagcaagttccaggacaactagggctacacaatgaaaccagaaatcctgtctgaataaagcaccccacatatacatacatacacctgtatagtgtgtgtgtgtgtgtatctgttgtctatatgtattttttatgtttgtggtgagggtatgtatacataggtcatgccatatgtgtgaaggttgaggacagccttgtggagtgattctccccttccactcttacatgaattccagggttcagacaggttaccaggctcagcaccttactgctaagccatctcaccagtcaaatgactggaacttacagtgtggttacccaatatgatcaaacctctgattgttgctctgggcagccctgcttgttgggaccttttttttttttttttttttttttttttgttctaaatacttttagaattcggctggtcattattcaaggagaaaccttactgacatttccccccacacacacacacacacacacattggaattttactgacttggtgtcagaagaggacataacaatagcataaagcctttctggctatcactttttgatgtctcatttctgttggccttctttcatatctgttaagagtcttgtttggttctggtttctgtgctgggattgagcccagggcattgagcatgtgaaatgaagcatgtattctaacagtgacccacaccccagtcctttagtattgcagtgttatccaggccagcctcaaacttgtgattgttctgctttggctcccgagtaactagaactgtagtcacatatctggctgttattggtgttacagttaaggtcttacacacataccaagatggtgtttatgcaattctgtcctttaatctgcttctcatgcctagggttttacacattacaatctctgttacactcttatccttgatgtcttcagttaaatagatctccaataacacccaatttcagtagttgtatgcctaattctgtttatccttataacttattctgggtttttctatgtgtattttgtgatttttccccttatatgttatgtgcacatgtgttaccagatttgtggtaacagattaatgattcaatttttccaatatgtatttttgtatgtgtgagtgagtgttatatgtacatttgtgtgtgctgctatgcacatgcagaggccagaagaggacagagggtattctgttctataactctgcctcattcctttttagacaaggtctctcactgaacctagagctaggctggcagctaccaagcctctgtctccagccctgccacagcactaggaatacaggtatagtgaccacagaggttttgtatgtgtgtactagggattcaaactctggtccttggccttgagcagcaagcactcttacctactgagtcatcttccccacccctgatgttttacatttgccttggctaaagccattgcctgccccagatcactcaagatttttaatcagaaaagtagtataagtcgagggtccaaacccaagtgtcgcatggttacagacaaagcacagtatctagttcataatgagaacctcagttgagggcccccaaaccaggagctgcaatttcagtaagaacctctacatgtgatgtgttgtccaagtaactttctgctccttgacaacagagtagctgggttccggagcaggtgtccggagagagaatctaggggcagccatgttgctgctttagaaatcctccagtctcatttctgctgcatttcctctgttgaagtgggcccaaatctcatctaggtccttggagagaagtctatgccatctgctgataggcagcatcaggctcctggagattcatgtggtgctagagatactgttggagctatttttagagtagactcactcaaaccaagggaagttgaatgggagtctaagcctgaggactaacatttttcttaatttacctcctaaagaagtgaagtctaagcatcgctgtgtagggtgggctttgtggttgctgtttgtccatctctgaaagtggaggtttttgaaggttttctttgtgtagaggtccctcatttgtagctatggtccaagcctggttgcagaacaatgtgtgcagctgctacttgccctggatctaatccctcgggacttgggctactttgtttccattctgcaaatgttgccctaactttctccctcagtcatatattctcaaatgtgattgcctctgatctcacctggtcagcatttcagcagacatctgactcaccgtatttcctaaaataaagcttactgagttattttaaattcctttttagtcattaacaactcttcacagtgttccttcttagaaacatttaaactcagcctaaaggtgtaatctaaggcacatgtgatggccatagccccagtgcctggtaggtataggtggaaggatggagttcaaggttatcctctgactttgggccaactttggttacataaggccttatcttcgagtggaacagagagagaaaatgacagtttaatgctgttttttctaaccaaatacatttgaaatttctttttattaaaaaaattctcaagtattgattgtattctgttaagaatggaataacttggggatggaaggatggctcgttgagtaagagtgattgctgctctggcagaagacccgggttcaatccccagcacccacatggtggttcacaaccgtaattgcagttccaggggatcatatgctttcatctgacctccatggatatcatgtaagcacatggtgcacatacgtgttaggctaaaaacacacatataaaatgaatacatctaataactttagaagaaaactttttaaagggaatggaataaattagtaatatttaaaaacatgagaatatgatttcaagggctgggaagagggctcaagcataagaacctgagctcagatccctagcagccacatagaccttgggcacttatctatatacccagcactgcccgatgggggagaacaagaaaatcccatccctggagctcattggccggccagcctggcccatggagagctccaggttcagtgagaaaccctgtccccaaaaaataatttttgggctgtggtggatggtactcaggaagcaaagacgggatttctgagttcaaggccagcctgatctaagaccaagttctaggacagccagagctatacagaaaaaccctgtcttgagaaaccaaaagataaaataaagtggaggatgataaaggaagacagttaacatcaacctctggcctcctcctgcatgaacacaggcatgtgcaacacattactgtctaaatacagagactatatcccatggcttctgctggggagacatgaatattgaccccagaccaacacaccaaagaaatgcttctttccaagtctaggtgatgagccagtgaccttacaaaaggtccttttaggagcataggtgactccaagacagacacatcaccagaaagccccaacccagaaatgctgactatttccggccttctccctcctagatgctgggggctggagaggggcagcatgaccacaagaccacatgcagccagagataggaaggagtggctgagtctcaagtgacagtctcaagtcactccctgccttctgcagggcctgttagaagggccatttcctttacctcagacctagttatcgctattctgcttgttttgttgccatgactagatctaggtcactaccttagtctgctccatgatggcctacagagaggcatgtcagccccaagaggaagtggctgcatcacaacatgatatggttactatgtgatcacagcaaccaggagtacagagcttcccagtgactaacagaaggaaatgccctgccgtcttcccttcataagctcttatgctgacgggttaactgcaagtttattagaattaaagatttcctatgtgtatgaatatgttttcctgcacacaagtgttccacatgcatgcctgatgcctgaagaggtcagaagagggcatcaaatcccctggaactagttacaggcagttatgaggcaccataagggtgctggaaactagatccaagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggggaggaagaggaagaggaagaggaagaggaagaggaagaggaagggaaaagggaaggaaaagaaaatgatggtgttagctggacctgatgatacatgcctagagttctagctacttggagggctgaaaaaagagagattacttgaagccaggagttcagggccagtctgggcaacataagtaatacctgtctcagaaagaaatattgggctggtaaaatggtccagcaggtaaacaccagtaaccaagcctgacacctgagtttagatcgccaagatctaaatggtggaaggaaataaccagctcccaaaagttttcttcaatactctgaatgcatgctgcgacatgcattcgtgcatgcatgacatgtgcgcgcacacatacacacacaaatataagtttttaaagagaatattgctgtcttgctggttatttacttactcggagtgtttgttgttttgttttgctttggttttgctactgagctacatccccagctgagttagacctgggaaaggtgattttcttttgtgtcggtgcggtaggtgtgtgcttgtttgtttttgtgttgctacaaggtctcatctaaccggggctagcctcaaactcactgtgtagctgaagataaccctaagcttcttatccttctgtctttacctcccaagtcctgggtattaaccccagggagtcatgcttgctagctaagaactctaaccaactgtgccagacttgtaagtgtaaaaccggaaggtttgattaaacgatggaaagctataaaagaaatggtagttgaagaggagatcatttcagagatcaaagtgagattctacagtgacaaacattacctgtgaaccttaaagattcaggggtaggaaaacaaaatgctagcatcattcccgtgtcagaagtgtagaatggatgtggccaactacaggtcaggcaccttgaacttaggactggaaacactttataccttcacctcagtgagcagacactgttctcattcaagctccgtgttccatctaggacacatatgcctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatgtatgtgtgtatgtatgtatgtgtatggatatatgtgtgtgtatggatgtatgtatatgtatgggcctgtgcatgccatatggactcagttctctccttccaccctaagtcttggtgactaaactcagtatcatctggctggtcattgaatccttttatctgctgagctgtatcacatgacccctggaaagagttttatagagtgaaactctggtttttgtttttaaggtttctttcatttgtgtcataaatatctataagatttactactttgaactttgtttgtttgtttatttgtttgtttttcaagacagggtttttctgtatagccctggttgtcctggaactcactctgtagaccaggctggcctcgaactcagaaatccacctgcctctgcctcccgagtgctcggattaaaggcatgcgccaccatgcctggcttattttgaacattcttaaggtaccttctcaagattatgtaaccatcactcagatttcatcactccagagagaaaccctgtaacccattaagcaataaccccccatcccttccttcctctagctctgtgactaagattctactttgtttccgtggctttgcttgtttaggtgcctcatataaatagaaccatgcggtcagtgttattttatatatggcttttattaccttaatatttttaagctcatcaatattgacagtagaatgtttcagaactttgttttgttagaatcagtatctcactatctatagcagactggcctcaaactcttacatgacccaggatggcctcacattcacaatcctcctgtcttagctcccagagtaccaggattatggcctatgccaccatacccatctactttcttcccattttgtgggcaaggcaggagtgatggtactggagattgaacccagggccttacatatgctaggcaagccctctaccactgagccatatcccagccccacttggtttgtttttgtagctgagtaatgtttttgttctgtgtatgtgtcattgttttccttggtcctctgttgatgctgcagttggctttaatctaccctgactgctgtgaccaaggactcgataaatttaagacatagaagtacctattggcataccagtgtctaattcttctaaggatgttcttgtgaaggtaactgttgagtcacattgtgatagtgtttaaatttctgagtaggctaggcatggtggtacatgactttaatcccagcagaggcaggtggacctagcctggtcttcatagcaagttctaggccagccagggctacatagtgagaccctgtctcaaaaacccagtaagtaagtaagtaaataaataaataaataaataaacagataaataaatttgatagttggcacataacagctgtaccattctgtgttcccaccaacaaagtgctgtggtccccacttgttcaacatcctcatcaacgctcacagctttacattttggaattccacccatcctagttggtatgaagcaatattctattttgggcttgatttgcattttcctaataactagtgctggacggctgagaatgagtagtcatctttgctgcattcaatatgttggtcacgtcactatttcctgttaatcctccaatagtatatgtggaagtctttattgaattgttattgtcttaagtagtcagtgtaactccattattccaggacagtgcgtcgacagaactgtatcccctcattttgtagggatagaaatttggacctttttcatctaaatacattttaaaattaattgatcataataagtttcaggccagccaaacaaaaataaaaggcagaaagagcaaaccctgcttaattgagtgctttaatgtatgttaagtaaccttccaggaaactgtgtgaattagtcattatccccacactacaagtcaaagagctttggtcaagaaagttaaacacaaaccatacatgcaactactgccaggaaattataattaagaagtacatgaagtaggtaatgctcaaaatgagtgcattttacatgacaccaaaacttcattgtattattatttgtaaggctacagaagagaattattcataggggctgtggtaaatatattgggaaagtaaagactatctataaactttcttctgatattgatggggattaaacttttaaaaagagggtgtgccaggtgtagtggaacaagcctttaatcccagcactcagaagtcagaagaaagaggatctctatcagcttggtctacatagttctaggacagccagagctatataatagagaccctgactcagacagatggacagaaagacagacagacagttagttttctgtcttaggggtaaggattaacattacaataccatgactaaaagcaccttggagaggaaagggtttatgtcactcacagttctgtataacagttcatcatcaaaagcagtgaggacaggagctcaagcagggcaggaacgtggaggcaggagctgatgcagaggccagagaagggtactacatactggcttgcacaccctgacctgctcagtgtgctttcttatagacccaggaccgccaaccccgtggtggtaccacccacaatggactgggtcctcccccatcaatcactaatttaaaaaataccctacaggcttgcctacaagccagtcttaaggaggcattttcttaattgtgtttccctcctcttaaataactttaacttgtgtcactttaacagaaaactagccagtatattttcataaacagtgcctacacattttcctgtgatacctaagagtggcaccctatcctttaaattagtttaagatatctggagacttttatttatctataaaggtgaagctgagagtcaacctggtgcctcatacatattaagtacatcacagatagatagatagatagatagatagatagatagatagatagatagatagatagatagataggtagataggtagataggtaggtaggtaggtagatagatttatgtagtaatgcatacatgaatagatgcataggcattgtaaatggtggtgctaaaatgtatggtcatctgctaataggaatagcttaacattaaatgtctgttttcttcagcttcttatcctaatcatgggtcctttcagacgctctaaatcccccaggaaacaacgtaggatatgaatgagaagacaggcctctctgttaaatagcccttctatctgtctcctcaggaaactactacaatcaaggtgagattcgaaagaaagagcttctgcaaagctgtgctgtgttggggattccaccttcccgtgtaatgattattgacaagaggtaatttgtcctttaataatgtagaagctcattggtaataaatatacattgatacattgaaaagacacaaaacctaatgtcaggataaaccgatcttacatcagaaaaagtcttttacttttgttgttggttggttggtttttcaacctttaacctgtgtgactcaggatggttttggacttctgactgcctcctaccccggcaagagctggggttgtaggtgtgcgctgtatttggatgaagcccaggacttcgcacatgctgtaggtactaactagcccggctgcatctccagcctctaaggaccttcttgtaagcttcctttcacaggcctggaagcagcactttctccacagcttggcttttcttggcagggaacatttacagagactcatacctgtgtggctgtagtattcatgtttacagtgccattatttctcattgttatctgaccttggcaatggaaaaggctaggacaactattttattttctaatatagttaagaagtttattttttaaaaaaaaatgaatgagattttgttatttacattcaagacatgagatattgaaaatgaaggctaagccaggcagtgttacacacagccttagccccaacatttgaaaggcagaagcagacaggtctctgaatttgaggcaaaattgtctacctagcagttccaggactacataaagagatgctctctgtatgtgtgtatatatgtgtgtgtgtgcgcgtgcgtgtgtgtgtgtgtgtgtgtgtgtgtgccaaactgacctccaacttttttttttcttcgagacagtgtttctctgtgtagctctggctgtcctggaactcactctgtagaccaggctgaccttgaactcagaaatccgcctgcctctgcctcccaaatgctgggattaaaggcatgcgtcaccactgcccagcttggcctccaactttgagattgatctttctgtctcctgaatcctggaattaaaggcatgcacagctcaaagtggcatataataacaatgagtacctcctggaaagtatacaagtgttcagttcatataaaaatgtgtgtgaggaagtctaaggagataggctgaataataaatagtgcttgctgcgcaagtacaaggctcatgatgtagaccctcaacataataaaagtgtgtaacaaactagtcacacctatctagagtaagatgaaagatagagacatgagaatccccaagagtggcgggccaggtagagaccctgtcttaagatggtaagtgaagccgggcatggtggcacatgcctttaatcccagcacttgggaggcagaggcaggcagatttcagagttcgaggccatcctggtccacaatgtgagttccaggacagccaggttctatacagagaaaccctgtctcagaaaaaaaagaagaaaaaaaaaaacttgcactgtgcttagggtttatttatttacttttgaagtaagttcttactatgtagccctgactgtcttagaacttgacccatagaccagcctggccttgaaatcacagagatgtgcggggtaatagactacgaatgaatgcttgatctactaagagttatgatttatttctcatgcttatgcttagagtttgtgtggctgtgtgttctcatgtgttgagacacacatatatatgagcatgtttatacacacacacacacatacacacaaacacacacacataaaggcccgagattgacatcatgtgctagaattatgacagaccaccaaacccagctggcatatgtgtgagttctggagatctgaactctggtccccactcttatgtggcaagcacggtatccactgatctgtttccccaaccccacagtagccttttgtgttcatatttctattgaccctcctttcaatataagctaagctttttctagctctcctactttgctttctattgctgtgattaaaaaataataataaataaaataataataatttattattaaataataataaataaataaataaataaataacacaaccaaagcaatttagggagaaaaaggttcaaatcaggtgtacttacccaggggtggtaccatcccggttattggactctcccatgtcaattattaagaaactgccccttggtatgcacacaggcctctctgatgggggcatttcctcaattgaagttccctcttcccagatcaccctagcttgcatcaagttgacaaggaaaaaaaaaaaaaaaacctgtcacactagcaaagaccatccacctgctacacttttccaaagccatgtccacattttcagttattatttattctgcctgggttgccataacaaaataccagagacaggcagccttaacagaaatatatattctcccagttcgtactggaagtaggaaggctagtttctggtaaaggtcctttcctttgcagatggccgccttcacaccatgccttcacatggaggcaagcaagtgggatctccaattccataaaattagaccctcaccctagtacgctcatttaatcttatttacctcctaagaattactctgggggatagtgccttgacttactatgaactgagggaaagcacaagttagtcatagaagtatgtgagcccctagcatccgtctctcatttcctcagaccctttagatgtgtcacagagaaaacttaaggggaaaggaagaaggaagctttatagaggatctgtaacctgtgatgataataagccaatataaaacccttatatcagtgacagaaacatacgcgtaatacatgatcttgcttaattctgaaggtgatccaattgttttccatcttactgataaaattttgagcctggtgaggctgagtcatttgctcaaggtcactcagctacaaggctggagacctggcaactgcactgagaccatcgggctgcagagcataagcttcaagcagcgagtctcctggctactcagtactttcaaagtatgaagtccatacctgatttcaaaggccacagcacctcatttgtaggctcactccacaggacagcctttatgatcttcctctgttttgttgcacataaagaaacaagagctcagagaaatgaagagtctgaagtcacacatttacaaaatatcagtgctaggtaagactcaaagtcagaaagggagatgaaatagatcctgactttctagagagaagtaagtcacagctttgttagtgtgtttgaaagaccatcatagatgtaaagtgctttgtgcacggtcagctgtttgttcttgctgctctgagccccagtgcttggtttcagggatacatttagccagctgagcacacacccaaataaacccttgatgggaaaaaatggctttcaaggaaagaatatgttggctaggttttggaactgtttttgtttgtttgttcgtttgtttaaatttttaattattacacatatatataagcttcaaccagtgagtctcctggctactcagtactttcaaagtatggagtccatactcgggactacacactgtagctgtcttcagacacaccagaagagggcattagatctcattacagatggttatgagccaccaagtggtttctgggaattgaactcaggacctctagaagagcagtcagtgcttttaaccactgagccatctctccagcactgtttgtttgtttttttaagacagtgtttctctttgtagccctgactgtcctggaattcactctgtagatcatgctggccttgaactcagatccatctacctcttctacatacaaattcgagccatctggaaagagggaccacagttgaggaattgcctccatcagattggcctgtggagctatgtgtagggcattttcttaattcaggattgatgtaggagggccacacatgctgtgggccatgccagggcaggtagtcctgggtactatggcaaggcaggctgagcaagccatggagagcaagcccataagtagcacttccatggactctgctttaggtccttcaggttgctactttgcatttctggctttcttcagtgatggactgtgacctgtaagccaaatgaaacatttcctcttgtagcatgcttttgctcatgcttgagcatagcaacagatacataaactaggacagaaggcatagtttcagccattagagaagtaaatgattacttacagggctcctttaaaggtaaattttgctaatttggtgcgtcatataataatgcattaaataatccattgaagtgcatgtttcaagatgggccacacctgtcatttcagcacttaagagacagagactagaggaatttaagttcaaggccagtttatgctatggtgggagactagcctgggctgcataaggagactctgtcaaaacagaaagagagtcaggcctggtagtatataccattcccacccctcacagaggtaggcagctctctgtgaatttgaggccaactgggtctacttagggggtttgaggacagaactagatagtaaggctttgtctcaaaaaaacaaaaaacaaaacgacaatgaccaaaacaaacacagaaaagctgggtgggggtgcacacctttggttccagcacttaggatttggaggcagaggtaaaaggatctcttgagttcaaggccagatggtctacagagtgagttccaggacagccagggctacacagagacctgacttgaaaacaacaacaacaacaaaaacaaaccaaaaaaaaaaaaaaaaaaggttaaaagtacaggaaaaaaaaaccagttccctaaatgttattaaaggtccagaataattaaagcactgcacaacattttggggaaaaaaacaatttaaagtctagaatatgaaaataggcgtggatgacatcaccatggacacattggtcgctttcactgagcttgtgagtcagcagagccctagagcctcagcattttcctcaatcaaaatgtgaatccttaacttatctttaacctgtctttaaccttgtagaaaatgctaaaggagtgtcctgtgcttggtgcctgtttcctgcctgtaggcttgttttgtttgtggggttggggatggaactcagggcctcatgcaatctgggcaagtgctctgccagagttatatcctcagcatctacttattttcccattccgtcgattagcctacataattctaagggttcagcacattaaatcatcttcctctctcccggtgcggtgcttatcttaacagcagcgaggcattagaaagcctgcggctttaattatttagctgagcgaggaaatagaatcgactgtccacaaaggagcatacattaggctagcttgctagcacttcctggaattcttctccaataaagccatatagatcatatagtgacagagaatccaggaggcagagcatagaaccattggactgtttgttatacacttcaacccctgcttctcctgtcccagaaccttcctccttagtaggaaaccaaaagagagtggacttgaggccaaagtggttcggacctagcatcccctcttacatgtgcgggattaaaataaaacctgaagtcctttcctccaaattctcagagggcttgggctgaggttcaaagacacggtttcagcagcgctggcaagcctgggctgccggctgccaagaggaagcaaaggacaagaatgtttcctagaaaagaacccagcaaaggagaccacagtgggccttctgatagagagccaccatgggcacacaagctgctgtcctgtttctttaaactcagattcttctgagaactaaggagaggctgggcttccacataacgtgattagaggagtcagtgcaaaagaagtgaggtgggtccaggaagcgggtcttgtgctgccctttagtctgctgcgttagttactttcccccatcagaggcaacctgaggaaggaaggggttggtttgtatgtttggggtttttacttacatccccaaggggatgcagtcgattaggtctgggaaggcagtaggaaccgggagtagctgggtgctttcgtctgcagccagggagcacagggtggtaaatgcttatgctcagcttgccctagccccttctcagactgggattctaacccatggaatggtgccacccaaatttaggagagttctttttaactcagttaagctaatctagatactgtctcacagacacaggcagggatgtgtatccatagtgattctaaatcccatcaaattgatcactgtggaactggcacgatagctcagtgagtaaaagcacttgatgccaagtataaggaccaaagttcatgtcccagaacccacgtggcaggaagaagaactctggcaagttgtcctgtgacctccacacacgaacaacatataaacaaataaatgtgtgtggggtgtcgtggttaagatgaactataacatgtttataactgtacttaattttgctgggcagtggtggcgcatgcctttaatcccagcagttgggaggcagaggcaggcagatttctgagttcaaggccagcctggtctacagagtgagttccaggacagccagggttacatagagaaaccctgtctcgaaaaaacaaaaaacaaaacaaaaaaacaaaaaaaatgaagaaaggaagaaagaaagaaagaaagaaagaaagaaagaaagaaagaaagaaagaaagaaagaaagaaagaaagagagaaagaaaagaagagaaaagaggggaaaaaaggaattgtacttaattttaaagtacatgcagttttacgtgagaggacacatgccaagacgcaagtggatgccagaggccttttgggagttggttctctcctttggctgtatgggtctctcgggttaaacgcaggtcatcaggcttggcaataaatgcttttacccactgatccatccggctggcctttggtttgtttttttctgagacagactctctctgtaggcctcgccgctgacatagaacttgctataagacctgtcttttcagtgtctccttacccttccttgcaggtttatgtcaccaaacctggagtgatgctagagactggaggtttagagaaagttttcaaatattataaaagtaagatttgaagtggtattgtatattatggcactcatcaaagcaactagtaaaatagcaaatagttgccaaatgtctctcagtaggccattaatgaatctctgtggtggtttgaatgagaatgactcccacaggcaaacaaatttaaatgttagtcaccagcgagtggcactatttgaaaagattaggattagatggtgtgaccttgatggaggaagtgtatctctctctctctctctctctctctctctctctctctggcagtctgatctctgtatctgtctgtctctctctgtctctgtctctctgcctctctgagtttggaccaggatgtagctctcagctactgccccagcaccatgcatgcaaccatgttccctgacatgatgataatggacgaagcagctgacattctgagcaagcccctaggaaacattttctttcctaagagttgctgcggacatggtgactcttcacagcaatagaacaatgaccgagacaaccgtactccagagattactatgcatttttaataaccatggaagttgttcgaggtttaaggtaatattaagttttcagagacatactttcttttttacagctttctatatttttcataggtttaataatttacactcaatataagaaaattggccgggcggtggtggcacacgcctttaatcccagcactcgggagacagaggcaggtggatttctgagttcgaggccagcctggtctactgactgagttccaggacagccagggctacacagagaaaccctgtcttgaaaaaaaacaaaataaataaataaataaaataaaaaataaaaaggaagtctgggatgagcttagatctggaacacttgcttaactcatgaagctctgggtttaatcccagttagtggtcctcactaccaatgtccaccaaccacaaagagtgaggtacatgcctaaaatcccagcactacaccagaagctgaagaggaaggatctcaagttcaagaccagcctaagctatttagttatggtttctatttctgtgattaaacactgtcaccaatagcaacttgatgaggaaagggcttgctgcaggaatctagaagtaggaactgaagcaaacagcttacctgcctgccttctttccttctttccttccttccttccttccttctttcctttttttttttttttttttttttttttttttttttttttttttttttgtgacagagtttcattgtgtagccctggctgtcctggaactccctgtgtagaccaggctttccccaaactcagagatccacctgcttctgcttccccaagagctgggattaaaggtgtgcatcaccacccacccaagtcagcattgcttccttatatgagttagaaccacttgccccaagccagcaggacccacaatgggctggaccctcccacatcaatcaataatcaataaaatgcccaacagactttcctataggtcagtcttattgaggcattttctcaattaagagtctctctcccggggctgatgagatgtctcagtgggtaagagcactgactgcttttccaaaggtcctgagttcaaatcccaacaatcacgtggtggctcacaaccatccgtagtgagatatgacaccctcttctggtctgtctgaagacagctacagtgtacttacatatttaaaaaaaaaaaaagagtagttatgggctggtgagatggttcagtgggtaagagcaccaactgcttttgccaaaggtactgagttcaaatcccagcaaccacatggtggttcacaaccactcataatgagatctgataccctcttcgggtgcgtttgaagacagctacagtgaacttataataataaataaatctttgggccggagcaagtgggttggccagagcaagcagaggtcctaaattcaattcccaacaatcacatgaaggctcacaaccatctgtacaactacagtgtgtactcatatacataaaataaataaatcttaaaaaaaaaaaagagtagttaagagtctctctcccaccaggcagtggtggcgcaagcctttaatcccagcactcaggaggcagaggcaggcggatttctgagtttgaggacagccagggctacacagagaaaccctgtctcgaaaaaacaaaacaaaacaaaaaaagtttctctcggcaaaagattctagcttatgtcacagtaacaaaaaagtaaccaggagagtaaatagtgagctcattgaaaagtcttcctcaaaagaagagaagaggctagagacggctcagcagttgagggcttgccgctcttgcagaggccctggattaagggcacacacagcagtttacagctgtctgtaactccaggtcccggggaccctatggtcttgtctagctaaggagagcattagacacacatctggtgcacttagatacaataaaactaaatttttaagtgttaaaaatagtgataaattattgccgggcgtggtggcgcacacctttaatcccagcactcgggaggcagaggcaggcggatctctgagttcgaggccaacctggtctacaaagtgagttccaggacagccagggctatacagagaaaccctgtctcggaaaaaaaaaaaatagtgatagattatttaggtttgttttggttgttgttgttgtttttttaatccaaaattcagaagcaaaatgagggctaagatgggaactggctcagtgtgggttcctgcaagcttcagggctggaaggaaaacaatctaggtgaggtaggaaggaagcttgcttcagcctgacttagcaggtgcccggccacacttttgaagtctgacactgggtgttttattttagccatatttaagcacagcacaattttgaaggaaaaaaaaaagctttctgatgacagttaaatcagtcccttgtgtacaacaaagctcaaaacatgtttgcattggaacctttgacaaagtacatatgatttcttccataaagatgaggactgttgactcagaaacaatactcaaaatacaggtctagggcctttgttttgttttgttttgtttttaaagatttgtttatttgtttgtttgtttatttaatgtatgtgagcaccctgtagctgtgcagatggttgtcagccttcatgtggttgttgggagttgcttgctctggtcagccccactcgctcagtccctgctcactccagcccaaagatttagttattgttatacataagcacactgtagctgacttcagacacaccagaagagagcatcagatctcattacagttggttgtggttgctgggaattgaactcaggaccttcggaagagcagtcagtgtgcttaacctctgagccatctccccaagccccaggcctagcgttaatgactgaggtgaacatatgcctataggagtcagggttggcgtggccctaagatacatacataaacgttgcttagcctgttataagtgcaagtgacatctcgcataaggctgggtaatatggactgagaagcaatgcttaagatttaggtggggcagaatctagaataaacaagtaatattctgggggatacagctgaagcctggccctacaatggcaaagggtcaccaggttgtaaactacatccttccccagtgttctgggaggaaggtaggcaaacctcttctttctttgaagagagaagcctgcatccacatgtttaactttcctggcttctccagtgcttctctgtgtgcacaaggaccacttactctgtagtgctcagtgcctaacagcatttgctgtgcaagcaggaagacctgaattggaattcccagcacataaaacaaaaaccatgtgcccataacccctggttctgagacaaagggtgaggacagatcatgtgcttgctggttcccagcccagccgacacatgctgagctctaggatcagtgagagaccttgtctcagggaaatagaagacattggatagcctcttttggcctctgcatatgcaaggcaaataaacctgcatacagacatgtacacacacatacacaacacacacagagagagaaataagtccagaataagtaaaatgaaatgccttgggagtgcagtttgtgagctgttgttattggtgctattttgacctgtgtttcagattagcaaattaacctattttctgcacatacctgaacaatttcctagtgaccttctataagtccccacaacaggctaacttaaaaacaaacaaacaaacaaaacagattttgtcaggctggagagatggctcaatggttaagagcactgactccccttctgaaggttctgagttcaaatcccagtaaccacatggtggctcacaaccatctgttctgacaccctcttctggtgtgtctaaagacagctacagtgtacttacatataacaataaataaatcttaaaaaaaaaaaaaaaaaagatgtctgcccaggaggcagaggccggggatctctgtgagttctaggccagcctggtctacagagagagttccagggcagccagggctacacagaaaaaccctatctcagaaaaaaaaaaaaaagaaagaaagaaagaaagaaaaacaaacaaaaaaagattttgtcagggggttggagagatggctccacggttaagagcactggcttttcttccagagtacccaggcaggttgaattcccagtacccacataaaagctcacaactgtcagtaactccagttcaaggacacagttcacacagacatgcatacaggcaaaacaccaatgcacatgaaaataaatcttaaaagaatatatatttggtgagtcatggtagctcagcctttagtcccatcaatgcaggtaaatctcggtctataccttgagctccagaagagccaaggctacataatgagtcactattttttaaaaaacattattttaattatgtgtttgtatgtgagagaatacttgtgaatacaagtgcagtattcacagaggtcagagaaggtgtcaggtctcctagagctggagttacaggtggttgtgagctcctgtcatcagtgttggaaccaaacctgggtcctctgcaagaacagtaatctctcttaactgtggagcactttctgcagggtcctctgcaagaacagtaatctctcttaactgtggagcactttctgcagtctccttccctttttccttcttcccttcctatctcccttctcccttgttcctcctccccccttctcctctctgtctctattttctgtgttggtactaggattaaacccaggaccctgtgcatgctaaggtctgccagtgactctaaaatccacaaccctttattcctcttttaaataactgttaaaattaattttaagtttggaggtgcaatatcaagcatgcttgccaatctgtctcaaggttctgtgggttcagtcttcacctgcacatacatacacacacatacagtaaataaatatgtaaataaataaaaattagatgtagctatcccagaggattttatcatctccagaaactatattaaaaattaagttggggccaggttttttgttttttgttttttgtttttttttttcgagacagggtttctctgtagtcttggctgtcctggaactcactctgtagaccaggctggcctcgaactcagaaatacgcctgtctctgcctcccaagtgctaggattaaaggcgtgcgccaccactgcccagctggggccaggtttttacctttaatcccagcacttgtgagtcagaggtaggaagagctctgtgagttcaagaccatcctggtttcagagtgagttccaggatagccagggttacacagagaaaccttgtctcaaagaaacaacaacaacaacaacaacaagatagatagatagatagatagataaatagatagatagatagatggatggatggatggatggatggatggacggacggacggacggacggacggacggacggacagacagacagacaacagacagacagacagatgtatggatagatggacagatggacttgggggctggcaaggtggctcaacaggtaaagctgacaacctgagtttgatcccgagacccatgtggtagaggaagagaactgacttctgtaagttgtcctctgacctccacacactgaagcatgcatgcacttgtacatgcacacactcacaaataaataaaattagttatttaagttaatttacttatgtgtgtagccatgtggtctgcagaggtcagaagagggcatcagatcacatgagacttgtgaaattcttgtagcagactcctgtgagtactggaaattgaatccgggtcccctagaagagaagcaagtgtttataagggctaagacatctctccatccccaaataaagtaatttttaaaatagacttgggccaggcatagaagcacatgcctgtaattccatcacttgagaggctgaggcaggaggattgctgaaagttcatgacctacttggactatagtgtaagatactatctcaagcaaacaaactaacagacctgcaacttatctctagcaacaggactttagatctggcctcccttggccccatgaggcaagcaggcacacccacactccaatctccagtcctctgttcataaaataaaagttctcttagattatcgctaaggtctttttttttttacaacaaccactttattacttaccagacagaacaattaacctgcaaagaggtatgtgcttcatgaataaaatacaaaatgcccaattacatttgcattttagcttaaacctatttttagtggtaaagattactctaacttttcatgggatataattatcctaaaaagctattggtgatctaactgaaattcacatttttgttttgttttgtttgtaaacaagaccttacactgttatttagatcaagctgttatttagaactgactcacttgtaaccttaagtagctcaaatctatggcaggtccctgtctcagccttcccagtcctgagactgcaagcatgagccatcatcatccatgctttgaactttatttagttttaggagttcattagtctggcctggaactcagagaggttcacttgcctgagtggtggaagaaaggcccacccactggccacccagccaagcctgaaatttgaattttaactggtgcttaggggtacctcatagatgtcaggcagatggcccagtcctgccgcctggctttcccgcctctatcttcttacgtgtgtgtgtgtgtgtgtgtgtgtgtgtgtgtgtgttgtgtctgtgtgtctgtgtgtctgtgtgtgtctgtgtgtgtgtgtgcgcgcgcgcgcgtgctcgagtgtgcccatgccatagcacacttgtggagatcgaaggccaacttgcagaaatcagttctctccactgtggtcagggtcaatagcaagtgcctatatcccttctaagctatcttgctggctcaacctgtcttttatctacttagcttgaaacagattgtgcatatcaaattactgcttactctgttgtttacctattaaacaaattcccagaattcagggaggaaagttactggtgacctattttctagaactggctgccaagactacacctgacacatctgttatttacagcttcatcactgacctttaccacagaattcctgctacttggaatatgccttagtagacattttcatttacctctcaactttcattgttttaagctctttcaacatctgtataaatttttctcatcatttaaacagggtctggcaagatgcctcagcaggtaagggtgtttggtgccaagcctgatgaccagagttcaattcctgggacccacatgataggagagaactgactcccacaagttggcctctgacccctacccacccacccacaaaacaaaaatgataaaattaattaaaataaatgtaattaaaaacaaaaaacaaaacaaagccgggcagtggtggcgcactgcctttaatcccagaacttgggaggcagaggcaggcagatttctgagttccaggccatcctggtctacagtgagttccaggacagccagggctatacagagaaaccctgtctcgaaaaaccaaaaaaagaaaaaagaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttggcccttctgccctactctcctgcacagctggtaattataggcataaaacggagcgtccgggtttatgagatttttttttttttttttttttttggtttttcgagacagggtttctctgtgtagccctggctgtcctggaactcactctgtaggccaggctggccttaaactcagaaatccacctgcctctgcctcccgagtgctgggattaaaggtgtgcaccaccacacccggctagtcccctacagtcttgtcaactaagaacaaccagctctattacctgttgttcttcagactgttttgccacactgtgactagataaatgtagtgcttctaatgcaaaggcgatgcaccagctctccaccttggtggacaggtgacctgccctgagctccctcctccgccctcgacttgtccttggtgtccttttcttccatgttcctaagatctaatttgctgctgactccagtagtcttccttaacgacagctgtcggctctttactgctttccatttgcctggttactacctttgggctagatcattatagttcctaagtattctccacttccccggtttaatcctccagtttgtttcctaaggcatccttggcttggctactcccctattgaaacctgctcataattcctcagtgtacaccatttgtctgtgactggacaggtatctcatacccccggcaaactgaatttcctgttctcaaaacagcttagccccccaccccactccttagcactccttcactttggctgttcacctggaattccagccttctcttgaagggtcttttcctcctgctccagcagagcttcttcctgtatgaggcagggggaggtttttatgtctttgttgtggtgctggtaataaaccctgagcgttgcttgttcttgttcctttttttttttccgagacagggtttctctgtgtagccctggctgtcctggaactcactctgtagatcaggctggccttgcttgttcttactcggctggctgcacatgctgtcctgctgtccctaaactgtgtttgctctgtactccagaagcgtccatcttcctgcactggatctccggagcattttggtcacttccttgcaatcctttctctgagttgtcattatttgaaaactttgctggttcttctgtctgtttatctcccttacttcatctcttaccatgctcagcagctcagtcaagcctataatgaaagcacatttctaaataaagctgtcctgttttggtttttttgttttttttttcccttggtgactccagtgggtagcacccagatcgcctaatgctttccatttaactgttgaggatttggaaggatttggggcccatgtcttctggctttctaccttgtctattttctttactttaaatgcttgtcaaaataaaaaataaaaattggtcaggcagtggtggtacatgcctttctttaatccaagcactcaggaggtagagacaggtggatctctgagttgagaccagcctggtctgcagattgagtttcaagacatccgagctacacagaaaaaccttgcttagggaaaaaaaaaaaatcagaaataaaaattgaagaaactaaaatttgtagtataacatgtcaattcattgcttatgacagaggtgggaggatcagttcaaggccacccttcgttaacaggagagctctaggccactctgtcctaaatgagaacctgtcttaaaaaaaaaaatcagatataccctcttcattgaagtgactgtaattttagtttcattaaaatgaagaatttagctgggcatggtgccacacacatttaatttcagcattcagggggcagaggcagatggatctctgtgggttcaaggccagccttgcctatagatctagttctaggacatccaaagctacacaaagaaaccctgtctagaaagaaaaaggaggaagagggaggaagagaggaggagaggaagaagggaggaggaagaagacccaggatatgggtgacatgtgtgagtgtttgcctagctagcattggtcccaaccccagcagagcgtaaaggagataacacacctgcaccttaacttcagccactgggaagaggggcaggagggttaaagtttgccgtcattctcatctacatagtaagtttaaggccaggctacaggagcccctatttttaactatagccctggctgtcctggaacttactctgtagaccagactagccttgaactcagagatgctccagcttctgcctcctgagtgttgggatcaaaggcgtgcaccaccatcaccttgcaaataaagcagtcagaggttaagctactacccctttcttctccatttgaaacaagatagcacaaccttctcagaagatttttttttctgtttttatatattcctaagtattcttcaactcaggcagacccccaacaaattaggtctggtcactaacaatagaaaagtcaagacaagcagggcgtgttggtgcacgcctttaatcccagcactggggaggcagaggcagggcggatttctgagtttgatgccagcctggtctacaaagtgagttccaggacagtcagggctatactcgaaaaacaaaaaacaaaacaaaacaaaacaaaacaaaacaaagaaaaagaaaaagaaagaaagaaagaaagaaagaaagaaagaaagaaagaaagaaagaaagaaaggaagaaaagtcatgacagaaagaaacttgattttcattatgatcatatcggacagatggaggagacgaataaaaaagcagtctcagactgtggtctggttagtcattggctcgtctgtatcctagttgtgcttggtaagtcctaggaaactgacctagttcacatgcaatgattgttcctgtcggggaagggagggcaacctctgtttccacttcagtctagccttcagctttgaagggagtctgatcaacttagggcaaaccctctttgtatcaaccatccttagatataccctctcccttgcccctatcccagccctaccccaaatctagaatcttgtaactgctgaacatgtgctttcccactgaagtgcatacccagtcccttcaaccccataagttattagagtgcctacttgtgaaaccgggcagaatccaagtaaaggagatagacacagaatgaagacagaaatggacgtcacgcttcaagtctgccttttggatcttgagagctcagagatgaagtgttcttgtgtgcttgcttgcttgctcccttgcttgtttccagacagggtttctctgtgtagccctggctacctggaattggctctgcagaacaggctggcctcgaactcactgtcagtccttgatacttaccaggaatcagatgacaggtttattgtgaggccatgctatcaccgtgttaggtgtccatgtagggtccaggtgagggagttaaacttttccttagtctggtatgtctgataagttctttggcctggttatgatttcaatacaaccatgtgcccctactgtcctcaattcacccctgtttaaaaaataaatgtcagccgggcgtggtggcacacgcctttaatcccagcactcgggannnnnnnnnnnnnnnnnnnncactcgggaggcgaggcaggcagatttctgagtttgaggccagcctggtctccagcctgagttccaggacagccagggcaatacagagaaaccctgtctcgaaaaaccaaaataaaataaaataaaataaaaaaaagtccatcttgtattcaatactaaaacttaacaagtgaggattctttccttgtatcctttaaattgtttgtttctttgttgtttgttttggggtctttttgtttttgttttgttttgttttaatatatgcatgggtgttttgcctgcatgtatgtccgtgtaccacctgtaagcagttcctgtggagggcagaagaggatgtgggatcccttgggactagagttataaagggttttgaaccaccttgtcagtgcttggaatacacctctctggtcctctgaaagagcagccaatattctaaatcactgacccatctctcaggccaaggtggcttcctttcttctcccagagatacttagcagcctgtgctatatgggttcaacctaacagagagtggttggctagtgcacccaggggctgctctcatcccccttccttaaaattgagtctaaagttacttgtaagttggagtctcttaggacaaagcatggccagaaaaaacactgttttatatactgtggaatagcgtagagcagattgcagcctgttctcaacaccacactaaacaacacactggcaaactatgaagtaaaatttcctataagagtgctgcaagctttgttgcaacaatatgaaggatgtctttgagaaggagaagcacagactactgatttctgtacagcactgtgattcacaatgcctcagcaacctctgggtaccttttacaaaatgccaaagaaaaagtggtggcacatgcctttaatcccaggacttgggagacagagacaggtggatctccaagtatgaggccagcctggtctacaggactccacaggagtttgggcatctttcataaagcacacaagggtctccagtctacaagcagcagcagtacttacaggtatgtagaacagacagaaacagggccccagtgttccaggctgaactaactactaattggtacaacccatgtatccagcaggccttttcttcctctgtttttggtttttgttttttgtctttgtttttttgttttttgttttttctagacaggatttctctgtgtagaccaggctggccttgaactcagaaattcacctgcctctgcctcctaagtgctgggattaaaggcgtgggccaccgcgcccagctcttcctctgttttagtgtcttggaagaaggtaagtggtcataaaccctcctgcgtcagcctgtagaagcttcagcatacctgcaaggacaaggccctgtgacctgcggacagtattaaggaaatatttcctacaagtacctacacttgtgatttcctggctcattttgcatcgaaggctaaaagaaaaggccattttatgattccacttgggagagggaagccctgtgcagaaaggggtctgttgggacatttaatcaaggtgctgactgttacgctctcagggcatgttcttccttctcctcgtccttctttccattgttttatttcccctctaggtttgtctcactctagagccatggttctccaccttcctgatgctgagaccctttaatacagttcctcatgtgtggggaccccaaccagaacattattttgttgctatttcaactgtaactttgccactgttatttatcatgcaatgctaagaaacatgtataactagccattagaaatatgcaaattagtcaggtggtggtagcacacactctgatcatagtgctcaggaggcagaggcaggcagattttttgtgagttcaaggctaccctggtctaccgagtgagttctgggacagccaaggcttcatagagaaaccctgtctcaagaaaacaacaacaaagaatcatagatatctgatatgcacaatatctcatcttcaacgccaaaggggatgagacccacaaattgagaaccactgcccttactccacagaagttactgaaccctgctttcaactgttgggtccaaccttttagcttagatccatttcccttgtcttccctggtcctcctgtgctccagcaggaacgctgcaggatggcctcagcatggggagacagcccctgcctccctaaatgagcccttggtgaggacgggccaactgctgggctccaactaagcttccaggccctgggcctgccaaagccgttacactgaaccctactgacctttacccactttagatgacaaaggaagtaattaagtttagaaatgtgcctgaagtgggtggaggaggggcagcagattctgccagcactgtgctaaacaagccacaagaccaaataagggtgtctgaaccacttccatctgtatgagagttcagagtgcagtgtgcaaaagtaggacttggttctcagggagctaagtcgttacctaaccctgctggagctctgctggagctctgcagcagcaccggtcctggtcgcttctgcagaggctgtgtctgagagaagacaaagcaaacctcctcttgctagtggagcccaggggcctcccttctcagacgtactgactggaggagtctcctgcaccacagattctccagagtgtttgcatggcactgctgagggactgtaaaagtaccagtaaggacgagtcactagaatgtgtgaaggtcagagtttgaggatatttcactattagaaaagcaagcgtcacaggctgaggcgagcttgtttactgaacacagcagtcccgggtggagccgggagctgggagcattttcctgtagcactaacactgtttgctaagtccaccctcttcccgctctcaagggcttgtcaaacacaaggcctggccacagtcttcctctgctcccctggatggtggccatcctcctcttcttnnnnnnnnnnnnnnnnnnnnnnnnnnnnnnnnnnnnnnnnnnnnnnnnnnnnnnnnnnnnnnnnnnnnnnnnnnnnnnnccacctccacctccttgtcctcctcagaggcctgcgacactctcagctccaccagctgccggtgcgcttcagcaaccactgccagctagctgctcatgccgccagctcatcatactgcctccttggcttggaatccctgacctcttggctctcctttccctgggaaattccttcatcctgcaagatcccaaacctcagctccactcagccctaagcataaagagtgacctatatccatgtttggctattgccttgggtatgatacagaagtgtgtacttggtccatgttagctaagtgaacactgaatttgttctgagtcttgccctgatgttttggggtcccgggcacccttatctccagatactcactgttgtctgacaagcccatggctcaggctcagtctaccacctgctttctagctcagggcttctatgacatctcagtcctggggcacccaagtaagctcaccttgaagtctgaagagctaacaggctacaacctgccctctgtgtggaggtactgtacatacagctttttagacacccatgggatctaataagccatgtatcaaatcaataaaaccaccctccttcccagcttccctccctctatggctcactatccctccctctgtgccttccacagtccttgtctccaggtgacagtgaggtggcttcagtgtaggctctgctttctgggaagctgagacttggttatctcaaggctccaatctattgggagcttgtcatttggaggccctcccactttattgccttgttgtgaaaattcaatttcttttcatattcctattcctctttcacatgagttattctttatgtgacaagcaaaggtttaggggctgggggctctttctggtgtacacactaacattccacatcttgggtggatcctcactttcaagttcacaaggatagagaaatcgcccccctggtggtgaagctgtagaactgctagtcctttggtaagggaggtgaatgtaggttaggtaattctttttttttttcccctgagacagggtttctctgtgtagccctggctctcctggaactcactttatagaccaggctggcctcgaactcagaaatccgcctgcctctgcctccggagtgctgggattaaaggcatgcacctccgtcgcccggcatagattaggtatttctacttgctctaccggcctttaagcttctccatttccttatcggaattttctagaagtctagggtcagactcacggaagccatttgaactctgcctgtgcccttctccacaagcatcttgcttttattttgcatttcttgcattctttctgagaatcctaaaaatgcattctattttgatattttgcattccttccttgtaattttgcctgttttccttaaatgatcttttctcttttttaacccaggccgatctcaaacttgacttcctggcctcagtctttctgagtctgattcagcttttaaccctctttaagggtttttatgtttttcctggcatatattagtttacatagtaatgggtttcattttgacattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaggttttttgaaatgtatacactgtatctgcctataggtatatgagagagtacgtgtgtacaggtgcctgtgggtgtgtacagtgcctgtggagaacagaagatggcatcagatcccctgcatctagagttacaagtgattgtggacgcctaacataggtgttgggaactaaacttatatcctccaaaagagcagaaaacacattattgacttctgagccatctttctagtccccttaacagactatatatatatatatatatagtgtattagagttttgtctgcaatatatatatatatattgtattagagttttgtctgcatgtatgtctgtgtgaggatataacctgaggctgcagctacagacagttgtgagctgccatgtaagtgttgagaattgaacccaggtcctctgaaagagcagtcagttctcttaacagataaaccacctcttgggccacagccctcagtagtgttttagagattattgggttgtgaggcacattgccactctgcctggctttgcatggtcatacccctacctgcacagccttgacctgacagcaaggcacaaccatctgtaattcctggttccagaggatttcatgctctcgatggcttcctcagggaccaggcacacaagtgcatagacacgcatgaagccaaatacttacacatacaacatcataaaaatgtttgtttgtttgttttccgagacagggtttttctgtatagccctgcctgtcctggaactcactctgtagaccaggctggcctcgaactcagaaatccgcctgcctctgcctcccaagtgctgggattaaaggcgtgtgccaccactacctggcctaaaacatttttaatttaaaaagtattttattcagaggtggtgaagtacacctttaatcccagcaagggaagcagaggccagcctggtggtctacagtgaagttccaggccagtcagagttatatagcgagaccctgtctcaaaataaagcaaatactttgtttttgagggtgagcaagttgactcagcaggtaaagatgtcccccgctgagcctgatgatttgaattcaatccacaggacccacatggtggaaagagggaggcagctcccactgtgtgtctgctgaactccacatgcacactgtggcaagcactcatgcatgcaggaatgcaaacatgtatgcattcacacaaaatcaataaatgaaacataattgtttagaaaaaagaatgtttagtcctcatcttcctttggacacttccttccattggaagttaagccttttttgttcagtttcctttgccggctctttcaggaaacaacccaggattgagctaggcaggaggtgaatgttaaggcgcaaagcatcaccttgcgtttagtaatggaaatttttaggagctcaaagctcaataactttgttgcccatccttggaggcttccagaaatctggacttggatgttaaaaaattacaagggaactgctttagaatatatgcccactggggccggacaggctgatcagtggttaagagcactgtcactcttccagaggacctgggttcgattcccagaagtagagcacttgcctaacagccctcagaaacacgcgcacacgtgcaccccttagttcttagagcaggcatgatgtatgcttactagtgtttccaatcagcttgtaaaatgcacagccctccaccctcaccccatccccattccctgatactctcccccacctttgtcaacagttcccatctactcttcttaacagggttctcttttttttaagatttatttataataataataataataataatgataataatgttcagatgcaccagaagagggcatcagatctcattacagattgctgtgacccatcatgtggttgctgggaccttcggaagagcagtcggttctcttaaccactgagccatctctccagcccttaacagggttcttgtaagaattagtctacatgcatactcctcacttcatctttgacgcagaaattgagtttcgctgattttatcacaaggaaatattgagagccacatacaaagagttgtatgtgttgggtacttgtcataatcttagtacagtaataagcacaggaaacaacctaaataattgattgtgtggaacttttaaaaaattaaattcaaagcttaggaaacggttcattgagtaagaatttcaaaagcacagtatccatgttttgttttgttttgttttgttttaaaaaggcaaacatggtcacacatgcctgtaaccctagcaatgtagacgataaagtcagggtttactggctgccagcctaactctcagtttagcaagaaaccctgtctctaagcaataaagactggtagagaaggattcccagtgtcctctctggtcatcgtgcgtatacatgctccttcatatgtgtgtacccctaacacaatcacacagacacacacaacatcacaaccaagtctaagtaattgctttcatgttgtagatatcagaagccccactatggtagaagccaccatggtgacacctaagactgtgtggctgactctccagagcccttagtgtctgtattcctttttgtcactctgttatatctgtctttcatacctgattagtctctggaccaaaatggcaattataattctaatcagcatgtgtaaactccagtcatcaggaagaaagactgtataaacaaaaccggacacaggtcattcaccaactgtttctttagagtccaaagactgcctccaacacacctgttttgccagcactgttaccaaagcagaactcctactctaccagagaagatagaaaccgggcaaaggttatgccttagacccaggtcttgtactaattagaagtgcactattggcaaaggagaactcatttggtctgaaaggaggggtgtgtgtgtgtgtctgtgtgtgtgtgtttgcttgaatttttcttatattttcttacattgagttggagagaggaagttgggatgacttgcaatctatgcccaatccatgcactttttaactcagatcagtttttttggtagtagtagagtctattcttgagacaaaggcctactctatagcccaggatatcctggaactcactattgtagctaggctggcctcaaattcatgaaaatcctcctgctacagcctcccaagtgctaggattaaagacgggagccaccatgccagtctttggttttgtttcctaggaaagagttttgctgtgtagtcctgtctgtcctggaactcagtgttgaccaggctagcctcaaacttgcagaatatcctcctgcctctggctcctaggtccaagtattccaggcacatgccaacatatccagtttgtcagataggttttattttgttttggtttgttttggtttgttttggtttggtttgttttggtttggtttgttttggtttgttttggtttggtttggttttggtttggtttggtttggtttggtttggtttggtttggtttggtttggtttggtttgagacagggtgtctccatgtatcccaggctggcctcagactcagagatctgcctgttgctgccttgtgagtgcagtattaaaggtgtgtgacaccatgctcagcaagatctgttttataaaaatgctatctttctaagttctcaccaaaaggccagtataacttccttttggtttagccaaataaaagttataattcaaccaactggtatgcattatgcactccttaatgaaagtgccttgcacatgggaggcatgggttcttactgtttgtttacatacattgtccttcaacttgaattataccaagtacacaagaagtagctttatttatatatttttttactttagacagatacaatacaggccatagttgatggagggggacagtgaaggttctttttatttatttatttattttatgtatgagtacactgtagctgtacagatggttgtgagccttcctgtggttgttgggaattgaatttaggacctctgcttactccagtcagccccactccctccagaaaagggcactagatctcattacgggtggttgtgagccaccatgtggttgctgggatttgaactcaggaccttcaggagagcagttggtgctgttacctgctgagccatcttaccagcccagtgaaggttcttatacacaaggatagcctacagtaaagaatttgactttgcccttggcttctgggaaatgtagctgactttggtacagattttgggcaatatggtatcagccacatggaggctgagatcaaccacaggcagtcagtcagtcactactaaaactgaacaccaaagctcctggctaacagtgctcccatgcactgccacatattgaagctgggcggacatgccctgcctccacaggaagcacaatgggatctctgcctgaggcgtctcttcatttgactgactttaatctatacctttgcctaatcatacatggaacaattgtcagtgagtagtttatgtatttccagtgaattgttgatggttcagggaaacttcacaacttgaagtcagtatcagaaatcaagtcagggctcagcaataaaggcacttgttgctaagcctgatcactgaattcaatcccagggacctacgtagtggaggagagatctaattcctgcaagctgtacacacacacacacacacacacacacacacacacacacacacacacacactggtgtacatgtgtgtaccccccagtaagtaaagaaaattatttttaaaaaagttgagcagtacaggggactgtactcactgaagttgaaattacagcctcatgctccttgtagaagacccagtggaggaagtggcactggaggggatgggggccttgtactggatggaacgtgctagtgctagttagacaaaagaagcagaagagaacatggaaaattagtaagttaacaagaggcccagagtggacattccacttggccaaagcaaggtttacagaccttgatggagcaaggctgggttttgtacccatttgttcctctctaagaccagcctctacctgaaggctctctgtctgcccgcgtgcaggagcatctgattgcactgacagagctggggagctgggtagaggttgccaatgaagcaaaggaaacaatggcatgtttttagtgatgggactcctgtcattttcctgttgaaaaaccttgtgactctccttggtccagaattctaggtcaattattggccctcactgtaggaagtttgtgctggcaaccttcctgttgaggagcaaagaaagctgtgtgtgttgtgtgggtttctagtagttttctgtctgtaaacctcatttctttaactgaaatccgagcacatgaagagtagaggactccccaccctgatagaattcctctcaaagctgcacaccaccggctgagtctcaaaaggcaaaaggttattccagcccaggtgatggtggtggtgatggcacatgcctttaattccagcacgcagaaggcagagactggtgaatctctgtgagttcgaggccagtctgatctacagagcaagttccaggacagccagggctacacagagaaaccctgtcttgaaaaacaagcaaataaaaaagaaaaaaaatgaaaagacaaaaaaaaaaaaagaaagaaagaaaaagaaaaagaaaaagaaaaaggtttttcccatcttgaaaaggattctggtgtgcttctctcttgcagggactttccggatgatccagaagtgcagtgggacacggagctcgtggccagcaccctccttcagcacatacatgccaatggcactgacctggtaagggaatgccacttccagtggagaggccgggtctccatcctgtcacagggctagcttctgctacctgcctcatggctgctttctgctcccagctctgctccaagcccactctaaaaggctgtctgctaaacccactgaaggggagccacgcctttcaattcccttccatcttatgtatgatggactgaacaggttctcaactctcaggcttgagaagaacatttttcaaaccctgtcctgccttcccagctttctcctgaaaattcagccccacccccacccaggagcctgcacaggactctcactggcacagaacttctagtaccaagtagctttacagttagggtagcagtcttaccttgaagattaaagttgtaaatgctggggctggagagatggatcaatggttaaaagcactggctgctcttccagaagacctgggttcaattcccagcacccacgtggcagcttataactccagttttgggaatctaacaccttcatgcagacatacatgcaggcaaaacatgagtgcacatgaaataaaaataaagatctagggttagcagattccagaaatgtataggggagtagggggctctgtggatctcacccaaagctttgtgcataagccctggctctgtcaatgagctacattctcaattctgaagctatgatattcaagcctccctttcacttgtttgtttgtgacatggtctcactgtgtagatcaggttagccttgaaactcaaagagatcaactggagtgctggggttaaaggcatgcagcaccatgcccagctcgctcacctccatttcttttttttaaaatgaggataaattcatactcgctttataagggaaatttcagtcaccattagagcagaaatggagattcatttttgctagccatctcagctctcttaggactagcaggttagggttcagccacagtcagttctatcctgtcctgtcctgtcctattcattcatttattattgacaggatctgtagccctggctgtcctggaactttcaatgtggaccagcctggcctgaaacacacagaaatcctcctacctctgcctcaccagtgctaggattaaaggttgcatggccgcacctgactaacagcccattttaaagctgccaaggcttactttccaaacctcaaaataatcaaaatagcaatccctcataggttcatatctaaaatttcactattcaaagtctgttcttttgacatttgttaaaagatagagcatgctggttgagaagcagattgggcttttctaccaatgacacattcattgagcggattgatacattagacctttgaggggggggtgagggtgtgttaaaacagggtttctctgtgtagcccaggatatcctggaactcactctgtagaccagggtggcttcaaactcagagatccgcctgcctctgcctcctgacttctgggattaaaggtgtgtacaaccacttactgctagaccttctatttttatttttattttatttttgtttttttgagacagggtttctctgtatagccctgactatcctggaactcactttgtagaccaggctggcctcgaactcagaaatccgcctgcctctgcctcccaagtgctgggattaaaggtgtgtgccaccacggccggctatgaagaagcttgtctttctaagcttcacactgatgggttgagtggcaggccaaggatctgctggtggttaggaagaaacaaatgtattctttcgccaattctaatgcctggccccagaagacttcctgaccagggcaccggactccaggctcctttctaataatagtttgagaccaataaatggtagggggtcaatgccagaaagcttcagagtttcagggctgagggtctagtccagtgggtatagtactttcttagtatgcacaagtcccagggtttgaatcccagcaatgcaaaaaccaagaaagaaggaaaaagtgcttcttagttttgacaaatgagaacattcatcccagcccagccgtttagcccttcattttgtcatcatgaaactgtctaggaaatggcctggatcggcactaacgcactcctgaagacagagacccggctggctctcacagtagccaggccctgtaaatagaaagaccgagcctggtgcattggtacagggctataagcctgggaggtagaagcatggagaccaggggtttaaggccagtctcagctacacagagagttcaaggccaggctggggtacatgagacatctctaataataataataataaataataataatacaaccacaaaagaaagagagcaagagtaactcttttccctgactatccaatttcagttctaaccccttcctctgtgccactgggatactttgtgtcctcgggaacagcccttctctttccattggcctctaaccaaccgtctttaatcgctttcctgaatccttgttttcttatgtttctttcattcatgggttttctcatgcttatttatttatttgtgcgtttgtggtgtatataggcgcacatgcggcgtgcctgtggaggtcagaggacagctctaaggactcatttctccttcaggtggcttctgagctcatcaggtttgcagcaggcagctttacctccggagccatctctctgccccacactgtgatttctgctattatattcaaactatagagctgggcacagcggcacatatgtaatcccagcacttaggaagtggaagcaaacaggagttcaaagttatcctcagctatgtagtggcttctagactagcctgagctatatggcagaccctaactcaacccatccccaccctgaagtcaaactgtctttttttttttcccctttaaatccatctgtgcagaaattaaatgttaagagtttagacaaagcttatagatgaagatatttttgcaaatggaacgagaggcagcctaagatagacttctgtgagtcaatccaggacattgtacctgtggtgtggcataaggaggggaaccccagcgaatcaggctgtttctacctgaatgattcctatgtagcagtcatggaggaaaatgcaagtgataagaaacaaatatctattgagacaggttctcatgtatcccaggatggcctcagacgcattctcgcaccaccacatcaatgtatatagtgctgaggaacaaaccctggatttcatgtgtgctgggcaagcactctactcatacccaaagcctacaacagaggtgtcctgagccttggagtcatgaaaacttgacattcatctctacagcccacgtaggaaacaaacaaaccaaaaaccaggcatggtgctgtgtgcttctggtcccagtactggggagacaggcgagcaggtccctgggattctctggccagccagactagcctggtcagcaaggtccagatcagcaagtgagagaccctgtctcagaaacaagatgggcagctcctagggaacaacacccacagttctctggtccccacgtgcacatacatgcatgtgcaacaaagatttggaagatgagtttgtgtggatggggtaaattccgctctctcctactgccagagccaggagtgaaccatagaacccaccgctgccacacacagatctaactgctgagaagctgtttcagatcctcagaatcagaaaagtgctgggtagcaagtggtacaagcatttagtctcagcctggtccagaactgccggggacactgagagaaacccctcattaaaaaaccaaccaaacaaacaaacaaaaaacaactaaaccataactgacaaaaacaaaatttgaaaagttgcagagctctgccctttccttccccaaaggaatggtgaaggctgctttgaagctgaggcagcaaagaagccattcagtacctctgaatgagcccttcctcccggtctgccttgcaggtggtgacttttgatgcagaaggagtcagtggtcacagcaaccatattgctttgtacaaagctgtgaggtatgcttctctgagggatgggcgtgggaacggggtgatggatgtgggaaggaagtggtcctccatttgctcaagggtcacagttactcaacactccctgcctgttgtctgtgccagcaaacctaccagtgtccctgtacagccactgctgctctgttgctcacctacctcaccacatcctttatttttaaggtgttttgctttcaagtatgtcagcctggttctcccttcagtgaggtgcctctataaggctcccatgtaggcagacctgacctgacggctccccaaccttgtcttcaattgtatgcaactttgaaagataccagaaattattgctgtcatattgttggtaggaacaggggctccattttgttccaggtccacatagagccttgttttttttgttcttttttttccattttttattaggtatttagctcatttacatttccaatgctataccaaaaagtcccccatacccacccacccccactccccttgttttttttttttaagatttatttatttattatatgtaagtacactgtagctgtcttcagacactccagaagagggcatcagattttgttatggatggttgtgagccaccatgtggttgctggaatttgaactcaggaccttcagaagagcagtcggcactcttaaccactgagccatctcgccagcccctagagccttgttaatttgcactcaggtatgtactacaaacaatccaggagcacctcagcagacagtgggtagggtccttgagtaggacttagctagttccatctctgcttgtgaaagacccacaacgtgaggactccctcacgttctgactcaggagaggcgacaccccaaaatcaccaacgagaaacggtcttgctgcaacctgcaagaggatttttattcaagagcgctctcgggcccacggtcatacaccacgcaggggtagaggaccgtggcgccccgagtagctgagtaagggggtatttaaaggaagaaaccacaactcaaggaggtggggagggcgttgttggaaaataccaaaaataccagttaagagtcacaaggaagtacaaagtcacaagtgtcacaaggaatggtaactgttaactctcaagacagtttctaagagcccctaacagtagcacctttgcatagcgggttcccgcaatggtcagggtgggtcagggtgactttctttgaatgaatactctttgaacgcaggaagtaggtgggtggaggaatgtcgctatctgttttatgattagcataccttggagcactgagtttactattctttcacttgtacttgtggctttttgtcagtttgacacaagctggagtcatttgggaagagggaatgtcaatcaagaaaaagcctccatcaaaatgacctgtaggcaagtctgtgggtcattttcttgtttgatgattgatgtggaagggccctgccaactgtgggtgatgtcctctggacaggtggacgtcagtgtataagagagcaggctgagcaagccaaaagtagcaagccagtgagcggcctctgcttcagttcctacctcgaagttccagtgtaagttcctgccctaacttccctcctgatggactgtgatctgggagttttaagatgatataaaccctctcctcctcccaaagttgtttttggtcttggtctttatcatggcaacagaaagctaactaggacactaatagatttttagagaaaaacaaaaaacatcgagggtagttatctcatctctaatgggcaaaacttgaggccagattattccataatccacagaccaacttctggattaagctgtgtgggaatgaaatgccataatcagaagtgtggagtcctgtagatttagatgttgacttatgcaatagaaacttccgggagtctcgtgtgcttggctgggccatgggcctgcaggccttgctctgaaggtccctcctgtttacacagcagagtgggtgtctcgtgctccctctaatgttcctcctctccatcctccagggccctgcactcaggagggaagctgcctaaaggtaaagaaggcttttgttgtttgggtttctggttttttgcaaatagacaacagtcactactcttgtaaggaacttaccaaggaaatttgcaaatattgtcagccctccatatctattaatttctatgttatctatggacttaacaccatgggagcagaattattcaaggggatgctggagaccaggctccccagttaaaagcacgctcttgcaaaggacctgggctcagttcccaggacccatatcaggcagactacaacaccttataataccagtcccagggcattcagacatccagtgcacgaatgtggtgcacataaactcatgcaggcacacgcacacgcaaaaacatatttaaatatgcaagaagaaaaaaatggcacctatactgagcatgcagattcttctcttcttattagtcctagacaatggaatacagcaactatttccacagcatttcctcacattagagagtataagtaacccggagatgaattcatgtatacaagaggatgcggataggttctgtgtaaacactgcatcattttatgtcaacttggtcatcagtaattgaagtatttgtggcagtcctagaacagtaccgctggggactgaaggacacatattcagggtggccctagactgtgcagtgttgtaaggtgtgcatggcaggttctgggctggcctccctcacaggggtgacatgagatcagaaagtgaaccgcgggagctgagtgctgtctccacagactgagtgaggccttaggagcaccactggccaccattgtccaccacgtgagacaggcaggcctacactgcccacaccactttatcaactaggaagctaagctccagagcagttaagagactttccatgccaaaacattttcagagatggggtgccaaggaccagccttggcttggagaggggttctgagagaaggcctgactgggacctggggaaacaaacgactcaggtcaaagcatgggtctgagctggtggcctatgttctgctcaagacagcttttcagtctgctttctctgtttttccttctctggagatctttagccagttacctctgtgttctgcttgtgcctattctccaagcagttctctgacctaaaaacttctctgcatagctcattcccactgatcttttattttacataccaatctagtcctttactctactcctggcttcctttggattatcctatcaaactgcatccggtgatcccagccctttgttatgggagagcaagcgcattttttttaaagttgcaaaagaattcggagatccgcctgcctctgttacacaaggcaacaaactagttgggtgggaccccacccagaaattaccttttcaaccactgcagagcctggacctaaattccttatcccacgctgaccttgaactcaggaatctatgtaagcacaacaacaacaaaacttagcctgctctaaatctctttatcttcctcctaagtatctgacaagttggctcacagtgcagctgcctcagtccctttagatctatgaagctccttacacaatttatattacatagtcatattttacatagttgagaaattttatattttcaaactcatggttttagagttcttttcataaccttaagggctgtcttgtaggtcccagcatttaccattttgctgagacactagccacacctatgcctccaggactagtgcagtctcggaatcccgtggagtcattatcatttactgctaggccggaacagaggaatgcaaacatatgtacattattatgcaaacaagccttttgcccacagcagcccatgaggctttggaaggccagttggtcctgatccagaggcgggaaccaattcactcccccaccaccaaggccatgccagacccggcaatggggtctaactctgaagcctaggctggcttccaagtgctgtgattacaggtgagagccagctcacccagcacctggtgtcagagcacagctggaatgagtctttagtttcccaatttagaagttcctgtttatcacctttcctcagccctctagcagcccaagtggaagctcttgcacggacactcacagctgtggagcacttctgccacctggcagtcctcccctgtgagagaatgctggtgagagccacaaagcacctggcagctgaagagcatctgccttgcctgccttgagccactaggagagggagggtgctcaggggagcacctggctgagagcagcacagtgatcccatccgccatccctccttgcccagggtgctccgtgctcacgctccagtctgtgaacgcgcttcggaagtacgccttcctcctggatctgccctggactctgctgtcaccccaggatgttctctttgtgctcaccagcaaagaagtggcacaggccaaggtaagatatgaatctcctgatactgtactgtgaccccagcctcatgtcccttggctcttcaaagccctgctacctgcgacagtgcgccacatgctagattattccacctggctgactagcttttcaacgacttgggcttttttttttttttcctgattataaaatgtataaaccgggcgtggtggcgcatgcctttaatcccagcacttgggaggcagagacaggtggatttctgagttcgaggccaacctagtctacaaagtgagtgccaggacagccagggctacacagagaaaccctgtctcaaaaaaccaaaaaaaaaaaaaaaaatacatacaccatcatcagtgaaatgaaaacaagcggctggagagctggctcagtggttaggagcactcgatgctcccatagaagatctggtttcagttcctgtgccacagccatctgtaactccagttccagggggtctgtcaccctcttttggcctccttggttactacatacccatgcactcaagcactgacatacatatacatctaagaaagcgtagagctcccagtggggcagtgagagggagggtctgcaaataacaggcccagagtgagtgccagcatgttctctgattcttccagaaagccatgtcctgccaccgcagccagctcctctggttccgatacctctacgtcctcttctccagatacatgagaatcaactcactgcggttcctctgaagccttggagagtggtcagaccctcagaacaagagggagaagcagagcaagaagtcgtctggccaggctttgggctgatttacctgcctgacccagggaaaccccagcaaagcagcgtctgccaaacagggaccacatgaaggatgggtcaccccaacccagcttcctcttctgaggaaaacctgccaaaaccaagcctacaccaacacaatagtagccaccccactaatttaccaatagtttgcatgataacagagtttgcaccagacatccagcaaagcctagggaagttgtctttaccacaaatgtgtgtaaatgtgccatagaactagttcacaggtgtgatgtttacatggtttccagaccaggctgttttggtcagtcttctgttcctgtagctgaaacaccgctcacagggcatctgcagagctgcggttttcttggatcacagttctgaagcctgtgaagtccaagagcatagcagcctctacatgaccgcggtgaggggcatcccgctgcatctcaaaggcaaaggcagtcagtcagaaagagcccatgagccaaagagttcctttagaacaaagccacgcctacaacaaataaccctgtcacttccaaaaggcctcaccctaaacactggggctctgaagacacatgaattccaggggacacagccaaaccctagcacaggttcatccagacacccctctcccctccccccacagtcttcaggtgcttcaaactattccttgggtttttatttgtgtccccttatgagaactttacagtctagagaagctgtaccttatcatcatggtggttctgctgtgtgtggagatgatcctgtgggtcccccctttaaggagccaataaacaccttggttctctgccttttcacagtaggagctgggcccacacctttatatatatactttttttttttttttaagatttatttgttatatgtaagtacactgtagctatcttcagacactccagaagagggcatcagatctcattacagatggttgtgagccaccatgtggttgctgggatttgaactcaggaccttctgaagagcagtcggcgctcttaaccactgagccatctcgccagcccatatatactttttttaaaaagaaaaagaaagaaatggaaagaaaatacaaacattattctgatagtgaaatattgaaccagtacaaaataaataaaatatgggaagctgggtgtagtagtatatgcctttaatcccagcattcagaagacagagacttgtggatatctctaagtttgtggccagcctggtcaacatagtgagttccaggacatccagagctacataatgagtttctttaaaaagtaaaaaaataacctcaaatagttattctaataggatggatagtgataaaaccacgtttacataaagcagtatacccacatgtaaaaatctacatgataatgaacaaatagtgttcttagcctgctttgtttgggggaagaagtgtatttccatagccacaggtgtaagcaagcagagctttgcccatgcctgtggagcctgtctctgaagagtccttttgtactgtgttcctgcactgagccctctgcaaggccgattcgctgattagcaacgacacagaagttgaaaggctgcatgtccagaaccaagttatattggggtgtccttagacaccttgcaaactgtctgctccccacttctgtatctgacctagcatctttgtgaccgttgggtaaacacttgggaatatagaagcagctgcctagttcccaccaaccaaaggctagggattctttcagatagcatctgaggcgtccagctgagatgccttccttccctgtgatccacctacctgatgttcccactgtgtgtgtgagaagtgcccatgtgtgactgtgtgtgtgagaagtgcccatgtgtgactgtgtgtgtgagaagtgcccatgtgtgactgtgtgtgtgagaagtgcccatgtgtgactgtgtgtgtgagaagtgcccatgtgtgactgtgtgtgtgagaagtgcccatgtgtgactgtgtgtgtgagaagtgcccatgtgtgactgtgtgtgtgagaagtgcccatgtgtgactgtgtgtgtgagaagtgcccatgtgtgactgtgtgtgtgagaagtgcccatgtgtgactgtgtgtgtgagaagtgcccatgtgtgactgtgtgtgtgagaagtgcccatgtgtgactgtgtgtgtgagaagtgcccatgtgtgactgtgtgtgtgagaagtgcccatgtgtgactgtgtgtgtgagaagtgcccatgtgtgactgtgtgtgtgtgagaagtacccatgtgtgactgtgtgtgagaagagcccatgtatgattgtgtgtgtgtgtgagaagagcccctgagtgactatgtgtgtgagaagtgcccacgtgtgagaagaacccatgtatgactgttgtgagagaagtgcccgtgtacgatttaagtagggcttctgctataaaacttcatggaactgtttccacattgggacatggaactggggtgacctgaatgtgtgtcctgggacaccagcacatattgcatcccaggataaactacctcacatctctttgaagtgagaactgttattttgttgacaataccccttgagggttttttttttatgatatatacacagtacaacctatgaaaaatgttttcaaatctgagacattaaaaagacacatagaagaactataatgatttgagaattattttgtgcctgtttgtatttgttttactctatgttcacaaattaagaggtggggatggtagcttggctgggaggatgtgcctaggtttggtctccagcacagtataaatgtgtgtgccagcacttgggcactggaggcaggatgatcagaaatctaaggtcatcttcaactacatagcaagtttaaaaccaacccaggctaaaagagattcattcaaaaataaatactatgtaaacatccaggaagggatattttagtggtatgtttatttgctgattcgcctgatggtgcgatttctcttcatgagctccttctgtgaggtagggctgctcacagtctccattcatgaccccacttcacctgagaaagttttacacatcctcagatatacaggtatataaataagtatagaaatccagcatttactaataataactcataaagaaatcttttaaaataattccttggtatacatagaattttactacttactgaatactgaatcttcaggctgagatggacatgattgcttattttacataatgaattaaattctggctgagtatttgatgctgcaaaatcagctgatttatagtcattagtgacagtgcctattcccatagatacatagtataaagtggcagaagtgtgttgcggaatgtttcagaaattgatggaaattctgccctaattccaagccaaaagtgatttaatgatttctttttttttttttaaagattttatttattatatataagacgcacaggaagagggcatcggatcccattacagatggttgtgagccaccatgtggttgctgggatttgaactcaggacctctggaagagcagtcagtgctcttaacctctgagccatctctccatcccaatttaatgatttcttatgaaagtcaccaaatcaaacagtaatttaaatttttgtttacatttacttatttgtgtgtgtgtgtgtgtgtgtgtgtgtgtgtgtaggtcaggacaaccttcaggagttttgttcttccagcatgtgttgttccagggacaggcacacacctttacctgctgagccacctcactgttacagattcactgtcagatgtaagctaggtgctaatcaagccacattcatttgtagtctcatagctgctcacaactcactgactcttcaaaaagaaatgaatagaatcaaatattatggggcttgaagagatggctcagcagttaggaacacccgctgctctggcagaggacttgggttcagttcttagcacccacatcatggttcacaactgcctataattgccattgctggggatccaatatcctctcctaccctctaggggtatcagtcacatatatggtgcatatacataaatgcaggcaaaacacttatacacagtaaataaaaatctaacattctaacagtacacttcaaagactgatttaatgtgttcatgctgcaggatcagagttgaaacatcaagtattgcttttccataattacaccactatgtttctacaaaagcagaaaacttttttatgtacagttagagagagggagagagagagaatcgcagcctagaatcggagctgaggtgttccagcagcacatggggggctctgtggtatgagggcatgcctagtgcacacatggtgcacatctttgtgttctaaacaaggttgaagtgaagtcgcacagtacagaggttgagcaagacacacgcagctgttagacatttggttcccggctaatttggttagtgtgagttctcattccctgtgtcttcagggaggttttactgctcacaccctccatgaccccacgttcactcacacacaggtcaacagctccaactcgagaggcaggactctggacatcacagcagagaggacaggcatgggcaacgtgatcttgaacatgctcattttgggttctgaaaagctcagaaaataacatcttcttggtgctcagagagcaaaggaaaggaactggagggagagtggctcttgaggcccccaggggcagccacatatgttgtcgagtgaaggtaccctccagtgaaatgtggccctgggtaagcttatgacaattgaatgtttgggactttgtttttaaaacaacacgtgtgcaagatctaggtgagaggagagtggagaagatctaggtgagaggagagtggggaaagacgagaagcagagttcatgctggaggaggtaccttgatatcagtgagaaaggctccagaaggggagaaggccactgaggggaagggacaagaaaagcccatgtccataattggaactcattaaacctcaagcagctttcatttgctaaaaaaaaaataagctaggcagtggtggtgcacacctttaatcctagcacttgggagacagtggcaggcggatctctttgagtttgaggccaagctagtctacagtgtgagttccaggacagtcagggctatacagagaaaccctgtctcaaaaaatcagggttttcagtacttgaaaactactactgctactgctaataataataatactgctaataataataataataataggccagcctggtctacatagcaaagttccaggacagccagggttacattagaaagagcccacttggtggtgcactttcaggatgttgaaacagaaggatttcaaatttaaagccaccctgagctacgtggcaagaccttctctataaaaaccaaaccaaacataagcaaactcacattcacctcattaagcttcctaggtcctcatttaacctgtgagtaacaggggaggccagaacaacacaactctctcaaaaacactctctcctggggtcgtagttaagatctgtagaaaccaagcttaaatccaataaccagactgccttccaatttgcttcattaatgctctgcagttgtcatgatgggagggagataaaagcattctgaaggtctcttctggagcagaggcatgctgagggaagggtgaagtgttaccacgtggagggacaaataacagggttcactgagattgttagggtgggaaagcattgtatccaggggaaacatgaagcctgcagacagctggggatgtagctcaggagtggttgcctaggatgcatggagccctggctctgatgtcagctctgtataaacaggctgagtgctgcaggcctgtaacctcagcactcaagaggtgaaggcgggaggaatcagaagaacttcaaggttgtgctctgcctcattcaggctgggaggctaccctggaagtcaggagaccttggctataaataaacaaatagccttcaaagcagatctcagaggaggagaaggctgaggggatggctcagtagttaagagcactgactgctcttccagaggtcctgagttcaattcccagcaaccacatggtggctcacaaccatctgtaatgggatcccatgccctgttctgaagaaagctacagtgtactcacatacataaattaaaaaaaaaaaaaaaaaaaaagcagaggaagaaaataaaatataaaatactgtaataaatttaatgggagtaaactgccaaaagtagtggtgaatttctccgccataacatagtgtatccataagtgacataaaaattaaaggatggggctggcgagatggctcagtgggtaagagcactgactgttcttccagaggtcctgagttcaaatcccagcaaccacatgatggctcacaacacccccgtaatgagatctgatgccctcttctggtgtgtctgaagacagctacagtgtacttagatataataataaataaatcttttaaaaaaaaaggttaaaaacatttaaaaaaaaacaaaaggatgaaccacctatcttgttctaggaaaaataaaagcattaagctaaacatgcatattttcataacaggctcatgccatgagaagatgtgtacatacatcacagaatccagatcatgaaacaaaacctagaaataaaaatcttcataaaacaaacaaacaaaaaaccccacaagagtaaggcagcactgggaagaggagtggaagaggcagacagagcttgtgagttcaagacagagaccctgtctcaaaaagcaaaaaataaaataaaataaaacaaagcaaacaaaaataccatcatagctgggagctctaatctcatccagagcctgacaaatcagccaagttccaacacaacacttggaaataccagccttgagctagagtgttggctcccaggctaagggcccactgctcctgcagaggacccgagtgtggctccaagcaccaggccggacagctcacaaccaactgctccaaagggacccaaacctgcattcatatacataaacctatacccacacccagacacaaacacacacacacacacacacacacacacacacacacacacgcttaaacaaggttttaaaggttttaagattttttttcttaattttatttatgtgtgtgaatatgttgttgctgtcttcagatgaaagatcctggcagaatgtaaaaggacacagaagccctgaaattggcaagatagacatcagtgttagcagaactagcttcactgatttagaaaaatagaggtgcacaatgctctggccactccttgaacctgtgtgtctgccaatgttctgaacaggtgtgtgcccattgctgcaccttcattagactctttccttgtacccctcccatacccatttcttgagaatagacattggttagatctggaaatcccctaatctcccccttctcctttcccccctgagggcctataaaaactgggaactctttcccctcgaggtcgactcctctacccctgcatgggatatgagtcgtccccagagctctggctttccccgaataaagcctcatgtggtttgcaacaagctcggtctgtcgtgagttcttgggtgtccgctattgtcctgaggcctgagagaggggctcctcttggagtctttcacagacacaccagaagagggcatcaaattccattacagatggttgcgaaccatcatgtggttgctgggaattgaactcaggacctcttggaagagcagtgagtgctcttaactgctgagccatctctccagcctggttttatgatcgtttaaccaagaacattaacatccacttaaatgacagaatacttatttgcaaacatcaattacccattggccactgagaaatccttaataaatgcccccaacaaaagatttatctgttcagtgtgtgaccataactaaagagcatcagactaggtgcggtgccacagccctataatcccagcacagacagcctgaggtaggagggatgcaagttcaaagccagcctagcatgtatataacaagacctgtctcagaaaacaacagcagcagcagcaacaaccatccaaaacaaccctagctcaaatagaaaataaaatcaaagctggggctagacagatggctcagcggttaaaagcactgactgctcttccagaggtcctgagttcaaatcccagcaaccacatggtggctcacagccatctgtaatggtgccctcttctggtgtgtctgaagacagcgacaatgcagtgtactcacacataaaataaatacatcttaaaaaaaaacaagtttattagccaggcacggtggcacacgcctttaatcccagcacttgagaggcagaggcaggtggatttctgagttcgaggccagcctggtctacagagtgagtttcaggacagccagggctacacagagaaaccctgtctggaaaaaccaaaaaacaaacaaaaaagtttattaaaaaaaaaaaaaggtacaacaaaaatagtagaaaggatgcactttgagaaatgaaacaaaataaacaaaagttggtgatttagctcagtggtgagcatttacctagcaagaataaggccttggtcagcactcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccagcatatgaaaatgctaaattaaaataagaaagcatgagctgggcatggtggcgcacgcctttaagcactcgggaggcagaggcaggcagattttcgagtttgaggccagcctggtctacaaagtgagttccaagacagccagggctacacagagaaaccctgtctcaaaagacaaaacaaacaaacaagtaataataaggaggcatgagcagtttctaaggcagagtagatgaaatcaccagtggaaaaatatttacagatgatttcctgagccagtgtcagaatcccacaaatgctaaccacagcaccataaacagggtccgagcagttcaatttcctaagtgagactgcactaccccatggaaatcagggttgtgctcagagataaagatgggccagtcacggagcctttgctctgccatggactttaaccctttggaatcataagggcaattaaatactttcttttgtcttttgtcctttttgctcctttgtcctcaaacagaaaacaaaacaaaaaacactggtattaaacttggtggccaatttcaattgaatgcacccacaatactacattatagaacgagcttaaaagtagccaccatttcttttttttttttatttttttacttttttaatgttagtttttacattgttcggttttttggttttttttgtttggttgtttttttttttttggtttttcgagacagggtttctctgtatagccgagactgtcctggaactcactttgtagaccaggctggcctcgaactcagaaatccgtctgcctctgcctcccaggtgctgggattaaaggtgtgtgccaccacgcccggcttggtttttttttttgttttttaagatttatttatttattatatgtaagtacactgtagctgtcttcagacacaccagaagagggcatcagattacattacagatggttgtgagccaccatgtggttgctgggatttgaactcaggacctttggaagagcagtcggtgctcttaaccactgagccatctcgccagccccttagccaccatttcaaaataaaagttcttcaaggacctggtgccagctgaaaacagagttacatggcacaaggctttactgacgagattttctttttcttggtttttcaagacagggtttctctgtgtagttctggctgtcttggaactcactctgtagaccaggctggcctcaaactcacgatatctgcctgcctaaatcagcagctcagttcacaggtctgcagcaacagattgatccacttgcaaacacttcacagatatagcagtcctgttctgtagagtcgagacagcaaacagaaatcagcagcagtggcactacctagcagagacagtcaggcctcagcctcggctcaagtcaggagggaccagcaggaacaccaggagaagctctaggctgtgcctctctctaggaatcgaagatcagcagaagatgagagacccacaagtgttgcgcagctagctctataggcaagccaaattcagcctctgtcactgtcagtcgagtcctatttataccctccaaacatcacctgtcctccacaggtcttacctcagcactggtgtctgccttagctgacatcactctgtcaatcagacttttgggggtgtgtttctctctatggaggcccgataaatgtagc

SEQ ID NO: 1238 - DNA, 1478 bp, Mus musculus
ggagacggggcagtatgggtggaagtttccacgctagaccacgaatcttggtctccagccgccgccgcactctgacccacggaacgcagtttcagccggttccgttttcccgcagggaacccgagtccacccgcagcctgccttcctgcgcaggcgcagtgccacttacccggcatggaattggtgggtttcttgtgtgtggccgtggctgtcctgacttggggcttcctccgggtttggaactcagcggaacgaatgaggtctccggagcaggcgggcctgccgggagccggaagccgggcccttgtagtgatcgcgcacccggacgatgaagccatgttctttgctcccaccatgctaggcttggcacgcctggagcagcaggtgtccctgctctgcttctcctcaggaaactactacaatcaaggtgagattcgaaagaaagagcttctgcaaagctgtgctgtgttggggattccaccttcccgtgtaatgattattgacaagagggactttccggatgatccagaagtgcagtgggacacggagctcgtggccagcaccctccttcagcacatacatgccaatggcactgacctggtggtgacttttgatgcagaaggagtcagtggtcacagcaaccatattgctttgtacaaagctgtgagggccctgcactcaggagggaagctgcctaaagggtgctccgtgctcacgctccagtctgtgaacgcgcttcggaagtacgccttcctcctggatctgccctggactctgctgtcaccccaggatgttctctttgtgctcaccagcaaagaagtggcacaggccaagaaagccatgtcctgccaccgcagccagctcctctggttccgatacctctacgtcctcttctccagatacatgagaatcaactcactgcggttcctctgaagccttggagagtggtcagaccctcagaacaagagggagaagcagagcaagaagtcgtctggccaggctttgggctgatttacctgcctgacccagggaaaccccagcaaagcagcgtctgccaaacagggaccacatgaaggatgggtcaccccaacccagcttcctcttctgaggaaaacctgccaaaaccaagcctacaccaacacaatagtagccaccccactaatttaccaatagtttgcatgataacagagtttgcaccagacatccagcaaagcctagggaagttgtctttaccacaaatgtgtgtaaatgtgccatagaactagttcacaggtgtgatgtttacatggtttccagaccaggctgttttggtcagtcttctgttcctgtagctgaaacaccgctcacagggcatctgcagagctgcggttttcttggatcacagttctgaagcctgtgaagtccaagagcatagcagcctctacatgaccgcggtgaggggcatcccgctgcatctcaaaggcaaaggcagtcagtca

SEQ ID NO: 1239 - protein, 285 aa, Mus musculus
PTERSFSRFRFPAGNPSPPAACLPAQAQCHLPGMELVGFLCVAVAVLTWGFLRVWNSAERMRSPEQAGLPGAGSRALVVIAHPDDEAMFFAPTMLGLARLEQQVSLLCFSSGNYYNQGEIRKKELLQSCAVLGIPPSRVMIIDKRDFPDDPEVQWDTELVASTLLQHIHANGTDLVVTFDAEGVSGHSNHIALYKAVRALHSGGKLPKGCSVLTLQSVNALRKYAFLLDLPWTLLSPQDVLFVLTSKEVAQAKKAMSCHRSQLLWFRYLYVLFSRYMRINSLRFL

SEQ ID NO: 1240 - DNA, 129042 bp, Homo sapiens
gatgatgactacttaaaacaaacattttcaaaattacataaatctctatgttattgccaggggaaatgaattgcctaaaacaaattactctgaatgtgaactgtgtatgacagtgataatggcaagaagaatgtctgtcagttcaacaaagtatggggtaaaggggcaatctataagcataaaggtgactctcatcataaatctaagagtcaaaatttcctagaaaaatgtaatcttggcggggcgcagtggctcacgcctgtaatcccagcactttgggaggccgaggcaggcggatcacgaggtcaggagatcgagaccatcctggctaacacagtgaaaccccatctctactaaaaatacaaaaaattagccaggcgtggtggcagacgcctgtagtcccagctactctggaggctgaggcaggagaatggtgtgaacctgggaggtggagcttgcaatgagccgagaccgcgccactgcactccagcctgggtgagagcgagactccatctccaaaaaaaaaaaaaaaagaaaagaaaagaaaagaaaaatgtaacctcaatatatttggttttgatatcagcttatttgtgtataacaaagaataaaaacagccaaacagcccaaattttgttcctcgagtacactgtaatgggggaaagaaatccaaataagttaggattcttgacttttcctttactcctgactaatctacttaattttttatataaaactagtcgatattattctttcaaagggagtcctgaattctattataatcctatcaaccaaccgttccatatttctttcttttttttttttttttttttttttgagacggagtctcgctctgtcgctaggctggaatgtagtggcgcaatctcggttcactgcaacctctgcctcccaggttcaagcgattctcctgcctcagcctcctgagtagctgggactacaggcgcgtgccaccatgcccagctatttttttttttttttttttttttttgtatttttagtagagatggggtttcaccacgttggccagaatggtctcgatctcttgacctcgtgatccacctgccttggcctcccaaagtgctgggattacaggcgtgagccaccatgcctggccaaccgttctgtatttctaactcacagttttttcctaggattgaaactactccaaaattccctgcatataaaaattaaaacattattgcattctaatattatctagaaccatgagtgctgtctaggatgaaccaatcccatgtttactttctctttctccccaaaattccaataaacagaattttttttttcttttttaaagaaatgcttttaactgggctcagtggcccgcacctataatcccagcacttcaggaggccaaggtgggaggatcacttgagcccagcaatttgaggtcagcctgagcaacataatgagaccctgtttctacaaaataaaaaaattgaccaggtgtggtggcacacacctgtagtcccagctactcagaagaaccgcgtgagcccaggactcggaggctgcattgaactatgatcacaccactacactccagcctgaagcctccagagacagaccctctgtaaaaaagaaaaaaaaaagaaatattttgataatttactaattacagctatgttagtcactgacattggtgaaatttctacatgttttttaatttccaaaaactattcagcatcaaactgccatatgtgtatcagagatcttctacagcaaccacactaactctagctgctaagctcatttttatgagctaggcacagggtgttattctgggagtgggaaaagaagaaaaaattttttaaaaactcagatacagacatgcctacaaagggcttacggtctagaggcaaaggatcaagagttcccagaataaaaaatatacattttggagaagagggaataggagagacacttcctggatgatgtaatatgtgatcaaacccttgaaaaataggataaatttagatgtagtagagtttggaagagtaagggaggaaaggagtattccagaaacaagcatagtaacaagaaaaaaaaacaaaaaattcttcttaatgcaacacaaaatagcccaagtagaataaagaaatatgccatgcttcagtatttatgtaaagattatcagcttaataagaatatgccttttcctttataataaattttataggccaggcatggtagctcatgcctgtaatcccagcactttgggaggccatggtgggaggattacttgagcccagaattcaagaccaggctgggcaaaacaatcagaccccatctctatttttaaaaaattaaaataaaataaattttatagcatgaatacatacagaaaatgaatattacaaataagcttttggatgtaaaaaaaaaaaaaaaaccataaagaatacactcggccaagtgcgatggctcacgcctgtaatcccaacactttgggaggccaaggcgggcagatcacttgaggtcaggagttcaagatcagcctggccaacatggcgaaactctttctctactaaaaacacaaaaattagcggggcatggtggcatatgcctgtaatcccagctacttgggaggctgagaacgagaatcacttgaacctgagaagtggaggttgcagtgagctgagattgtgccactgtactccagcctgggcaatagagtgagactctgtcaaaaaaaaaaatgttcatgtttgtgctatttatctaagcttttatattaatataacaattgaaatccttcatacttaaaaaaaaaatccagaagtctgagagtaggcaaaacaagcaacagctaattttataaaataatttaacctatttgtaggccaggtgtggtggctcacgcctgtaatcccagcactttgggaggctgaggcgggaggatcacctgaggtcaggagttcgagatcagcctgaccaatatggagaaaccctgtctctactaaaaaatacaaaattagcagggcgtggtggtgcatgcctgtaatcccagctacttgggaggctgacgcaggagaattgcttgaacccaggaggcagaggttatggtgacctgagacagcgccattgcactccagcctgggcaacaagagtgaaacgctgcctcaaaaataatagtaataataataatttaaactatttatttgggcctcaggggtatttaaaccactggcataataaaatttccatcactattaatacttaaattccatgaagtgtcactggacccagataacctcaaagacatttttgtttaagaagctattcatcaaagcagattaaaaattaagcaaactaaataattcctggtgatcactgtaacactgacatagatcagtatcaattttttcaaactatattttcattgccaaaatttaatattaagaagtatcttaaattcaatacctaagctaaatatccaaagtaatctctcatttcctattcactccaatttttttttttttttcttgaggcagagtctcactcagtcacccaggctggagtgcagtggcgcaatctcggcttactgcaagctccgcctcccgggttcacgccattctcctgcctcagcctcccgagtagctggcactacgggtgcgtgccatcatgcccggctaattttttgtatttttttagtagagacagggtttcatcatgttggccaggatggtctcgatctcctgacctcatgatccgcccacctcggcctcccaaagtgctgagattacaggtgtgagccaccgcgcctggccgatttttaagtgtcaatcatcaaatcgattcatcccatggatgatacagtgtaacacagtgaacactataatagatacgaaaagacttagattctgctattgcccaactttagcaacttaggcaggtaaatcacttcacttctccgaccttcagtgttatcgaaagtaaaacaagactagataatctgactctacattctataaattagctatttttattttatttttatttatttttttttttgagagacagtcttgctctgtcacccagtctgaagtgagtgcactggcatgatcatggctcactgcaacctcaacctcccaggctcagcttcccaagtagctgggaccacaagcacactctgctaatttttcaatttttttgtagagatgggactcgctctgttgtgcaggttggtctcaaactcctggcctcaagtggtcctatcacctcagcctcccaaagtactaggattataggcatgagccactgtgccctgccattaacattttattttaaccaattttgttgtttttgagatcgctgttaaataaaagtaacagcaggacatacggaagaagcaaactgtctgaagaactccataggaacattcgcagtgtttcatacagtctcagactttcaaatgcaaagaaaaaaaaaataggttgtatctgaagactattctagtaatattttgaccacacaagctactggggtaggaaaaaaatggtagaagaacagtataagtgttcaaggaaaaatgccaccacaagaaaaccaaaataaaaaacagatgctccacatacggttattactacattacagaagcttttcatagttttccagtgctcttaaaaagtgctaatagaaaaagaaacaaaatgttttcttaaccatttacatgtatacatgtattttttgcatcctcaaacctgaaaaggaccaaatataagataatctatagggccgggcacagtggctcacacctgtaatcccagcactttgggaggccaaggcgggtagatcatgaggtcaggagttcaagaccagcctgaccaacacgtctctactaaaaatacaaaaattagccaggcatggtggcgcatgcctgtaatcccagctactcaggaggctgaggcaggagaatcacttgaacctgggaagctgaagttgcagtgagcctgagatcacgccactgccctccagcctgggtgacaagagcgagaccctgtctcaaaggaaaaaaaaagaaaaaaaaaagataatctatagactgagttatttgtgaatataactgatctgctcgactatattttataactttctagtatttagtagtgtgccagaacataaaaagcacctcatactggttgaatataagtgagtaaacaaaaatatatgaatctctaatctacaaataagactatacacaataaattctgatcaatctttactagttgttttatatcatagtctagtaaaatccagtatcttaagtaaaagaacagatggaactaaatatgcaagagttccatcattcccaggcatcaagaagaatttgaaattacaactaagatagatcacagaatacaattaaaaccaaataaccaaaacatattttttaaaaaacaaacagcctgacactcacctacatcaacccccagtctatccaaaggcctttgccttctacagcagataacaaaggtaagaaaagaaaatttcaccaattcataacacaattttttttaatgcttttaaggccgggtgcagtggctcacccctatcatcctagcactttgggaggctgagacaggcagatcgcttgagcccaggagctcgagaccagcctagacaacatggtcaaaccctttctctacaaacaaaaaaaaaaattaaccaggcgtggtggcctgtgcctgtagtcccagcgacttgggaggctgaggtggaaggatcacctgagtccagaggtcaaggctgcagcgagccactgtatttcagcctgggcaaaagagaccctgtctccaaaaaaaaaaaaaaaaagctttaaaaaagttattaactaatctaatctttcctataagttaatttccatcatttcattcttttttgattaagaggataggcaaaacacaaattttactgttttttaaatccaacaagtattcaattaaaaataagccaggcacggtggctcacgcctgtaatcccagcactttgggaggccaaggcaggcggatcacgaggtcaggagattgagaccatcctggctaacacggtgaaaccccgtctctactcaaagtacaaaaaaattagccaggcatggtggcacgcgcctgtagtcccagctactcgggaggctgaggcagaagaattgcttgaacccggaggcggaggttgcaatgagctgagattgcgccactgcactccagcctgggtgacagagcaagactgtctcaaaaaaaaaaaaaaaaaaaagataaaatcagcgaagggcctatcctgctctcaagagataaaataggtacataaatacctacaagatagaaagtgtaaatgccgcgagagatgtgcagaaaaagcattacaggagcccagagggagctgttaccacctcacagaaatataaccccttcaatctgtttaaaacaattttataactattaactccctttaggctcacaacagccaaccctaggagagtagatgtttacctaatattcaagatgaggaaactgaagcacagaaaggttgatcaagttccaaaatcacatagttagagcaagaatcaagatactttgtattatattttctccgggggagtagttcaacatatggcaagccttttgtaaaaggaaagagtattttagtattgtaagtaatcagttcctactgtgagcattttatacatagctatatccatatatacaattaatcttgatttccattaacaggtgtgcttaaagcaaggccaagcaactgggtactataaatattaaaacaaataaataaaattccaccggatgttaacagaaaaagaaaaaaagatacaagatttctctctccagtaacttgcggttacttcttctgtaattgttacccttgtctaaataacattctaaaattggtctgctcctgagcccgggcaagtacaagttggttcatccaataaatatcttcatgaaaaggtacatcaaaacattttaaaaagctattaaaaattaaacgatgccatcaactcttcagttatccacaggacaatcacatgtgacccagcatcagcagctattgatcaagatatattgaacgaatgaatgaatctttgtaggcatttttaaatcccgggcctgttgctccttgcacagtgccatgttcagccttccatcactgcctcaccagggtgcacacaaggaatgtaaatttcaatataattaggatataattagagaagcaaatctgatgcaggtttacatactaatcccaaagattagaattacctatactactactctccaaggttaactctgtggaagaggcaccgcagcatgcaacatcacataaagaaaactgacacttcctgagcaaatagttttcgtccatatcacttattcccatccattcctttaatacatgactattcctgatccagttaatttgaagaattcagtctcctctccataaaggctgatttcacaactacagtttctcaaattcctctctccccaaaaaggggtgcacttacggacttcgcttaagaaaacaccaacaataaacggcagaaggtatagtgttcggatctttgccatctccaccagtacccagccttcgccattacaccctgaagcggtctgttagaaaggtgaactaatttactctgcacgcacttgtccatggctgtcaacctccgcagccccttctacacttccaagtcggccaccaactccgcctcagtgagcccaggcccgccacctgcgccggccccacccggggcaccggctgcccgctctccctcgcaggccctgtaggctccgcacgcccctccgcacaggacacctcggggccagccccggcccggccacagcccattcttcctccaaactccataagcctccgctagcccagcccgagctccccgccgcgcccggctctctcctgggctgccgagtggaagaggccaggcggccaggacgggtcccgacctgcccaggcctgcgacaccccccgcccggcggagaaaccgtcccagcggctgctgccccgggagccctcggaagcccccggactagcaggagcccggaggccggggttgcaggcgccagggcctactcaccgggagctggctaagcgtgggagccgacgtgcgccccggcctgaggagtgggacgcggccacggcgcgcggccctacaccgggacctcgttcggcgcggcgagtcggacgctcactccagccgccgccgccgccgcggctgctgcttcgccaccttggccgccatcttgactcaacccctctccctccccccagcccgcggagccgcggctaaggcggctccagcgccggctcctcctccttccggagagttgggagaccaactccctccgctggccgggcgcctctcctacctcggcggagcttcccgggtcgcgctgcgcccggtctcttcatgtctcctctaggcctggcagcggcggtcctctcggacggatacagggccgagcagcgcccagccggatccagcgctgctgccatcgtgccctgggcttgtgcgccccccgcctgcccgtctgttccgcgcgcccgaggccttcctcaggcgtgggaaaaggaaaaactccaggccgtggaagggaccctgcaaacccctccgcggcgtggtggggcggcggcggcctcctctggccggagctgcgtacagggaagccggtcccctcgtggctgggagctggaggggtgcatttcgacctgcccaagatactttctagggctctggctggaattcgcaccaagccctcactgaaatgctgggcgaggccgatttgtccacgatgttgctccttaaccttaagttacttgcaagaggagcctgtggccctcgcgactgttaagtgcacgctcagcctcaccctgctggggaaacgacggttcctcgtaaccgcacgcatacgttcctttagaaaagccaggcccgaccggacgcagtgggtcacgcttgtaatcccagcacttagggaggccgaggcgggccatcacttaaggtcaggagttcgagaccagcctgacgaacatggagaaaccccgtcactactaaaaatacaaaaattaagcgggcgtggtggcgcgcgccagtaatcccagctactggggagaccgaagtgggagaattgcttgaacgcgggaggctgaggtagcagcgaacctaggtcgcgccactgcactccagcctgggcgacggagccagaccgtttcaaaaaaaaaaaagaaagggccgggcgcggtggctcaggcctgtaatcccagcactttgggaggccgaggcgagcggatcacgaagtcaggagttcgagaccagcctagttaacatggtgaaaccccctctctactaaaaatacaaaaattagctgggcgtggtggcgcgcgcctatagtcccagctactcgggaggctgaggcagaagagtcgcttgaacccgggagacagaggttgcagtgagccgagatcgctccactgcactccagcctgggcgacagagcctctcaaaaaaaaaaaaaaaggtaaagaaagccatccaaaagtgagaaggaataacaaagttggtgtaactggctattttggaaaactgtcatacggataacgggctgtctaaccctataattacgagaaaggcccgagttttaagaaatgaattcgaaaatgaagaggaaggaactcttcctataagtgggagcttatatataagacgcttccttttaaaccgattgtacagtgtggtaggactagggtaggaaactggacggcatggagacttctgtgttaaaacacaagagaacccttaacgttaaaacctcaagcttccggagcatgtcggcgggagggacttaacagcggaacccaacattccccggtgaagttttccagccggagtcagggtcagaggcagcctttcctactgcgcaggctcagtgctgcttacccatcatggaagcaatgtggctcctgtgtgtggcgttggcggtcttggcatggggcttcctctgggtttgggactcctcagaacgaatgaagagtcgggagcagggaggacggctgggagccgaaagccggaccctgctggtcatagcgcaccctgacgatgaagccatgttttttgctcccacagtgctaggcttggcccgcctaaggcactgggtgtacctgctttgcttctctgcaggtaggaggccataggaggggcgatgggagccggggctttgaaagggatttaagtgctaaccgatctcagtcgccttcttctcgaagttttccgtagggagctaagtgaatacaccgaaggtcttacctctgaacccctcacagcctagggacaggagcggccggcttacctggtgggttgggggacgtcggcagctcgcgtactacgccagcaggattgaggagcagagaaacagttgcagttggttgtattcagtacctgcatttccgttgggaactccacctgtacttgttattctgtggaacttttttttatttgtagaaggagcaagaatattgaccttactatatagcacacgaaacaatctatgctgtatcgtgcctgctcaatccttaaagttaacttctaatgatagtaaaagaccttcctgctgcctttaaaatgcagcttgtgctagtaacatgcatgtgtcaaattgaagaattagacatagatgactagatagaaagtaattttgtaggtaattttagagttcaactccacccagctttcagtgaaggaacctttcaaataatagatttttgcttaccatagagaaaagatcaaatgacaaagcaaatattgaccattaagctggaatatggtgataattgaacagttgtataaatgaagtaattgaattgtacacatacaatgggtgaattttatggcatgtcaaagtatacctcaataaagctatttttttaaattgcccatgacctcttttcccatttgtttgtgtgtctttccaattctttttctatacagcttcttcacagaaatcacattttataaaattttatatcgtttttactcgacattactttttcatttatttaccaaatacttattaaacatttatgtgctaggccttattctatgccctagggatacaaaagtggaaagctagataagagcagtgtcctcatgaaactttaaacatctacctatattaattagatctaaatgtatagcctgttaaatggcttcatcgggataaaccttaatcatcccttattgtttgtacattcagagggttttttcctagtttattgcaaagagcagagaacatctttatgtattttatattatttcatgagtattaatttttaaaattggctgtttttaggctttgcattgcaaaacacattcccaaaaacaaaatgccaacttactctttttttttttttttttttctgagatagtctcgctctgttgcccaggctggagtgccgtggcgtgatctcggctcactgcaacctccaccacccgggttcaagtgattctcctgcgtcagcctgccaagtagctgggtttacaagcgcatgccaccacacctggctaatttttgtatttttagtagagatgaggtttcaccatgttagccaggctggtctcaaactcctgacctctagtgatccacctgccttggcctcccaaagtgcttgggattacaagtgtgagccaccatgcctggcctacctatttacattcttactggcactaatgagagtatctgtcttaatatactactttctgtagcattgactgacattttttataaatttctttttttttttttttttgagacggagtcttgctctatcgcctaggctggagtgcagtggcgcaatctcggctcactgtaagttctgcctcctgggttcacgcccttctttctgggactacaggcgcccgcccgccaccatgcccagctaatttttttatttgtttttagtttttagtagagacggggtttcactgtgttagccaggatggtcttgatctcctgaacttttgatctgcccgcctcagcctcccaaagtgctgggattacaggcgtaagccaccacacctggccattttttataaatttcttaatttgtttagtatcttctcccccaaaaacctttgttaccagtaaaagtaaaccattttacatatttattaagaattggagcccaagcacttttcttctaaaatttatgctctgttaagaatattaattgcaaatagttacaagtaatgccaccattttttcttagcttctaggtttggtggggggttttttgtttagttttctttttgagatggagtctcactctgtcacccaggctggagtgcaggggcgcaatctcagttcactgcaacctacgcctcctgagtttaagcaattctcttacctcagcctctcgagtagctgggactacagtgtgcaccacatgttgggctaatttttgtatttttggtagagctgaggttttgctgggatagccaggctagtctcgaactcctgacaagtgatccacccacctcggcctcccaaagtgctgggattacaggtgtgagccaccacacccggctggccagcttttagttgtatttgtattttatattacaactataggagtcaaattataagcaaatttgttacaaggtcttcaaaagaagcctggattttatttgcaaaacattataggtatagctgtttaataaacttacccttattttcaataggttcataaaaatttgggaccagaattgaaaattttttcaaataaaaaatataggccgggcatggtggctcatgcctgtaatccgagcactttgggaggccgaggcgggcagatcatgaggtcaagagatcaaaaccatcttggccaacatgttgaaaccccgtctctcctacaaatacaaaaattagctggctgtggtggtccacgcctgtagtcccagctactcgggaggctgaggcaggagaatcacttgaacccaggaggcggaggttacagtgagctgagatcgcgccactgcactccagcctggcaacagagggagactccgtctcaaaaaatatatatagagagagagagcatgcacttggcactcaatgtttttattgtatttcattatttcctctgaatccattttgttttttattgtatgttatttattctttatttgtgtttttttaaattgttattttttttttttttttttttttttttgaggcagagtctcaccctgtctctcaggctagagtgcagtggttcgatcttggctcactgcaacatctgcctcccaggttcaagcgattttcctgcctcagcctctggagtagcgggattacaggcattcaccgccacgcccagccaattttgtatttttagtagagacgggctttctccatgttggtcaggctggtctcaaaactcccgacctcaggtgatccgcccaccttggcctcccaaagtgctgggattacaggcgtgagccaccgcgcccagccacgccaggctaatgtttgtattttcagtagagacagggtttcaccatggcggccaaactggtctcgaactcctgacctcaggtgatccacctggcccggcctcccaaagtgctgggattacatgcatgagccactgagcatggcctgtttgtttattttataaaaatggggtcttgttctgtctagagcctttcccctctagactgcactgtcagctctcatatcaggtgacagagcaagaccctgtctttataaaataaaccaaacatgaataacatacaagaaaaaacaaaatgataagttggattcagaggaaataatgaaagacaataaaaacattgagtgccaagtgcatgctctgtattttttatttgaaaaaattttcaattctggtcccaaatttttatgaacctattgaaaataaggatgaatttattaaagagctgtacctgtaatattttgcaaataaaatccaggcttctcttgaaaatcttgaaacaaacttgcttaatttgactcctatagttgcaatataaaatataaataaaactaaaagctgactggatcacagctccctacagcctccaagtcttgggctcaagtgatcctcccgcctcagcctaccaatagttgagactataggcgtgtgccagcacacccaactttttttttttttttttttgagacggagtctcactgtcgcccgggctggagtgcaatggcgcaatcttgggtcactgcaacctctgcctcctggattcaagcaattctcctgcctcagcctcccaagtagctgggactacaggcatgcatcaccatacctggctaatttttgtttttgtttttgttttgttttgagtctagctgtgtctcccaggctggagtgcagtggcacaatctcggctcactgcaacctccgcctcctgggttcaagtgattctcctgcctcagcctcccaagtagctgggattacaggtgcccgccactatgcccagctaattttttgtgtttttagtagagacagggtttcaccatgttggctgggctgctcttgaactcctgacctcgtgattcgcctacctcggcctcccagaatgctgggattacagacgtgagccaccacgcctggccaatttttgcatttttaatggagatagggtttcaccttgttggccaggctggtcttgaactcctcaagtgatccacctgccttggcctcccaaaataataggattacagcatgagccactgctcctggtctaatttttaaaatcccttcttaaattcacaagtcattcaaacgtgtggattaaacattatctattctgctgatttaacattttaatataaaaaacaggaagctattaatttgtaatgtaatgaaagctatgatgttttgatggagaaagtactatggacacaaaatggaaaaaagcattaaatctcttttcaggggtttagattaaggaaatctccaaattggttttcttttgagctggactttaaaaataggagtagatatatatataggaagcaagcagtagtaaaggcatcagtaactcttggatttgcatgaataattcattctaacaagatcttcagtttaagggaaagggagaagcagggaaaaaataataattgctttgttattggtggctcatttcatcctgtcagcaactctgtgaggtaggtactattgttttttccattatacaagtatgggaactgaatcacaaagtttaagtaacaactgaagtgaccagctacagtgtaaagaagccaggaccctgtggtttttctctgttctaaaaccgttacacccaatctgcctctcacattgccttgtatgccttgtcagttgatgaaatatctaaattgattcccagtgtatgttccaaggaacattagttcatcaagctgctattaaaaaaaaaaaaaaagaggccaggcacagtagcttacaccagtaatcccagcactttgggaggccgagacaggtgcatcacgtgaggtcaggagttccagaccagcctggccagcttggtgaaaccccatttctactaaaaatacaaaaattagccaggtgtggtggtgcatgcctgtaatcccagctactctggaggctgagacaggagaatcgcttgaacccagtaggtggagattgcagtgagcagagattgtgccattgcaatccagcctgggcaatagagcaagactctgactcagaaaaaataaataaataaaatgaaaagaatgcctcggtcaagtttggagaatagccagatgtgctatcctctatgtagacgtttacagtctttatgagaatatcaacatctttgagaagcattgctgtaaaaaattttgacttggtttaatccagtattcctccaatttatgtgaccactaaaatacctactaatagatgcatctcttatatagtaggatgtcattgaatatatatggtagagaagtaacataatcagttttgtgttttagaaagctcattcttggccaggcgcagtggctcgtgcctgtaaccccagaactttgggaggccaaggtgggcagatcacaaggtcaggagttcgagaccagcctggcaaacacggcgaaaccccatctctactaaaaatacaaaaattagccgggtgtggtggtggatgcctgtaatcccagctactcaggaggctgaggcagaagaattgcttgaacccaggaggtggaggttgcagtgagccaagatcgctccactgcacttcagcctgagcgacagagctagactctatctcaaaaataaaagctcagtcttggaccgggtgtggtggctcatgcctgtaatcccagtactttgggaggccaaagtgggaggattgcttgaggccaggagttcaagaccaacctggtcaacatagtgagaccccatctatttaaaaaagaaaaaaaaaaaagaaagctcattctggtggcaatggggagaatggtttggaaggaaagattggagtcaggaaaatcaattcagcccagcctttcttctctagactgcactgccagctctcatatatcagatttccatgtaattctggtctatacactttagtcatctcaacaaccctgtcttaattactgtagcttataaaagctacactaggccagaagtgttggttcacgcctgtaatcccagcactttgggagacagagacgggtggatcactagttcaagagagcaggaccatcttggccaacgtggtgaaaccctgtctctactaaaaatacaaaaattagctgggcatggtgatgtgcgcctgtagtcccagctactcaggaggctgaggcaggagaatcacttgaacctgggaggcggaggttgcagtgagccaagattgcgccactgcactccagcctcttgctcttgcgacagagcaagactccgtctcagggggaaaagaaagctacactatattatagaagcgctattatctgatatgaatagtcttctgattgttcttcagggtatgtttgctgtttttgaccctttttccaaataccttttttatgggggaagacagagcctcactgttgcacaatcttggctcactgtagcctccgcctcctggattcaagtgatccccctgcttcagcctcccgagtagctgggactacaggcatgcaccaccacgcccagctaatttttgtatttttagtagagacgggattttgccatgttggccaggctggtctccaactcttgacctcaggtgatccaatccttcttggcctcccaaagtgctgggattacaggatgagccaccatgcccagcccccaaatacattttagaattagcttggtgatgttcaaggaaaaatcttgctgacattttttcccccttgtgacagagtctcactctgacgtccaggctggagtgcagtggcgcagtctcggctcactgcaacctccacctcccaggttcaagcgattctcctgcctcagcctcccaaatagctgggactacgggcatgtgccaccatgcccggctaattttttgtatttttagcagaaatagggtttcaccgtgttagccaggatggtctcgatctcctgacctcgtgatccgcccacctcagcctcccaaagtgctgggattacaggcgtgagccacagtgcgtggcccttgctggcatttttattggaatttcactgactctactgattaatataaggagaactgacatttccaatataaagcctttctgtctctgatactatggtatgcttccatttattatatgttggccttctttactatctgttaatagttttataattaaggtcttaaatgtgtattgagatgattatgtcattgtgtccattaatctgttcttatgtgtagacattccttttgcaaatatagtctgttactttctcatacttcagtatcctctttaatttctttaaatatattaaacatttatatctgcttctaataattccagtttctgcagtctgtatatctgattctgttctttgttctagtaattcattcggggtgactcggttccatgtgtattttgtgatttttttaaatgtaagcacgtttctttttttttttttttttttttttgatacggagtctagctctgttgcccaggctgaagtgcagtggcacaatctcagctcactgcaagctccgcctcctgggttcacgccattctcctgcctcagcctcctgagtagctgggactacagtcacctgccaccatgcccggctaattttttttttttttttcagtagagatggggtttcacacctgggattacaggcgtgagccaccgtgcctggccttttgttttcttttgttgttgttgttgttttgttttttgcacgtgtttcttagaaccatatttgtggtaatattttggtgatttactttagcttcagccaggtagctaagggcactacctacctctcatcactctaaaattttagattgagatttttcaggccatagaggtcatataaattcagggatcaaacccaagagcattcactgtggaatgctgtgaaacaaattgtctcaagaccttgtagcttaaaaccataattaaatctttccagcctgtgtgctggcacacacctataatcctggcactttctgaggccgaagcaggaggatcacttaacccaagagttcagcctgggcaacatagccagaccaggaaaaaaaaaaaaaaaaagttagccaggcttggtggcagctgcatgtagtctcagctacttgggaggctgaggtggaagaacacttgagcccaggagtttgcgactagagtaagctatgatgatcatgccttatagactaagcccatgtctcaaaaacaaacaacaacaagaaaaaccaatcaccttttttttcatggtttcagacaaagtatacttgtctctgcctcacaatgtttagtacctcatttggaggacccaaagactaggggctggaatcacctgaatactcatgcacttacgtatctggctgtcagctggggactttgctacagatgtcagccagaacatccacatatggtatatccatgtgacctgggcttcctcacaacctggtggctgggttcttgggcaagtgtcctaagaaagagcctgtgctagggataaccatatttccttttatgacctatccttaaaaatcttgcagtatcataagccacatccaggtttaaggagagaattagattccacctcctaaaggggaatgtagacattctacaagtgcatatgggactagaaatattgctgtagctacttttggaaaatacagtctatcacaccaagtaaaggagagtatgtgattagcaattcttagggggtgacattttttcttattttcccttctgctagaaccaagcctacagataggatgtagccccaccatatctgtctagggcaagtttttttctggttcatccagtgaaggtattgccttttgaaggtcctgtctttatgtggaggtctccttatctgtgtccaagctttatctgctgctcccttgactttaggccaccaaggatatgtagatgttctcaaagtgctctgggtcagccgcataatacctctcaggatttatgtctacctattgttttagtccttcaagtatatcccttactttcctgctagttaaaccatgcattctagaacatgtttgccttttatctcacatgttcaggtattcatcctgagggtttctctgcatatctgatttaccatattgcctaaatagaacttattaggggttatttttaatactgcttttttgggttttttcttttttttttttgagacggagtctccctctgtcacccaggctggagtgcagtggcacgatctcggctcactgcaacctccacctctcgggttcaagtgactctcctgcctcagcttcccaagtagctgggattacaggcgcgtgccaccatcatgaccagctaattttggtatttttgtagagccagggtttcaccatgttggccaggctagtctcaaactcctgacctcaagtaatccgcctgccttggcctcccaaagtgctgggattacaggcgtgagccacctcacccagtgaaaggtagcaatttcattagtaagagtcgatatgaatgcaatccttttgggaataatgagaaatgacactactcgcaagtatggctatattggctgataatatagcatgtgacaatgtttcttgatctgcagagatatgagctcatttttctttttaattttcttttctttttttttttttttttttgagatggagtttcactcttgttgcccaggctggagtacaatggcatgatctcggctcactgcaacctctgcctcccaggttcaagcgattttcctgcctcagcctcccaagtagctgtgattacaggcatgtgccaccatgcccggctaattttgtatttttagtaaagactgggtttctccatgttggtcaggctggtctcgaactcccgacctcaggtgatccacccaccttggccccccaaagtttgggattacaggcatgagccactgcacccagcctttttaatttttttctcttagtgatcttttaaagacaacttctgttttatagggataacgcctataatcccagcaatttcataattgaaagattttattcattgaaaatccagtttttaatattatttaaattgtggtaagacatacataacaagaacttaccattttaaacttttttttttttttttttgagatggagtttcactcttgttgcccacactagagtgcaatggcatgatctcggctcactgcaacctccgcctcccaggttcaagcaattctcctacctcagccccctgaatagctgggattacaggcacccaccaccaccatgcccggctaatttttttatatttttattagagaatggagtttcaccatgttggccaggcttgtcttgaactcctgacctgaggtgatccaccttcctcggcctcccaaagtgctaggattacaggcgtgagccactgcgcccagcgattttattttattttatttctttatttattttattttatttttttgagacggagtcttgctctgtcgcccaggctggagtgcagtggcgcgatgtacgctcactgcaagctccgcctcccgggtttacttacaccattctcctgcctcagcctcccgagtagctgggactacaggctcccgccaccacgcccggctaattttttgtatttttagtagagacggggtttcaccgtgttagccaggatggtctcgatctcctgacctcgtgatccgcccgccttggcctcccaaagtggtgggattacaggcgtaagccaccacgcccggcgattttaaacatttttaagtgttcaattccatggcagtaagcactttcatagtattatgtaaccatcaccactatttcatcatcccaaatagaaactctatacctgtttagcattccttttcccctcctctcccaagcctctggtaaccaccattctttctatctctatgaatttgtctattctaggtaactcgaataagtggaatcatacaataattgttattttatgcctggcttatgctaattagcatactgttttcaaagttcatccatattgtggcatgtatcagaacttcatttctggttgagctcagtggctcacacctgtaatcccagcactttgggaggctgaagtggaaggatcccttgagaccaggagttcaagaccagtctggacaacatagtgagatttcgtctttacaaaaaataaaaataaaaaaattagccagtctgggtggcgagtgcctatagtcccagctacttgggaggctgaagtgggagaatcccttgaatccaggaggtcaaggctgcagtaagctctgatcagtctgctgcattccggcctgggtgacagagcaagtccctgtctcaaaaaaaaacttcatttctttttatggctttattaatattccattgtgtatatatacatacatatatatatgtatgtatatataccacattttgtttatcattcatctaatgataggcacttgggttatttccaatttggggctattatgaataatgcttctatgaacattggtgtacaagtatttatttgagtaccggttttccttttttttttttttttttttgagtataattgctgagacatatggtaattctgtatttaaattttttgagaattgacaaactgttttctgcagcaactgtacagttttacgttgccaccagcaatgaactatggttccagtttctccacatctttgtcagcatttgtaattttccattttttggactatagccatcctagtaagtgtgcagtgatgatgtcacattgtggttttgattttcatttccctaatgactaaggatgatgagcatcttgcatcttttcacatgcttattggccatctatatatcttctttagagaatacctattcaagtcctttgcccattttctgattctagtttcattttaaagtcatgatttttttttttttttttttttttttgagacggagtctcgctctgtcaccaggctggagtgcagtggcacgatctcagctcactgcaacctccacctcctaggttcaagagattctcctgccttaacctcccgagtagctgggactacaggcgtgtgcccaccatgcccagctaattattgtatttttagtagagatggggtttcactatgttggccaggatggtctcaatctcttgacctcgtgatccacctgcctcggcctctcaaagtgctgggattacaggcatgaggcactgtgcctggccaagtcatgatttcttagactgggttctgtggacacatcctaatagaagaggatctagctctcttagtttcagcttcctttgggaacccaggcctctgggctccagtaacactgcctccttcctttaccttgccaaccgagggttggtagtcacttcttgctatctctaaactctgggttacttcactgttccttttgtcccttagatcctccctcagttatgcgtcaaaatctttgcattaaattcttgctgttgtaactatttgatgtggtttctgttaccccgaatagatcttgacatagcatctaaattccctcattttataggggaagaaacttgtaccattttgtcttccaaatacattttagaattacttggtcatgttaaaggaaaaacattgcagctattccttcccataacatacttctcagtcgtaactagcaatctagcagtcataatcacttttttttttttttgagatggagtctcactctgttaccaggctggagtgcagtggcacagtctcagctcactgcaacttctacttcctgggttcaagcttttctcctgcctcagcctcccaagtaattacaggctaggattacaggcctgagccaccgtggccagcctcataatcacatttaatacaaaataaagtcacgttgtaaagactcaaatttatacatcacaatgtataaaggtaaaaattttatttttaaagaataaaattacaaaaattaaagaatttctccaaattcatatagttagtaaaaagacagatagtgttgggaccatgatgccttcatgcccagtccatttcttgttctaacaaattaaaacttcccgggttggagtgggagaggagcttttttcctttatatggttttttttttggttttggtttttcttttttttttttttttttttttggtagagagaggtcttgctatattccccagcctggtcttgaattcctggccttaaacagtgtgcccgccttccaaagtgctaggagctgggattacaggcatgagccaccacacccagcttcttactgatttattttcttttcttttttttttttttttttgagacacagggtctcacattgtcacccaggctgtagtgcagtggtgtggtcatggttcactatagcctcaaaatcccaggctcaagcgttcctcccacttcagcctcccgagtcagtgggactacaggcgtgagccaccatgcccagctaatttttaaaatttttcttttgtgaaaacagggtctcactatgttgaccaggctggttttgaactcctggcctcaagtgatcctcttgccacagccttccaaagtgctgggaatacagacatgagccactatgcccagctttgatttttttttaaccatataaatctattacctatttagaataaactaattttaaattttttaagtaaaataaaatgtttacccttataaattatgatgtataaatttgagtctttacaaaatgtctttactttgtattaaatgtgattatgattgctagttatgactgagaagtatgttatgggaagactactaagcatacaattgtgcatgagcttatacacaaacacacacataatgtagttctacatctagaaattacattaattttattattttctgtttcctagaataatggtctcaaactctttggtcacattttcctatcagtaaaaaatgttgagtttttttatttatttacaatatatcataagtatatggactaatgtgtacattaaaaacattaacaaaaacttacatttataaaaaacaaggtaaacaaattagggggagatggctgagcactgtggctcactcctgtaatcccttcactttgggaggcagaggtgggtggatcacctgaggtcaggagttcaagaccagcctggccaacataatgaaatcccgtctctactaaaaatacaaaaattagccaggcgtggtggtgggcacctgtaaacccagctacttaggaggctgaggcaagagaatcgcttgcacctgagaggcggaggttgcagtgaactgagatcacaccactgcactccagcctgggcaacaagagcaaaactctgtctcagaaaaaaggaaagaaaagaaaattagggggagacatcctaatgctttttctccaccaccccaaaagattattttgtgcatcctagggtgcacctgtcttagttggacattgttctagaatgtatcagttaaaagctgctgaaagatctcagacatgtgttctgttaagtgcctacaggttcaccaaacttattgaaaatagttaaaatggtccttgacttcagcttccagaactgttgtaagttccttagttcaaacacaaagcaataaaactggccccaataaaacacattagcctcaattctaagcagtttctgataaccataatcatagactaatgtgcacagcctttgaacttagcaattgcaacactaatgtacatgagactatttatcaccaaaaatcaagtaatctagggagaaaaaatgggagagggtatgtgtagagatttgagggaaacccaaaatatacacaaaatagtttatgacttaaaaaaaaaaaaaacgcaaaaaaaggtatgatgaggacaatacaaaactaaacctgtaaactaaacctgtttgctgggcgcagtggctcacacttgtaatcccagcactttgggaggctgaggcggatggatcacaaggtcaggagttcaagaccagcctgtccaacatggtgaaaccccatctcaaataaaaatacaaaaattagccgggtgtggtggcgggtgcctgtaatcctaactactgagctgaggcaggagaatcgcttgaactctggaggcagaggttgcagtgagccaagatcgcgctgctgtactccagccagggcgacagagcaagactcttaaaaaaaaaaaaaaatggccattatctccacttaactggtgaagaaactgtggctcaagaaagttaagtaacttgcacaaatcagacctgcaattatttattggagagttgaagtaacaggtgcattagctggacagttgctcaaaatgagtccaacttaagtgataccaaaatgtcactgtattattatttgtaaggttacagaggagttttatttaccagaactatttttagggaatatagtatatgttttgggaaaataaagaatatataagttgtttggggtgccaatgggatcaagatccccttggggtatgctggatagctggctatgaaactcttcaaaagaggaagctttcctaaatggtatctacacattttcctgtaatactcaggagtagcaacctctattttctttttctataccaacaagaatgagcttggaaagcttcatccttaaatcaatgttaaacaggatttgaggactgtcaatgaagagggggccccagttgttctgagtggtcgtacatggtgtgatcctaaatctgcttaacttcaaagttagtacccttggctgtgtaccatgctgcctctagcatgtgactgaaatgcagacagacagataggtatatagatacaaagatgggaaagaattgtgaatggtgattctaaagattgtgctactggtagtcttctcacaggagtatcttggtgtcgtgttttcttaaactttgtatcataatcacacattttcaggcagcttaaatcctttaaggaacaaaaacaggataagaatgagtgaatagataggtctccactgttaaaaaaaaaaaatctaccactgtatatttgttaccctcaggaaattactacaatcaaggagagactcgtaagaaagaacttttgcagagctgtgatgttttggggattccactctccagtgtaatgattattgacaacaggtaatatatcttttaacaatgtagaaatttattggcaataaatatgcagtgatatactcaaaagacacacaaaaaactaatgtgagtggctgagaacatcttgtatgaaaagtctagggctcggtgccatggttcacgcttgtaatcccagtactttgggaggccgaggtgggcggtctcaggagtttgagaccagcctggccaacatggtaaaaccgcatctctactaaaaatacaaaaattagctgggcattgtggtccagctactaaagaggctgaggcaggagaatcacttgaacccaggagttggaggttgcagtgagctgagatcaagccattgcactccatcctgggcgacagtgagacttcatctcaaaaaagaaaagaaaagtctacataaaataacttcacagcggggcacagtggcttacgcctgtaatcccagcactttgggaggccgaggtgggcagatcacctcaggtcaggagttcaagaccaacctggccaaacatggtaaaaccccgcatctactaaaactacaaaaattagccgggcgtattggcctacgcctgtaatctcagctacttgggaagctgaggcaggagaatcgcttgaacctgggaggcagaggttgcagtgagccaagatcacaccattgcacttcagcctggatgagagagcaagactccgtctcaaaaataataataataataacttcacatttgtttttaaatgacagcgtgattgaaataaattttttaacttctgttcggattttttttcctgacatgggtacttctctttacatctatagctttaaaaagttttattataaatttcaaaaacatacaaaagtataaagaatagtatcataaacccccatttgcctattacctaaacccactgattatcgagactttactatacagtgcttgtttcttcacctatccctaacttaacatcttttgtgtatatgaaacattttaaagaaaactccaaccaccaggttttttaccccaaggtacttaggtctgcatctcttaagaagatgggacacttttcatctagctacagacagccattatcattacatctaacaatattaacaataacagtaattctttggtgtccaccaacacccagtccatatcagaatttcttcaggtagctcaaagatttccttttacaattggtttactcaaatcaggatttcgacaaggaccacacattatagttggttgatattctgcatttaattacccttttctccaaatcagtggatttgttgaagaaactgaattatgttgtcatacagaatgtcctgcattctggatttatctgtttgtttcctgtatgtctacgttcttttttttttttttttttttttttttgagacggagtctcactctgttcccgcccagcctggagtgcagtggtgccatctcggctcactgcaacctccacctcctggattcaagcggttctcccccctcagtctcccaagtagttgagattacaggcatccaccaccacacctggctaattttttgtatttttagtagagatggggtttcaccatattggccaggccaggctgatcttgaactcccgacctcaggtgatccacctgcctcggcctcccaaagtgctgtgattatagccatgaaccactgtgtccggtctttttttttttttttttttgcacacggcaaatcagatttgggtctaactttttggggggcaagaatatttcataggctgtaccatgtactttgcatcatatcaggagacacgtactatctgttagacctatagtgaatctacagttgatcagtgagttcagatggcaatgactccctttattttaaagacccccatcaaactttcatatgttctcatgcctattgcctgaatcattaattacctagaagttgcaaaatgcttagtttccaatagtctcacatattctatgtgtactatctataattcttttgtaaaacagaatcttcactattaattaaggctacttagttaccctgctatgtataataatttgaaacaaaaaaacaggataggtgcttaattttttccccttaattgacatttttcagaataaagagttgatacgccgtacacctacagtcgtgatctattgtttgtttcttgaatgggaggacacctaactttcattaggaaattacgcgtttttatgtattcggtgtttcaggttcagtcatatgttctttaatactaaattgtcttatgtttggccagagagtctctccatgttggcttatatgtccttttcatatgacctctgtcttttatgatttccttcctttctttcaagtacaatgagattttccagtactatcttgtatactttcctgctccaattctgaaatcagccatttctccaaagagcctttgtttgtcttagtagggaatggtatttagagtccataaccagcatagtaggagtgttcattgcaatagtgttatttatttatttttttagacagagtcttgctctgttgcccaggctggagtgcagtggtgcgatcttggctcactgtagcctctgcctccctggttccagcgagtctcctgcctcagcctcctgggtagctgggattacaggtacacgccaccatgcccagctaatttttatatttttagtagagacaggggtttcaccatgttggtcaggctggtctcgaactcctgacctcaggtgacctgcctgcctcagcctcccaaagtgttgggattacaggcatgagccaccacgcctggccgctatagtgttattatttctcattgctacttgacctttatagtggacagagctaagatgtatgttttttatgtgcttttgtattttttagagacaggatctcactgttacccagggtggagtgaactggcgtgatcacacttcactgtagccttgaactcctgggttcaggcaatcctcctgtgtcagcctcccgagtaactgggactacaggcactcaccaccacacctggctttttttttttttttttttttttgagatggagtcttgctgtgtcgcccaggctggagtgcagtggtgccatctcagctcactgcaacgtccgccacctgagctaaagtgattctcctgcctcagcctcctgagtagctgggattacaggcacacaccactacacctggctaatttttgtatctttagtagagaaggggtttcgccatgttggccaggctggtcttgaacttttgacctcaagtgatccgccctcctcggcctcccaaagtgctgggattacagacgtgagccactgcgcctggcctatttttttttttaaaggaaaaaaatcagaaatatatacagatgattacaattcaaagttaatatttcaggggttttgtttaacgtcattgatatttacaatggaatctctggttgggtgtggtggctcctacctgtaatccaagcactttgggaggccgaggtggacagatcgcttgagcctaggaatttgagaccagcctgggcaacgtggtgaaaccccgtctctactaaaaatacaaaaattagctgggcatggtggcatgcccgaaatcccaactacttgggtgactgaggtgagaggatcacctgaacccagaaggtggaggctgcagtgagccaagatcatgcccactgaactccagcccggataacagagtgagatcctgtctcaaaagcaaaaaaaaaaaaaaaaaaaattgaatctcttttctgtcacactgaaagtcctttccaagaacatgaacataattacttattttcttctttaatcttttcaagaatttcagggccgggcgcattggctcacgcctgtaatcccagcacttggggaggccgaggtgggtggatcacgaggtcaggagttcgagaccagcctggccaacatggtgaaactccatctctactaaaaatacaaaaattagtggggtgtggaggcacgcgcctgtaatcccagatactcgggaggctgaggcaggagaattgcttgaacccaggagatggaggttgcagtgagccgagatcgcgccattgcactccagcctgggtgacaggatgagactccgtctcaaaaaaaaaaaaaaaaaagaatttaataaaacatgaaagaaggggctggtattatggtattatgtatactcaaaacagtaaatactcaaaactaatactaaatacaatatgactgattatgatgcctgcaatttactttaagataattcagaaaaaaataaatacctatatagattaaccccaaatgacaaaatataacaatttaaaccttagtggaaggtactggagtgtttctttttttcttttttttttttttttgagacggggtcttgctctgtcacccaggctgcagtgcagtggtgtgatctcagctcactgcaacctcctcctcctgtgttcaagccattctcctgcctcagcctcccgagtagctgggattacaggcgcccaccaccatgcccagctaatttttgtatttttagtaagacagggttgccaggcgccgtgactcacacctgtaatcccagcactttgggaggccgaggcaggaggatcatgaggtcaggagttcgagaccatcctgaccaaaatggtgaaaccccgtctctactaaaaataaaaaaattagccagatgtggtggtacgtgcctgtaatcccagctactcatgaggctgaggcaggagaactgcttgaacacaggaggtgaaggttgcagtgagctgagatcacgccgctgcactccagcctggtgcgacagagtgagaccccgtctcaaaaaaaaaaaaaaaaaaagacggggtttcgccatgttggccaggttggtcttgaactcctgacctcagatgatccatccgccttggcctcccgaagtgctgggattacaggccggagccaccttgcccgacctgaaaatttagctaggtgtggtggcacgcaccctgtagtcctggatactcaggaggctgaggtaggaggattgcttgaggccagaagttcaaagccagcctaggcaacatggcagaaccctgtctctaaaaattaaaatgaaaaataaaaatgaattttgggccagccgggtggctcacgcctgtaatcccagcactttgggaggccgaggcaggcggatcaggaggtcaagggttcaagaccagcctggccaacatggtgaaaccccgtctctactaaagatacaaaaaattagccaggcgtggtggcatacacctgtaatcccagctacgcaggaagctaaggcaggagaatcgcttgaacccaggaggcggaggttgcagtgagctgagatcgcaccactgcactccagcctgggtgacagagtgagactctgtctcaaaaaaataaaaaagaaaaaaaaaagaaaaagaaaaggcagtaaagtttaggtgagctgtgaacaaattagctttggcaaaacatatatctctttctgttgaaccttcatgatatcatacagaaatgtaaactgtgaatagtggagagagatgatgagttttgtgcttcagaatgattactctaatgaaagtatggattgaagagatcaagattgtagatgagtctattgtctttgtcccagtggagggaggatatctcaaattagggtagcagcaactgagatggagatgatgggatgaattcaactctttttttttttagagacaaggtgtcacgctgacacccaggctgtttaggcagtggtgcaatcttagctcactgcagccttgaactcctgagtagctgggactacaggtgtgggccaccatgcctggcttattttttaacttttcgtagagatgggttctccctgaattactcagtgatatgatttcgatctgtgtccccaccaaaatctcatgtggaactgtaatcctaacattggaggtggggcgttggatcagtaggaggtgattggatcatggaggcagatttctcatgaatagtttagcactatcctccttggtactgtccttgtcagtgagttctggcaagatctgcttgtttagaagtgtatagtacttcctccctctctctcttgctcctgcctctgccatgtaggatgcttgctccccctttgccttctgccatgattggaagcttcctgaggcctcctcaaaagtggaaactgctatgcttcctttatagcctgcagagccatgagccaattaaacctcttttccttataaattacccagtctcaggtatttctttatagcaatgtgagaaggaactaatgaacccaggctggtttggaactcctaggctcaagcaatcctcccacctcagcccctcaaagtgctgagattatggatgtgagccaccacgcgcagccccagccccaaggttttgttttcttttgtttttttcattttatttgagacagagttttgctctgtcacccaggatgaatgcagtgacacaatcacggctcactgcagcctaactcccgggtgcaagggatccttccacctcagcctcccgagtaactgggaccacaggcatgcaccaccttgccagctaccttttttttttttcggtagagatggagtcttgctagcttgcccaagcaggtcttgaactcctggactcaagcagtctcccactttggcctcccaaaatgctgagattagaggcgtgagccagcgcacctggcctccagtattatttaagaggtagaaataggccgggcatggtggctcacgcctctaatcccagcactttgggaggccgagggggtggggggcagatcacctgaggtcgggagttcgagaccagcctgaccaacatggagaaacccggtctctactaaaaatacaaaattagccgggtgtggtggcacatccctgtaatcccagctacttgggaggctgaggcaggagaatggcttgaacccaggaggcagaggttgcagtgagccgaaatcacgccattgcacttcagcctgggcaacaaaaacgaaactccctctcaaaaaaaaaaaaaaaaaaaaaagaagtggcaggaattcaacgaacaaaagaaatttgggataatggaaacccacctagatatctaggtggataaagattagcgagggtagtttgcaaaggaggagaattgggtatgaagagataataaattaggcatctttagcatatgggaggatgaaagtctttggggtgggctgggtgcagtggctcaggcctgtaattccagcactttgggaggctgaggtgggcggatcacctgaggtcaggagtttgagaccagcctgaccaacgtggagaaaccccatctctactaaaaatacaaaattagccgtgtgtggtggtgcatggaggctgaggcaggagaatcacttgaacctgggaggaggacggtgcagtgagccgagatcacaccactgcactccagaatgggcaacaagagtgaaactctgtcttaaaaaaaaaaaagaaaatctttggggtgaatgaaattgcccatggattaactggagtgataagaactggggatcagttagaggaaaataaaaccacaaactataatgaggagaattggaagcattgagatgtaaggtgggaatacttgagaaaattataaggaaaatgagaattatctgctcagtattaaacaaaattagcatcaaatggtataagaaatttggtaccctgctttttttactagagagtatttttagcatttttctatgtcattaaataatcattaaaagtctttaatgattgtaaagatttaatcgtgaagatgtaccataacatttaacattctcctactattgaatatttaaatctttctaatatttaagcacttacaatttttttagcaaatctctttgaagttctgactctttccataaatgaatttctagatattgaattactgggtcagagtataggactttttctttggggtttttttttgtttgtttttggagacaaggtctctgccatcaggctaaagtgcaatgacatgatcctgtctcactgcaaactctaacttctgggctcaagcaatcttcccacctcagcctcctaagtagctaggactacaggtgtgcaccaccatgcccagctaattttaaaaattattttagatccagagtcttgccatgtcacccaggctggtctccaacccttgggctcaagtgatctgcctcagcttcccaaagtgctgatattacagcatgagccaccattcccagtctatatagaactttttatagttttcttcatctaggtactaaacaattcttgttaaagttattttgattcttttttattattattgctgtgaaaaagattttttggttaagaatttactgctagtatgtagctttattgattttttaatgtatttattttatattcatcactttgaaacttctgtaaaaagcctaccagttttaacttgattccctaaagttttgtaggtaaatcatctgcaaataatgctaatacaatctttcatgttttcaacatatgcctcttatttctgattccttttttttttttttttttttttttttgagacagagtctcgcttgtaacacaatctctgcctcctgggttcaagtgattcttctgtctcagcctcctgagtagctgagattacaggcatacaccaccatacccggctaattttttgtttttttagtaaagatggggtttcaccatgttggtcaggctggtcttgaactcctgaccacaaatgatccacttcccaaagtgctgggattacaggcatgagccactgcgctcagccctgatccatttcttatttctttgagtggatttccttaatctatgttaaacaaaaaagggaaagcaggcaactttatccgtatttatgatttgattgacaacatatccagtgtttaaccattaactgtgttgttactggtgtgtgtttgtttgtttgtttatgagacggagtcttgctctgttacccaggctggaatgcagtggtgcaatcttggctcacagcaacctccacctctcgggttcaagcaattctcctgcctcagcctcccaagtagctaggatcacaggcgtgtgccacccacccagctaatttttatatttttagtagagatagggtttcaccatgttggccaggctggtctcgaactgctgacctcaggggatccacctgcctcgaactcccaaagtgttgggattacaggcgtgagccaccgtttccggcctgctgattattctttataatattaggcattggtgggaattgatgttcactgtatttgatttggggtggggatcccattcatttcagtatgctacaaagagatgaaggaaaaagtttagatttattcttgatcttacttgcttcatggtaaactactggggtcaccacgggagaatttcttctgtttataccagtggatttatagagccagactgcccagactgaaacccaagtttaaagtttttaattgcgtaacctaggcaagttactgaattctgttcctaaatttcttcctccgtaaacctcgaaagatacatggttttgagttaatttgtgaaaggagttatgggttcctttgttttcaaagatgatatcccaccctcttactctgtgagtgttgtgatttgttttttcacattaatattgtaaccgcccaaggggttcaccttgcccactgcctagacagagccaatttatccagatggagagctgcaatggtgaaagagtaattcacgcagagctgcgggagaccagagttttactgttactcaaatctgtctccctgagcattcaggcagcagagtttttaagcataatgtggtgggtggggcgaagccagtgagctgattggtcagagacgaaatcatggggagtcgaaggtctcttcttgggctgagtcagttcctgggtgggggactacaagatcagatgagccagtttattgatctgggtgatccatcaagtgcagggtctgcaaaatatctcaagcactgatcttagcagtttagggagggttagaatcttgtgtcctccagctgcatgactcctaaaccataatttataatcttgggcctaactcgttagtcctacaaaggcaatctagtccccaggcaaggaggtctgctttgggaaagggctgttaccgtctttgtttaaactatgatctataaattaagtttctcccaaagttagttcatcctatgcccaggaatgaacaaggacagcttggaggttagaagcaagatggagtcagttaagttagatctctttcactgtctcagtcataattttgcaaaggcaatttcaatattagtaatcgtgttttttctcaggcactccatttgcacaatgtcctgcctgtgcagtgtctgctttggcccagtaatgcaaatgttttcggggacaaatctgttttggagatcttggttattaagatctttactctgatagaaagcaatgtgcattcagtacactcctcaacttgggatggggttacatttggataaacacctcctaagttgaaggtataaagcggggagtttttggtttttgttttttgcttttgagacagggtctcactctgtcacccaggttagagtgcagtggcaggatcatggcttactgcagcctccacctcccgggctcaagtgaccctcctgcctcagtctcccgagtagctgggactacaggcacacgtcaccacatctagctaatttttttggtaattattttagagacagggttttgccacgttgcataggctggttttgagctcctgagctcaagcaacccacccacctcagccttccaaagtgctgggattacaggtgtgagccatcacacccagactagagtgtgttttttgttgttcttgtttttttgagacggagtttcgctcttgttgcccaggctggagtgtaatggtgcaatctcggctcactgcaacctccacctcctggattcaagcaattttcctgcctcagcctcccaggaagctaggattacaggtgcccaccaccacgcccagctaatttttgtatttttagtagagacgaggtttcaccacgttggccaggatggtctcaatctcttgacctcgtgatccacccgcctcggcctctcaagaagctgggattacaggcgcctgccactatgcccagctaaatttttgtatttttagtagagacgggattttgccgtgttggccaggctggtcttgaagtcctgaactcagatgatccacctgcctcggccttccaaagtgctgggattacaagcatgagccactacacccggcctagagtgtgttttttacttatgatattttcaatttaggatgggtttattgggacgtagccagattgtaagccagggagtatatatatatatatatttgagatggagtcttgctctatcgccaggctggagtgcagtggctaattttttgtatttttagtagagacggggtttcaccatgttggccaggatggtctcgatctcttgacctcatgatctgcccgcctcagccctccaaaatgctgagattacaggtgtgagccactatgcctggcctatatatatatacacacatatatatatacacacacacatatatatacacacacatatatatatacatacacacacacatatatatatatatacacacacacacatatatatatatatatttttttttgagacggagtctcggagtctccctctgtcacccaggctggagtgcagtggcacaatctcagctcgcttcaagctctgcctcctgggttcacaccattctcccacctcagcctcccaagtagctgggactacaggcacccgccaccttgaccagctatttttatttttgtgtttttagtagagacggggtttcaccatgttagccaggatggtcttgatctactgaccttgtgatccacccgcctcggcctcccaaagtgctgggattacaggcgtgagccactgcgcccggtcatggcacctatattttttatatatcacatgaagaccatgtagcttcagcatcactcccctactcgtgaaatgctatagtagagggatagtaagcctattaaaagtaagtacttcaggccgggtgcggtggctcacacctgtaatcccagcactttgggaggcaggtggatcacgaggtcaagagatcgagaccatcctggccaacacggtgaaaccccgtctctactaaaaatacaaaaattagctgggcatggtggtgcacacctgtagtcccagctacttgggaggctgacgcaggagaatcgcttgaacccgggaagcggaggttgcactgagccgagattgcaccactgcactctagcctggcaacagagtgagactccgtctcaaaaaaaaaaagtaaatacttaaagaagccagtttgaagattcaagaaaaatgcatcttagtctgcttgggctcccttaacaaaataccgtagacagtgtggcttaaacaatagaaatttattttcccacatttctgcaggctagaagtccagatcaaggtcttttttttttttttttttttttttttttttttttttgagacggagtctcgctctgtcgcccaggccggactgcggactgcagtggcgcaatctcggctcactgcaagctctgcttcccgggttcacgccattctcctgcctcagcctcccgagtagctgggactacaggcgcccgccaccgcgcccggctaattttttttgtatttttttagtagagacggggtttcaccttgttagccaggatggtctcgatctcctgacctcatgatccacccgcctcggcctcccaaagtgctgggattacaggcgtgagccaccgcgcccggcccagatcaaggtcttgcagggtcactttcttatgaggactctcttcctggcttgcagatgaccttctcgctatgttctcacatgctggaaagagattctctcactctctccttcttccctccctcttcttaaaaggctacaagttttattggattaaagccccactcgtatgacctcatgtgatcttagttacctcctaaaaccctatctcaaaatagttacaattagtggttagggcttcagcacatgaatttgttgaggacactattcagttcatagtattccatcccagactcccacattcatgtccttatttcatgcaaaatacattcatcccatcctaacagcctccaaagtcttaactcattccagcattaactcgaaagtccaaagtctcatctaaatagcctcaccagctgtgaacctgtgaaaacagacaagttatatatttacaaaatataaggaatggagaggcataggatagatattttcattccaaaagggagaaatgggtgacaggccccaggcaaggccaaaacctaggaaggtaaactccattagatcttgaggcttgagaacaatcctctttgggcggatattcggccctccaagccctctggagcctgtggtgggaatggtagtccttctgatctctggataacttttgaggtcattcttcccttttcttgaaggacgacgcatgtttgcagccagatagctctgttgtctggtcctgtagactcttaagtccagcaggcttctttcgtcccacccgattttttctttctcctggctgttattgaggtggttgattacatgtgtggttcacacccatgctaatcacctcatcaaatggttgttcagtcacaccagagtgctctcttcagaacaagctttctctcttttttttttcttttggagatggagtctcactctgtcgcccaggctggagtacagtggcacgatctcagctcactgcaacctctgcctcctgggttcaagcgattctcctgcctcagcctcccaagtagccgggattacaggcgcgcaccaccacacctggctaatttttgtgtttttagtagagacggggtttcagcatgttggtcaggctggtcctgaactcctgacctcgtgatccaccagccttggcctcccaaagtgctgggattacaggcttgagccactgcgcccagcctcaagctttctcatttttttacaatatggacaggctgaaaattttccaaaacctttacgttctggttccttttaaacgtagcaatttcttctttatctctcaactcttacattttactataaacagtcaagaggacccaggccacaccttcaaaattttacttagaattcgcctcagctaaatatctaatttcatccttcagaagttctatcttccacaaaacactagaacacaatacaggcaggttctttgcttctttataatagtgatcaccttttctccattttccaatgtcttatctcatttttctctgagaccccatcagaatggccttaaagaccatatttccactgacattctgttcatgattgtttatgtattctctgagaagatggaggttttctctccagtctccttttcctttcctgagtcctcaccagaatcacctttaatgtccatatttctaccaaccattccttcctggcagtctaggatttttctagcattcacctcaaaactcctccaacctctacccattatctagttccaaagccacttgcacatttttatgtatctgttacttcacagtactaaaatctgtcttagtcagcttgggctgccaaaacaaaataccatagactgggtggcttaaacaacacaaatttattttctcagagtcctgcagactagaagtcccagatcaaggtctggcagggttggtttctggtaagggtcctcagcctgacttgcacatggctgccttctcactgtgcctcatgtggtggagggacagagggagacagatctcttccttttcttatagcaccaccagttctatcagattagggccccacatttatggatttatataacctcaattgcagtagtcctcccttatccacagttttgctttctgtggtttcggttacctgcagtcaactgtggtctaaaaatattaaatggaaattccagaaataaacaatttatacatttaaaatgtacaccattctggctgggcacagtgcactcacgcctgtaatcccagcaatttgggaggccgaggcaggtggatcacctgaggtcaggagttcaagaccagcctggtcaacatggtgaaaccctgtctctactaaaaatacaaaaattagctgggcatggtggcgcacgcctgtagtcccagctactcgggaggctgagacacaagaatcgcttgaatctggtaggaaacaagttgcagtgagccaagatcatgccgtcacactccagcctgggcaacagagcgacacaaagacaagaacaaaaacaaaacaaaacaaaacaaataggattatagatatatgagaggggatttattaggggagttggcccgtgattatggaggctgagaagtcccacaacaggccatctgcaagctggatgccagaagtatggctcagtccaaggccgagggcctgagaaacaagcaggccactggtataagccctagaatctaaaagccaaagagtctggagttctgatgtccaaagacaggagaagaagaatgtatcccagcttcaggagagaggaaatcacctttttgctccatgtgggtcccccactgattgtattgtgcctacctacattgatggcatgtcttcccctgtcagttccctgaatcacaggccagtatcctctggaaaccccctcataaaaatgcccagaaataatcctttaccagttctctagataatccttaatccagtcaagttgatacctaaattattattatttttgtgtgtgtgatggagtttcactcttgttgcccaggctggagtgcagtgacatgattttggctcactgcaacctccacctcttggattcaaatgattctgctgcctcagcctcccaagtcgctgggattaccgacatatgccaccatgtccggctaatttttgtatttttagtagagtcagggtttccccatgttggtcaggctggtctcgaactcctgacctcaggtgatccacctgcctcctttgtcttgcgaagtgctgggattacaggcatgagccaccatgcctggctgatacttaaaattaaccagcacacttactgtgtctaatttataaattaaacttcatcatagttaacatgtgtataagaaaaaacatagtatatatagggttcagtaccatctgctatttcaggtatccactggggatcttggaacatatcatccacaggtaaaaggaggctgctgtacctcctaaaaacctgcctccaaatacagtcacattttgggtttagggcttcaacctaacatgaatttggagggatcacagtttaatccatagcaacacgcaacagtcagtctttcagcctctcatctcctaacccagaaaaagcagagctttggaatcttactttagattatttagataagtcaaagagaagaatgaagaggaagaagagaaagagaagttttatagaggacctgtactcgtaacaataacagtaaatataaaactactactgtcagtgccaaaaaaataaatatatgatctttcttaatcctcaaaatagtctaattatttttcccatcttacagagacacagtgggaggttgagtaatttgctcaaggtcatccagctaataactggtagagctggcatttgagctgatgcaatctgggtgtacagtatatgcttcaaccactattttccacctactccatgcctgacacatgctttcacaaaggcagtctcatttaattcttagactaactgcacaagataggttttattttctttttttgtttcacaggaagaaactaaagctcagagagattaagagaatctttgtggtcacacgtttaataaatgacaatgtgaggattcaaaaacagaaagggagatggaatagattctgactttcttcagggaagcagatcaccactttgttactgtatttgaaagacgagctgggcacggtggcttgtgcatgtaatcctagcactttgggaggccgaggtgggaggatcacttgagcccaggatttcaagaccagcctgggcaacatagtgagaccccatctctacaaaaaataaaactaacctggtatggtggcgtgtgcctgtggtcccagctccttgggaggttgagatgggagaatcgcttggggtcaagaggtcaaggttgcagtgagccttgatcacgccattgcaccccagcctgggcaatggaacaagactctgtctcaaaaaaaaaaaaaaagaccaacgtgggtttatgagtacatttaattgacatcgtatagaatcagctctattttccccttgttctgaacttcactgcaaaacatttagccagaggagctcacccaagtaaatccctcaactaatcagttaaagaggggggaaaaaatctagttctcaagaaaagaaggcataatctcagttgtaagaccactatatggggacttttggcaactttacccagtaccttaacatctagtatgatgttaaaatgcatgctgcacagatgttaacagatacctattcagtacctagaatgacactgtgctagatgctgaagaaagagaaaagcagtgaaaggtataggaaatgaataataggttttgccatgacagtcattgctgttgcatttgtggacagctatttcattatgcatgtattgaaggtcaggcctagagaggagattagagaccctttccagaatacttgggaacggtatgtgattgagaaatgcagccaacagatttggtattcatttgttgcttttgtgcttcttaacatattatgaagaatctatagaattattttatttatatttagaaaaacaaaaacacgaatttctctatgcgcagataatttttttttcctttttttttttttctttttttttgttgagacagagtctcgctctgtcgccaggctggagtgcagtggtgcaatctcggctcactgcgacctccacctcccaggttcaagcgatgctcctgcctcagcctcccgagtaggtgggattacaggcacatgccaacacgcctagctaatttttgtatttttattagagacggtgtttcaccatgttggccaggatggtctcgatctcttgacctcgtggtccacccgccttggcctcccaaactgttgggattacaggtgtgagccaccccacccggcctcttttccttttttaaatagaactaagacaagacttaggtagtatgcacagataatttctaaaaggatagataccaaactctttaacagtagctgctacttagttggagccagggaagagagataatcactttctaattccacatgaatctgtgtaggttttttttagtaagcctttattactttaaaagttatatacatataattatataattatatgtatataatttttaaaacatatatataatttaaaagactatcctacacaactaataaaactttcctccctctctactcaacttctagccatccaagtgaatgctagattacaaataattctgtgtacattttgataatattttatttgataagttcaaagcatagaacagagttcctttaaaagataacaatgcatttaaacctttttataaacactgtagtcttctcatgggcttctttctggaggatgaatggggagtaacccagggacaccactcctaagtgcttagactagaaatggtggggagtcagaaaagaactgtttatggtggaataaaacaaagaaggctgggcgtggtggcttattcctgtaatcccagcactttgggaggccgaggtgggcggatgacctgaagtcaggagttcaaggccagcctgaccaacatagagaaaccgcatttctactaaaaatacaaaattagcttggggtgatggcgcatgcctggctgaggcgggtggatcacaaggtcaggatgcgccatcacgcccagttacccgggaggctgaggcaagagaatagcttgaacccgggaggcggaggttgcagtgagccgagatcacaccattgcactccagcctggacaacacgagggaaactccgtctcaaaaaaacaaacaaacaacaacaacaacaaaaacgtaaaacaaacaagatccctccaattaaaacccatgcctattaaagtgcatgggggcccaatgacctactgtttggcaaaacttgaaggtctaaaagctgttcatggtcaaagaaacaatttatagttgaggtgatggatatgataaatagcctgatttgatcaacctacaatgtatacttacatcaaaatatcacattgtaccccataaatatatacaattattacttttttaaaagattttttaaaactttttaaaaatacacacaaaaagcagtttgtggtctaatttctttttccttgctcagcctcatcttttagcacctgtttatacacatatcacctctattcttgtaacaaaaataggtagaactggccagacacagtggctcatgcctgtaatcccagcactttgggagaccaagatgggaggctcaatagtttgagcccaggaattcaagaccagccagggcaacacaccagaccctatccctactaaaaattaaaaattagccaggcatgctgcacaccagtagttctaggaacttaggaggctgaggcaggaggatcatttgagcccaggagttcaaggctgcaattagtgatgatcatgccactgtactcccacttaggtgacaaaacgagactttgtctaagtaaaaaaaaaaaaataggacgtcccagtaccccaatctatgtctctcctctccatctcccagtccatatttaagctgtgcctcaaatataccatgctgtctaatgcatccacacctttgcatgtgctagtccctcctctaacacacttccacattttccaacgcccttcatcttgtccctctagcaaccttctgtttattcttcaaaagaattatcttagatcccatggcatcatccctaatttgccccaggttttcttggacacttttgttacattcccattgttccactgtattctagcatatacaccaatttttttttctttttttcttttcttttttgagatagagtttcgttcttattgcctaggctagagtgcaatggcgtgatctcagctcaatgcaacctctgcctcccgggttcaagcgattctcctacctcagcctcccgagtagctgggattacaggcatgcgccaccacacctggctaattttgtatttttagtagagatgaggtttctccatgttgttaaggctggtctcgaactcgcgacctcaggtaatccgcccacctcggcctcccaaagtactgggattacaggcgtgagccaccgcacctggcatatacatgaatttttttgtttgtttggttggttgtttttttgtttgttttttttgagatagagtcttgctctgtcacccaggctggaatgcagtggcgctatctcgactcactgcaagcttcgcctcccaggttcacgccattctcctgcctcagcctcctgagtagctgggactacaggcgcccaccaccacgtccggctaattttttgtatttttagtagaaacggtttcactgtgttagccaggatggtctcaatctcctgacctcatgatccacccgcctcggcctctcaaagtgctgggattacaggcttgagccaccatgcctggcccatatacactagttttttactgtaggccgtaaggccctttgaaccctcgatatataatacttgctcaattatgtttgtttagtaaaggaatgattccatttgcaccataaactctcttcctgtgaccagcatatgaatgtgtgtgtggtctctaagaactcgaatgatgcctaagctatccaacccactttcctcagtttttatttacgcagaaattgaaattaacaaactaatttctgagtcttaagtgaaattgttttcgttttatttaaagttacccttgacttacatagttttaaccttctggaaagttcttcttttttctctctctcttcctgttcctgattgccacactggatagaaagttctaaatgaatacttaggtttgaaagtatttttctacatctatttattttgccattctacagatttggctccattgtcctaaggtttcagcacaataaaaatctcgtttctcccagtgcttgtcttgacatcaatgtagcattaaaaagtccaagacttttacagactaatttaagctgaacaaggaaatatcatctggtacctactaagaaacataaatgggcctgggttgctagcagttcctggaagtcactgtgttttccaataaatccatgcaaatcgtaacagggaaagagaagccacaaagcagaggctgggactgttgggatcatgttagtaattaaactctctctcctcttgagactcagtgagagccttccccttacaaaaaaacaaaaaagaccatagcttgctgccaaagcggatctgaccacgcgtcctctcactctaagagattaaaataaagcctcctgcagtccttttctccaaatacacaaagaagtggctgggctgaggctcaagggcacagttccagtccctgttggcaagagaagggcagggctctggttctcccaaagggtgcaaaggacaagaatgtttcctagaaaagaaaccagggaaggagaccaaagtagacctagctgatatggagctgttatgtgaaaactgaaagctgcttcgatactacttcaaagccagattattctgggaactgaagggagactgagccttcaagtaatatgactagggaagtcaagtacaaaaaaaaaagtgagaccaggaaggaacaaagcatgcatttggagctaataccactcattggaagaggttgtttggaaaaggtttgcaaataccacaaaaatgggattcaaagtgtctttatgtattgtgatattcattgcagcactatttataatagcaaaaaactggtagcaactgaaacatctagcagtaggtgaactgttttatagccatggtctagaacattaaaccacaatttaaagttttctgtgcatatttaataacccaagaagatgttcataatataatattgagggtttttttgttgtttgtttgtttgtttgtttgagacggagtctcacactgtcacctgggctagagtgcaatggcatgatctcggctcactgcaacctccacctcccgattcctctgcctcagcttcaagcgattcctctgcctcagcctcccgagtagctgggactacagttgcatgccaccacgcccggctaattgtgtattttttagtagagatgcggtttcactatgttggccaggctggtctcaaactcctgatctcgtgatctgcctgcctcagcctcccaaagtgctaggattacaggcgtgagccaccgcgcccagccgtttttcaccctttatagttgttttttgtttgttttgttttttgtgtgtttgtttgtttgtttgtttgtttttgagacagggtatcactctgtcactggagtgcagtggtgcagccttgactcactgcagcctctgcctcctgggctcaagtgatcctcagcctcccaagtagctgggactataggcatgctctaccacactagggtaatttttgtgtttttagtagagatgagttttgccatgttgcctaggctggtcttgaactctttgggctcaaatgatctgcccacttcagcctcctaaagtgctaggattgcaggcgtgagccaccatgccagccagtctctttttaagaccctcttcctgatcatttgagcccaggaagtcgaggccgcaatgagccatgcactccactgccactgcactctagcctggacaacagagatcctgtctcaaaaaaaattaatgtccttaaaaaacaaacaacagaccaggcacggtggctcacgcctgtaatcccagcactttgggagactgaggcaggttgatcacctgaggtcaggagttcgagactagcctggccaacatggtgaaaccccgtctctactaaaaatacaaaaattagccaggcctggcggcgggcgcctgtaatcccagctactcaggaggctgaggcaggagaatcgcttgaacccaggaggcggaggttgcagtgagttgagatcacaccattgcactccagcttgggcgacaagagtaaaactccatctaaaaaaaaagaaaaacccaaacaaaaagaacactagttgcctctgaagatggtgagcctctgaagatgcctctgaggctcaattttgagggaattctatatcctgttaaaagtccaaggtgcagcatgtaccagatggctgtatgccctcctctttctggggcagggttgacagtaataggcaggaatgtatcatatatatgtatcatatattttgtggttttcagcagtgggttttttttttcctttcttaatagaaattgatgctatttaatttttataccttttgttgttgtttttaatggggtttgagagaagagagtaaagtgaaaatgtcactagtcctttaattagaagtccatatttccaccgggcacggtggcttatgcctgtaatcccagcactttgggaggccaaggcgggcggatcacttgaggtcaggaatttgagagcagcctggccaacatggtgaaaccccatctctactaaaaatacaaattaactgggtgttgtggcgggcacctgtaatcccagctacttgggaggttgaggtgggagaatcgcttgaacctgggaggctgaggttgcagtgagttgagatagcgccactgcactccagcctgggccacaggagcaaaactttgtcagaaagaaagagagagagagagagagagagagagagagagaaagagagagagagagagagagaaagagagagagagaaagagagagagagagagagaaaactcggaagtagactttttttttcttttttttttttttagatggagtcttgctctgtcgcccaggctggagtgcagtggcgtgatcttggctcactgcaacctctgcctcccaggttcaagcaattcttctgcctctgcctcccaagtagctgggactacaggtgcctgccaccacacctggctaatttttgtatttttagtagagacggcattttgcgatatcggccaggctggtctcgaactcctgacctcctgatctgcccgcctcggcctcccaaagtgctgggattacaggtgtgagccacctcacctggcctcttttatttttatttttatttatttatttatttatttattttgagacagagttttgctgctgttgcccaggctggagtgcaatggtgcaatctcagctcactgcaacctccgcctcccgggcccaagcgattctcctgcctcagcctccggagtagctaggattacaggcatgcaccaccatgcccagctaattttatttttagtagagatgggatttctccatgttggtcaggctggtctcgtactcctgacctcaggtgattgacctgccttggcttcccaaagtgctaggattaaaggtgtgagccaccacgtccagcctggaagtagacatttttttattaaccaaaatgaatttagttagctcaccattgcctctacaaaaattgtactgggaccaaaaactttgtatatgagacaacaaattttctaaaatgcaaatcttaaagacaaataatgttagtgtccagaagaaaggttattgggtcagtctttcagattatttccccataacaccaagttccaaaaaacaatttctagtcatttgtgggatgctccagagagcccttgggacaagtaaagttgcagctgtttgtgtgtgttgtaattcaagatgatgtgttgctacatctactagtttggtacaactgttatgatcagatagacctagttccttaaggctgagacacaacagtctggtttctgtaatggaaggatgagtaggctttattctgttttgttgctttttttctttctttcttttaaataatacattctaagcctcgatcctggactttgcaggaaaaaaaaaaaaaagaataatacattctaccctcacatatagtcaattgattttcaacaatggtgccaagacaattcatggggaaagaatactcttttcaacaaatggtgatggaacatccacatgcaaaataatgaagttgactttgggaggccgaggcaggaggatcatttgaacctagggagtttgagaacagccaaggcaacagagtgagaccctgtctctattcaaaaaaacaaaaagaaagaaagaaaaaagaatgaagctggactcctccctcacaccacacacaaaaattatctcaaaaaaaaatctaaatataaagactaaaactataaaattcttaaaagaaaatataggaatcttcttgagcttggatttgctgatgattttgatggcagcagcggcctgtttggagtggtggctactgccatgacaccagcattgaggggactggtgggggagtgggcatggctggggctgcacactccatggagccaacggaagccaagaacaggcgggagccctactcccttctgagttggcagggccagtgcagctgcagccaaccagctgtagctgtggacccaggcatccctgcactcttgactcaggaagccccctgcccccacaggctcaaaaatgcctgctcccactgcctggcctcttcctgttcctggtgcccgctccaattttggagcaaagttgaggctgagcccaggcactgtcgcaacctgccacagtgcacgcatgctcagggcagcactgatacaccagccccctgccaacttggccctctctgggctttgggcagagatgagcacaagtgggaggccgagggggtgctgagggcagctcaccatgggcctgcaggcaccccttggcacaaacagccttggtgccatggacacttggatggcagattgatggcagcaggaggcagacaggctcgtggactgaaaggggcaggtgcccgatgaagccccaccttcaagccagtgacagcctgaagcctgtgggctgggctgccagttccatggactggagtgagaacttatggtgctttttctggacctgcccatggcaaaccatggaccaattcagcactcatttcctcccctctgaagcccataaaaacctcagtctcagccagattcaggcagacaacaggaagacctgcctgctgttaggagctactcactccatgtctcttctccactaagggctgcagagatgatgggatgatttgcctgcgaataggagctacccactccaggtctcctgtctgctgagggctgcacagacattgggatgacctgcctgtggaagggagctactcactgcaggtctcttctcctctgacagctggatactcgttgggatgacctgcttgcagaaaggagctacccactttgggtctcctgagaatggttctgcctctcagtgaagctcctctctatcttgctcaccctctagttgtccgtgtacttcattcttcctggacagggaacaaaaactcaggacctgccaaatagcggctaaaagagctgtaatacagccggtcacagtggctcacacctgtaatcccagcactttgggaggctgaggtgggcagatcaggaggtcaggagtttgagaccagcctgaccaacatggtgaaacccccgtctctactaaaaatacaaaaattagctgggcatggtggcacatgcctgtaatctcagctgctcaggagtctgaggcaggagaattgcttgaacccaggaggcagaggttgcagtgagccaagatcatgctactgcacttcagcctgggcaacagagtgggactctatctcaaaaaaaaaaaaaaaaagagctgtaatacaaatagggctgaaacatatccctctgcttgccacattcccagcaacaagaagaaaagaactgcagccctttggagagcccggcccaggctgttgcgttgcctgctgggctgagtgggcagaacaaacccagtgggtgcaagcaatactcaggcagaaggcatcactggccacagaggtttctagctggcgaagcaacaccccaaggatcctgtgacaatttattgaatatgacaccaaaacagtaatcaacaaaagaaaaaatagataaattggacttcgtcaaaattaaaaacttttatgcatcaaaggacactatcaagagtgaaaagacaatctaaagaatgggagaaaatgtttacaagccacatagctcatcagggattgatattcagaatatataaagaagtcttacaacaaaaagacaaaaaatagggtgggcacagtggttcacacctgtaatcccaatactctggaggcagagagaataataatacattattattattgcttgaagccaggagtttgagacccgcctggaatttgagacagggatgatccctccacctcagtgcctcccaagtagctgagactacaagtgcgcaccaccatgcctggctaatttttttgtattttttgtagatatgaggtttcaccatgttgcccaggctggtctcgacctctgaggctcaagtgatctgcctgcctcagcctcccaaaatgctaggattataggtgtcagctaccaagtatggctcaaaaagtaatttaaaaattattaaaattgccactgtggccaggcatggtggctcatgcctgtaatcccagcactttgggaggccaaggcaggcagatcacttgaagccaggagttcaagaccagcctggtcgacatggtgaaattccatctctactaaaaatacaaaaattagccgggtgtggtggtgcgcacctgtaatcccatctactcaagaggctgaggcgggagaatcacttgaacccgggaagcagaggttgcagtgaggcaagatcacaccactgcactgcagtctgggcaacagagtgacaccctgtctcaagagaaaaaagacaatccaattgaaaaacaggcgaaggacttgagtaggcatttctccaaagaaggtatcaaatgggccaaatggccccaaatcacatgaaaacatgttcaacatcataagtcattagtggaatgcaaatccaaaccacagtgagatgccactcacacctacataaattttttaaaggaaaaataaaagtgttcgtgtgaatgctgagatattggaaccctaatacattgctggtaggcaagaaaaatgatgcagccaccacagaaaacagttcggcggttcctcaaaaacttaaaaataaacaccaaatacaaatggtttgtgtctgtaaccccagctacttgggagactgaggcaggaggattatttgaggctagttcaagaccagcctcagcaacatagtgaaaccccatctctaaaaaaaataaaaattaaaaataaacatagaattaccacatgactagcaattctctttctaggtaaatgcctaaaagaattgaaaataataattcaaacaaaaacttgtatatgaatgttcatagcaacactattcacactagccaacaggtagaaacaaccaaaatgtttgtcactgatgagtggataaacaaaatgtagtatgttaatacaattagaatattatttagccataaaaaggaagaaaatactgattgatgctgtagcatggatgaacctggaaaacattatgctaagtgaaataaattagacacaaaaagctacataggattccatttatattaaatgcccagaagaagcaaatccatagaaacagagtatataagtgtttgccaggggttgggaggagggaaaaatggggtttattataatatggtttatttggggggggggatgaaaatgttctagatttgataattgattgtggtaatggctgcacagctctgtgaacttactaaaaaattgaattgtacagtttcttttatttcattgagataggatctcgctcccaggctggagtgcagtggcttagtcacagctcatggcagcctcaaactcctgggctaaagtgatcctcctgcctcagcctacagagtagctgggactacaggcacacactaccatgcctggctaattatttttatttttagtagatatgaggtctcactatgttgtccagtctggtctcaaactcatgactgcaagcgatccttatgccttggcctcccaaattacagttgtgagccaccacaactggccaaattatacactttgttttattggtttttttttgtttgttttgtttaggtttttttttgttttttgttttcttaaacgaagtctcgctctgttgcccaggctggagtgcagtggcgtgatctcggctcaatgcaacctctgctttccggattcaagcaattctcctgctcagcctcccaagtagctgggactacagtgtgcaccaccacgcccagctaatttttgtatttttagtagaggcagggtttcaccatattggccaggatggtcttgatctcctgacctcatgatctgcccatctcggcctcccagagtgctgggattacaggtgtgagccaccacacccagcctgtaaatgttgactttttttttttttttttttttttttgagacagagtttcactcttgttgcccaggctggagtgcaatggcaaggtatcagctcactgcaacctctgcctcctgagttcaagcgattctcctgcctcagcctcccgagtagctgggattacaggtgcccccaccaccactcctggctgatttttttttttttttttttttgagacagtctcattctgttgcccaggctggagtgcaatggcgtgatcttggctcactgcaacctctgcttcctgggtttaagcaattattctgcctcagcctcccaagtagctgggattacaggtgcctgctatcacacccagctaatttttatatttttagtagagatggggtttcaccatgttggccaggctggtcttgaactcctgacctcaagtgatccatccgcctcagcctcccaaagtgctgggattacaggcatgagtctctgggtatggccttaatcttttgtatttttagtagagacgaggtttcaccatgttggccaggctggtctcgaactcctgacctcaggtgatccacccacctcggcctcccaaagttctgagattacaggtgtgaaccaccacacatggcctatataaattgactcttaataccagaaacagattagctgctctagaaaataactgcctagctctttgaaatgcctcacctagaatgtcctcacaaggagttttgtgtatgccatgtaacctttaagtcaaactagtcttcccaaacacatcgtcattattattattattattattattattattattttgagacagagtctcactcttgcccaggctggagtgcagtggcgtgatctcagctcactgcaggttactcactgcaacctctgcctccctggttcaagtgattctcctgcctcagcctcccaagtagctgggattacaggtgcccaccaccacgtctggctaatgggggtttcaccgtgttggccaggctggtctggaactcctgacctcaggtgacccgccctcctctgcctcccaaagtgctgggattacaggcgtgagccaccgcgcctggctactttccatattattgaaatgtgatgtagtcattttcacatgacaatgtgaataaagagacaaacttagttttataatgtttcacatcaatttatataatgcttatagtccttctaagagggtaaaggcctttgtgaggaatcagccaactggctgcagagtagtggtattatttttttctgtatgagaagggaagtgacactgtgtcattgtgaggtaacagaaagggatttggagaagaacacctaggaataaagggaatagtgttaccttaagactaacacttagggatatatggtaaggtaactaacggtgaccttaagggtgctgattaggtcacattcataaatgggtggggagtgatgccaaagggcacatagtgagcaagttgtggtcacgaggtgattaggacagatgatttagggctggagactcctgtgggtgttaacatgatgactgcataggtgctcaagactgcccatggtggagtattagtccccacaacctaactggcatcaagaatcagggaaaccagaccaggcgtggtggctcatgcctgtaatcccagcactttgggaggctgaggtgggcagatcatgaggtgaggagttcgagaccaacctggccaacatagtgaaacccctctctactaaaaatacaaaaattagctgggaatcgtggcacgtgcctgtagtcccagctacttgggaggctgaggcaggagaatcgcttgaacccaggaggcagaggttgcaatgagccaagatcacaccactgcactcgtagcatgggcaacagagcgagactccgtattaaaaaaaaaaaaatcaaggaaactttcttagaaacagctgggtcttaatagtctcaacaagttaaggagagtttctgggcttcagaccccgcatttccccccatgccctgaagagcattatagaccctgtactttaagaagagtaaaagtcctgagtatcctgttaggaatcatcccatccctgggcagcttctcctcagtactaaccatgaggaaggggaactgagggccctttcacccagagaggactcttcatcctgaagagaagtgagaggacatgtctgaaaaacacaccaagataaagtatctggctgtcatgactctttctagaaaaatctcagtgctgttttacataacctcattcatctccagaattagaatgagtatcttctggcctggtgtggtggctcacacctgtaatcccggcactttgggaggctgaggcaggcggatcacctgaagtcagtggttcaagagcagcctggccaacatggtgaaaacccatctctacaaaaatacaaaaattagccctgcatgatgggggaggctaaggcggaagaatcgcttgaacctgagagagggagcttgcagtgagccgagatcgcgccattgcactccagactgggcaacagagcgagactccatctcaaaaaaaaaaaaaaaaaaaagaatgaatatcttctattacttcatttattgtgccaggtactcttactcttgggcaactgaaatcatggcttcatatctatgaattgagtgaggtggtactcacatcaccagcctcttatgttgaccgaatcaagacctttaactgcctagtagactgacttacaagtggagctgctcaacagataatagtttctttttttttctagacgggagtctcgctctgttgcccaaggtggagtgcagtggcgctatctcggctcactgcaagctccgcgtcccaggttcatgccattctcctgcctcagcctcctgagtagctgggaatacaggcgcccgccaccatgcccagctaattttttttgtatttttagtagagacggggtttcaccgtgttagccaggatggtctcgatctcctgacctcgtgatttgcctgcctcagcctcccaaagtgctgggattacaggcgtgagccaccacgccttgctctttttttttggggggggggggttgtcgtggaaattaagtttatgaatctccttgatctctgaattattccaaacagcaccatcccagcaattccttttaattgtttttagaactacagttgacctttgaacaatgagagggttagggtgccaactcccaccaatgcagctgaaaatctacataaaagattagattccccaaaccactagtagcctattgaccagaagccttcttgataacctaaacaattaacacatattttgtatctttatcatatactgtatttttacaataaagtaagctagagaaaagaaatgttattaagaaaatcataaggaagagtaagtgtatttactattcatgaagtggaaatggatcatcatgaaggtcttcatccctgtcttcacattgagtaggctatcttgctgtctcaggggtggcagaggcggaagaggtggaggaagtggatggggaggcggaagaggtggaggaagtggatgggaaggcgggagaggcaggcacacttggtgtaacttttgttgaaaaaatatctttgtataagtggacccacgcagttcaaacgtgttgttcaagggtcaactgtggtcatattgtcggggttctttagccattaggtctcagaaattagcctgaatttagccagacatagtagcacacgcctatagttccagctgcttgagaggctgaggcgggaagatcacttgaacccagactgcagtgggctatgatggtgtcactgcactccagcctgggtaacacagtgagactccatatcaaaaaaaagaaaaaaagaaaaaaaaaagaaaaggaaagaaattaacccgaatttgtggtttctaacttggcaattagtctttctttgaccccaagtttagactcaatatcttcactaagagccagcccagggggtgcaacttggagcaccagaatgtttgtgtaatactagccatggtaaagaaggtgtcccaggctctcctggtggaggcaggctctgctctacttaactctactccaggcaagagcagacaaagagcagactctttagactggtaagcagaacagactcgtccctcaaggagctcccagaccagggaggggaggagactgtaaatattcaccatgccgtggtaacagcagagatggagcacaaggggaagttcagagaaagatctcagaagagaggtactttgtctaacctgagatttagggaaagttctcctgaagatgatgactggtctacatgacctgagccgagatgggaatgagttgaaaggtaggcttgtgaagaagcaggagaagagcattatagatagaaaactcaaaggcatcagaggccccaagctgcatgctatgatattgggataatagtagtacaaacatagtgcaagacagtggtgtaaagtgagatatttgcttctgagccatttcccttctgttgccacttcctcttcctcttttaagtgaaacattactagcagcctaataattatcatagctgacatatattaggtgttttttgttttgttttgtttgttttgtttttcttgagatgaagtctcgctcttgttgcccagactggactgcaatggtgccatcttggttcactgcaacctctgccccctgggttcaagcgattctcctaccttagcctcctgagtagctgggattacaggcgcctgccaccatgcctgactagttttttgtatttttagtagagatggggtttcaccatgttggccaggctggtctcgaactcctgacctcaagtgatccacccacctcagcctcccaaagtgctgaaattacaggcatgagccactgcgcctggcgtttttttgttgttcttgttatttgtttttttagatgggagtcttgttctgtcgcccaggctggagtgcagtggcgcaatttcggctcactgtagcctctgcctccaggattcaagcaattctcctgcctcagcctcctgagtagctgggactacaggcgcgtgccaccacgcctggctatttttttgtatttttagtagagacagggttttaccatgttggccaagatggtcttgatctcctgacctaatgatctgcccgcctcagcctcccaaagtgctgggattacatgcgtaagcaaccatgcccagccaggtttttactctgtccaactctattctacatcccttaaatttattaacttgttaaattctctaggagtaaatgctgtcattactcccattttacagatgaggaaactgagtcgggggagattaagtaacttctcaaaggtacacatagggccatgtggtctgtcatctctgctttagctgacacatatggcctctatagcctaggctttacatggccagtctccatccagactgactagagtggtgttttgtaaaatatagaggttgatctgcagcctaggtgcaatagaattacctggggcaggccaggcactgtggctcatgcctgcaatcccagcactttgggaggctgaggcaggtggatcatctgcagtcgggagttcgagaccagcctggccaacatggtgaaaccccgtctctactaaaaatacaaaaaaaattagctgggtgtgttggcatgtgccggtaatcccagctactcgggaggctgaggtaggagaattgcttaaatccaggaggctagggttgcagtgagcctagatcacccactgcactccagcctggtaacacagcgagactccgtctcaaaaaaaaaaaaaaaaaattagaattacctggggcatttgataaaacacagatacctaggctccactgtactctgcatgaatctaatggggtgggtgattaagaacctgaatttttttttttgaactccccagatgatcctaaggcacagtaatgtttgggaacctctgggctggagtctctgggttgaaatccaagttttgttctgttttttttaagaatgagtcattgcatctttcaagtattcaaccaagattgtcttcataatcttacacttcattcatctgtctttacaaagttacagagctgaagccatatcctgtttcttcagcactcatctatactttaaaaattctaggccaggcatggtgggtcacgcctgtaatctcagcactttgggaggccgaggcgggcagatcacctgaggtcaggagttcgagaccagcctgcccaacatctgcgaaatgctgtctctactaaaaatacaaaaaattagctgggcatggtggtgggcacctgtaatcccagctactcaggaggctgaggcaggagaattgcttgaacccaggaggcggaggttgcagtgagccgagcttgcaccactgcactccagcctgggtgacaagagcgaaactccatgtcaaaaaaaaaaaaaaattctaatcagatgccagtctcactgtcattctccaatcttcccactataacatatttagttcattgtcctgcccgtgttctaattttgcagttttcctagactgatcctctgtgatccaacaattaattataaattattaattataaattaattaattataaattaataaaaattgtgatcccacaattaatttcaaatttattaaatagaacctgagaaaaaattatgcagtatttttttcattagatgattgtcagcctcctaccaacaagcatatgctagatgttacccatgaaaacttaagtagtcaggccaggcacagtggctcacgcctgtaatcccagcactttaggagattgaggtaggcggatcacctgaggctaggagtttgagaccagcctggccgacatggtgaaaccccatctctactaaaaatacaaaaattagccgggtgtggtggcgggcacctgtaatcccagctactcgggaggctgaggagaatcacttgaacccgggaggcagaggttgcagtgagccgagatcgcgcaactgcattccagcctgtgcgacagagcgagactgtctcaaaaaaaaaaaagagaaaaggaaaagtagtcatgatccctcccttggactcatttccagtgtaaaggttattaacctttttgtaattgggatgtattatgaatgactgctcaattcaacaatgtacctttttcctcagtaattcctaaagaagtcatagaatgtatgtatttctttattgaataaagtctattaaaattattgtgattctaaggcatcttagggaatttcattatgtctcctaaagctagactcaaaaatagaattaggaattattcttctttagcaaccttcattatgtgtcttaaagctagactcaaaaatataattaggaattattcttctgtagcaacctcaagcagtccaggatcagtcctcagctccaccttttgtgacagtgggcaggcacattcatgctctgaccctcaggcttctcttcatcaaataggagccttgtgttagattatctctgaggttttttcacaactagcattttgtggttcaataaacagaataattgtcctgcaaataggtacgtaccctaaatagggttacagataaaatacaaagtgcctaactaaattttagtttcagataaacaataattttttaatgttaagtgtgtcccaaatttcacatagaacactttttttttttttgagatggagttttgctctgtcgcccatgctggagtgcagtggtgcaatcttggcttaccgcaacctccacctcctgggttcaagcaattcttctgcctcagcctcctgagtagctgggactacaggcgcacaccaccacacccagctaatttttgtatttttagtagagatggggtttcaccatattggccaggctggtctcaaactcctgacctcatggtctgcccgcctcagcctcccaaagtgctgggattacaggcgtgaaccactgtgcccggccagaacataattatactaaaaaattattcacttgtttatctgaaattcaaattttattttattttattttcattattttttgagacatagtttcctctgtctcccaggctggtttcaaactcctggcctcaagcaatcttcccaccttggcccccgcaaagcactgtgattataagtatgagcctccatccatgcccagcttaaaatcaaattttaactggcatctgctattggcaaccctaaccccaaagccattgctttttatcccattttgtgaaagtcagtgtcactatttccctactgtgagcttgcttatttctgccttttatccttagcctgaaacaagttgtgaatatcaaatttccactcactccattgctttacctatgaaataaattcccagaacttagaatagttaacagcaatctgtttcctagaactagctgccaggactacacctggacatctgttatttacagcctcattattgacattttgtcaatagttctgacctatgccatgtaatctgttatagtcatagcatgccttcctggaaattttcatttgcctctattcctattgtattatttgggttctttccatatttgtttgttcaagattctctcatcattaaaaacaaataaacaaaaacctctacttaaccctcctcatcccattactgctctacttctcttccttcataaccaagtattatctacatgcattgtcttcacatcctgttattaattccccaatgcattaaattctggctcatcgtcctactacttctcgctgccattgaagctcctctttccagagtcactggttacttcctatttgtgaaatcagtaggaagcttttcagtcccagtcctactggacctctcagcagctctggccaatgctgaccactcccccaatccagaaaccactcttggcttctgtaacagtccctggctccagctgtcctcctacctccttacttccctggccacttgggtcggtcaccttcagccattcttgtcatctgcctggtcctctatgattctcagtgttcgatgcacactctgtagttgtgattgaggtatttacaaaaaactggtgccccactgagccaggttcacgtggaagttgggatgaaacaggattctgagaggacatgggaggaacatgggtttcactttgtttctttattaatctttgaaatgtgtttgtttattcatttagcactcattttttgagcatatactatatctcaaatatcaggtcctaggagtacaaaatggcaagtcaagtccttgccctcaaggagcttgcagtctaggaaaagccaacaaaccaactaatgatgtgaggacagcacacaaaggtaccatggactcagatgcaggagccaggaaagacactagagacaggttgcctgtgatctgagctttaagagacaagtaggaattagccaggtgcattccatatgagttcttccagatagctggagtccacatgcctgagggaatatgacagaagatcaagtgagggagccaggcaaatgccagatcacaaagaccatgtgtcaggtgaaggttatggaattgaaatgtcttaaaactataaggagctttgaagtacgtcaaaatgggcaataaattgatctgattttcattttagaaagacttcttttgacaacactgtggaaagcagcttgggaagggggctccagacttggtgcagtggaaccaataggcatggtcacgtgagaaatcagagtcagaaaaaaaagcagtggcaggggaaattgagagaaggagatagtttctagtgctgctacagaggtagctattctaaggcttgatgaccaattggttgtcaaagataagagggaggaaaaaaaacaaagggtctcccagatgtgtgcatttagtgactgcataatgcatcacctccactaaatgattcatctgttcttcatccctgttagtctggacaccaaaaatatcactctgcctaaaggggggaaacatttctttgagggaaaacccttttgccctatagctaaactaagccattggaaactttttagggcagaaatgtcagaggcatgaacagggcttctggaggagggtgaggtctccaggttctcctggctagtgaagaggctcatgttctcattagcaaactgatggcctccatcgatggccgtgatactcacagggcgtggttcaaagccccagatcatcagggcttctagagtgtacttaatcaggacaggcatttatttaaagtgctctgaagctaactgtcacaaatagggaaccttagtactggtcagttgggaaccaaggttattaccaagaagatagtgtcaggtgtcaagtgtggaagtcaggacaaggccagatgtaggagataagagtgaaaccagacgtgagaaggttggagcgtgtaaaggaaatgggtcacaggacaagcagttcagacctgaggccaagaagaggaaggcaagagttctcttgcggatctcagctagaaaacattgctgtagaacataggtcactttgtttgtttgtttatttatttatttattttaagcaaaagcaagtttattaaggaagtaaaggaggccgggtgcggtgactcacacctgtaatcccagcactttgggaggccgaggcgggtggatcacctgaggtcaggagttcgagatcagcctggccaacatggtgaaacctcgtctctactaaaaatactaaaattagccgggcgtggtggcagccgcctgtaatctcagctacttgggaggctgaggcaggagaatcgcttgaacccgggaggcagaggttgcattgagctgagatagccccatggcactctagcctgggggacaagagcaagactacgtctcaaaaaaaaaaagaaagtaaagggataggccgggcactatggctcactcctgtaatatcagcgctttaggaggccgaggggggcggatcacctaaggtcaggagtttgagaccagcctggccaacatggcaaaaccccgtctctactaaatatacaaaaattagccgagtgtggtggcttgcgcctgtaatcctagctactcaggaggctggggcaggagaatggctggaacccgggaggcagaggctgcagtgagctgagatcacaccactgcaccccagcctgggcaacagagcaagactccgtctcaaaaaaaaaaaaagaaaagaaagaaagtaaaggaataaagaatggctgttccaccggccagcaaagtgggatgctccactaaggacacttacagtcattttctgattatactctaaacaagggctggcttattgagttttctgggaaagaggtgggcaattcccagaactgagggttcctcccattttagaccatagagcgtaacttcctgacgttgctatggcatttgtaaactgtcagtggcactggtgggagtgtcttttagcatgctgatgcattataattagcgtataatgagcaatgagaaccaccagaggtcactttcattgccatcttggttttggtgggattttggtgggatttttattgcaggttgttttatcagtaaggtctttatgacgtgtattttgtgctgacctcctatctcatcctataagtaagaatgctaacctcctgggaatgcaacccagtaggtctctgccttattttagccagcccctattcaagatggaattgctgtggttcaaatgcctctgacatatttcaccccttccttttataagagaacccttaatcctaagggctgtagagggatgaagatccatcttctgtgacttcttcaggctgaataggggcaatgatattactgcctattagggtctcttgtatttggggtagagaggagctctgtcagaaagtgtcagtatggaggctgggtgcagtggcttacacctataatcccagtgctttgggaggccaaggcaggcagatcacttgacatcaggagctcaagaccagcctgggcaacatggtgaaaccctgtctctactacaaatataaaaattagccaggtgtggtggtgggtgcctgtaatcacagctactcaagaggctgcggcaggagaatcatttgaacccaggaggtggagtttgcagtgagccgagatcaggccactgcactccagtctgggtgacagagtgagactctgtctcaaaaaaagagaaagaaagcgtcattatggtgagggccatttataactctgacaaaaggtgatatctgaaagattaataagtgttcaatttaagaaaacattcagtaagcttatcctgcattcctacacaaagagtacaacagcaacacattccacaatggtaaagcaaaataagtaaaattattcaaagtaaactaaataagaagtctttccatgaactgggcaattgttgaaaccaagttgatatggggtcactagcttattccaatatgtgcccagaattagaatattgatccagatttttacattatctatccctcttgtttcttctaagtagcagccagagatcactggttggttctcaggaataagcagtcagtttaaattgcagaaaaaaaacttaaaaactactgataagactagactctggccgggtgtggtggctcacacctataatcccagcactttgggaggccaaggcgggtggatcacctgaggtcaagagtttgagaccagcctagccaacatggcgaaactctgtctctatgaaaagtacaaaaattaactgggcaggcgtggtggcgggcacctgtaatcccagatactcaggaggctgaggcaggagaatcacttgaacctgggaggtggaggttgcagtaaggcacaattgtgccactgcactccagcctgggtgacaagagtgagactccatctcaaaaaataaaataaaataaaatgactagactctgataacatgcgtaccatagtttttgaaacataacgtttttctctccagtctcccatttttactaaagacaaatcatggtaactgatttgctttgttatacttggcctcattatttgtataaagtgcagcaacaataattatttttcacataggcttttaaaatcagctttgatggaattttgttccttagaaggaatctcagataagacttttttaaagctgagcccagccatgggtctgtaccctcaaatatctatatgagttgggtaaatttctctcttcttgagatcccaagataacttggggctcctggacttgtcataaagtgacattctttacttaccacaggtcaagaaccctgtacagggactacgtagacaatgtatgaggccagttttcctaaggggcttttattggcactgtaagtcaagtttgattccttaaaggaaagagtgtcattccagtcaaagccttggtgaaaaaaaagtttctccaattgtgttctgatacaaaagaaaacattcttattgcatttatgcaaataattatattgccataagttaaaaatgctcacaaatggtttctgaattttggagaaattgggcagagagaaacaaatatgcttcaaattttgttcacaggagtatactttactcaattgttaaaagctgttaatagctcaaaagaaaaatttccttggctctgaaaaacaaaagaaaggatcagcaacgttttaagccaaaagttaaaaaaagattgcttcagtcttctgtaggtcaatccatgcagttaactcctgttttgcttgatattcatgaacatttcagctcttcatgagtcctgaaagttttttcctctattttaatgtcacaatttacaaagttattagaaacctacattcaataacacctgttagagttctataattgattataaaaccaccttctaaagaggacaaagacaagacaacaattgtccgtgggtgacaaaacaccttaggatagcctctattaaagccacagttgactaagaattttggttacttctgtggcatacaacaatttttacataacaattataatgattaacaacatacactaagtcatatcagaattgtaggagtttcctgtgattttggaacatataccaataacatatttatacaaatacagcccaaagaaagccaagcgccatttcatatttgacagtgcttcctgtatgatttttataccaaacaagccaaacttcaccattgaattagtgcattattgatgtcaaactcaattctttttttttttttttgagacagaatctcactcttttgctcaggctggaatgcagtgacgtgatcccagctcaccgcaacctctgcctcccaggttcaagcaattcttctgcctcagtctaccgagtaactgggattacaagtgtgagccaccacgcctggctaatttttgtatttttagtagaaacagggtttcgccatgttggccaggcacagggacctcaacagcacatgccagtgaggatgggtctcaaactcctgaactcaggtgatccacctgccttggcctcccaaagtgctgggattacaagcatgagccactgtgcccaggatcaaacccgattcttaataaaactttatagataaatctatccaattttaatgtctgaccataaggtaaggttcttataaacctcttaaaaccctttacaatttttgttaaagagcagattagtgttctaagaaaactctgttgtgcttttattccagtcttcaatttatggataaactgaataatacccctttaattttagctaatatgttcacacacagaatttcttttacaagattaatttttcacaaaccttccacaacttgttcaaacttcaactttttcctatctaacctaaaacaatcctttaactcttaaatctaggcaaaaaaaaaaaatccacattcacatgcctttttataatcttttaccaaaaacacatttcactttccttgcatgtaaaactgatttacttaagtctcatgaactaaaaggcatttatactttttacttttctgacaatatttgatttaagcacctattatttttaaaccagttaatcaaaatgctttcatatcacacacacaacccatataaatacacagacaggcagaataatattcagtagttgttaagatttttcatttgccagtttcttaaatggattatgggtttcagggtagagcgcttggaggaacaggcccaggaaagcacacagtttctagggcatcataagcaggtacagccaaagttggccaattggtgctgcagtctatttcctttgggccagagtttcctcagtattgtcccttcagggttcacctggaagatgttaccgggaaggagtcccaatccagaccccaagagggagttcttggatcttgcccaagaaagaattcaaggcaaatccaaagagtaaagtgaaagcaagtttattaagtaaaggaaacaaaagaatggcaactccataggcagagcagccggtcactttaaattcatttctacaacctaatttttgacatattttagatgccagttcatttactgtaaggcataagattagacttgttggcatcaaaggactgtgacttctaaatgaatgcatataataaagagatattttgcctgcaaggccaatgagacccacttaggatggtcttaggctcagcattatccttgaacagatttatgcatatttctaacttttaaattttcatttacatttgtttattttattatacttcccaagagaagattttctatagaagttttattaaattcttcctattgtacctaaactctgtccccattgtccttctcttgctccagattgtcatatctcagactgatgtgtctatcagaggcacagggacctcaacagcacacgccagtgagtcagtcatcagattatagtagcctgggaatggggtgaatacaggcttgaagtggactagtatctatttccaaggaggcccaatctattgggtaagccattgcagcaagtgtttctagctaacaagatggtcagagtcaggcaggggggccttgctgtgattctgggttgaccttgtttggagctagatgactatagccagcatctaggagagaaaactggttcaagtcactaggcttggaaatgtcatcttgccagaccctcttatggtcttgactaactgggctgggtttattaccagtagaggaacagacaactacatcagggcagaagcccaggcacatggacatggaaaaacatatgcatcactgaggaagagcctagagcttgatgtacacacagatgcttgaggttcaccctggtccattggatactgggtctaaaatatgttttcacattggtaattctaggccttatctgctcctgggggcagaggtcccaccaaatggtgcctgcatgggtccatactgactgtacttgagagaggctaagggtcctataagactggagaaagagggttgatggaaatagattagccttgattgcctggagaatgccagctggttttcagcccccaatactttggagcagaattagttaactttgagtgatgggtggatctttcttttcttctaatttaactttctgttcatgtttagcttacatacagtattgggtcattttttgcataacttttttttatttctaacagactttattttttagagcagttttaagttcacagcaaaattgagcagaagttatagcccttgccccacgcatgcacagcctctctggttatcagcatccccaacccaaatggtacatttgttacacttgattagcccacattgattgacacatagttatcacctggaatccataatttacattaggcattagggttcactcagtgttttttttgttttgttttgttttgtttgagatagagtctcactctgtcacccaggctggagtgcagtggcacgatcttggctcactgcaacctctatctcccgggttcaaccaattctctgcctcagcctcctgagtagctgggattacagatgcctgccactacgcctggctaatttttgtagttttagtagagatggggtttcactatcttggccaggctggtcttgaactcctgaccttgtgatccacccacctcggcctcccaaggtgctgggattacaggcatgagccaccatgcctggctcactaggtgtttttaaaaggaaaaaaaatctcacttactttgagaagactcttgtgctttcacatgtataaatataagcactaaaatcacatgaacatacattcatttgaagttttcaaggaaataatcatgaaatgtttcagattattatttaagtaaaaaatttttctaggaatgcatggacccctgagaatttagccacagactctcagggatttgtggacctcaattggaaaacattgctgtagaacagtagttcattttgaactcatttttgcaagctaaattttgacatgttttagatgctaattcgaggaatgttctcccttttctaagaaaagtccaagcattttttacctgctctaaaagaatatcaacggcttttatgtttcagagactggatgcaagagattgtttaacaaatcccatcccatccctgagaatgtgtctaggcatttgctctttgcaaagccagatgcaacattcataataactaaggctatcttctggccagcactgcaagtgtatcttttgtctacattcttaagtaaccacatcaaatagcatcaacccacttggaaataattttgaagtgatttggatctctcttgtatattttccctataaatccctagcctggtaggcgtgtatattttctgctgcaatatttaatgcttagttccttgcctacatctaagaaatattaattttagaaggaattggatactgatattggcaaatttttatgagactggctaaaggagaaagaagaaggggacctgtgatagaatcttccatgacaagggggaaatactggcctcagtctcctgcagaagcaggagctctggtacacaggtggggtgcccactggtacagctcccatctgacatgaagcaggcaagccaaaggggagcaagagcaatgcaacctggaagacccatcctcagacattctgctattgcccccagacaatggaaggggggcgacagctgtccatgggggcactgctaagagggtgttgatcagcagatcaggactgtaactcaccatagtggtggactgccctgatctggagaccactgcctttcgagaataattcaccctacagaagctatctgagcatcaccagacagggtcttcctgggaattagcacatatcccaaatttccttcagctttgcctgcccacagtcccctgaaagccctccctttttctgggtgtgagaggaatggctgggcatcccttggcttatcctccttcttgcccaccatagccagcatctcagagtgaacatgcacgagggaggtagaaagactccatatccttgttctttacaacttagaaaagcctaagttataggagagagatagcacaatggaatgctgaattagaggtaaataattggtctgtttttttttcaccagtctagttactactattatgtaaaatatctaattttacataccctaaacacccatacccaaacaccttgacaaaggaatcattttacctcccaaacatagtcagtgttgatttcacaaaatatccctagaattactctttctgaggctaacaggactacttagatggttcctaaagtcccttctaactcctgcattctctggttaatgaatcagcattagtcatgtggaaggaaggtatcctcctcaaactctttttaagaatgatctcaaggaatccagagtgctcattaagttggtgaaagagtcagtgcagaatgcagctcatacatatatcctgatgtgatgttggcacctctcaaaaagctgggaaagatgtccaggctggtcataggactcagcccctattatgggtccagcagccagtaatagtaagcaatgtctacttcaaaagatatctctggccaggtgcagtggctcaatcccagcactttgggaagctgaagcgggagcatcacttgagcccaggagtacaagaccagcctgggcaacatggcgagaccccatgtctaccaaaaaagaatttttttttttttttagacagattctcactctgttgcccatgttggagtgcaatggcatgatcttggctcactgcaacttctgcctcctgggtttaagcgattctcctgcctcagcctcccgagtagctgggattacagtcacacatcaccatgcccagctaatttttgtatttttagtagaggtgggatttcaccatgttggccaggatggtgtctaacttctgacctcaggtgatctgccagtctcagcctcccaaagtgctgggattacaggcgtgagccactgtgcctggccaaaacaattgttttaattagctggccgtggttgtgcatgcctgtagtcccagctactcaagaggctgaggaaggaggattgcctgatcctaggaggttgaggctgcagtgagctgtgtttgcaccactgcactccagcctggatgacagagcaagaccctatttcaaaaaaaaaaagatatttctgaggagccatgcttattcaagactcactgctcttagaagaggtgttaatctggccaggtgccgtggctcacacctgtaatctgagcactttgggagggtgaggtgggaggatcatctgagacctggagttcaaggtcagcctaagcaacagactgagaccctgtctcttaaaaaaaataagagagagatgttaatctatattaaacaattgaatagtgtgaagattttgtaaaactttttaaatcaccgattatacaaaagctcttattgaattattaaggagttagcaattactattaatgctgttgaatatgagtaagaacccacttaacttcaatcagaatccatcgatcaagcttaaagccttatctcatagttcccttcctggtctgtcagcattgcctcatagagagggaaatacatcccgcatctgcctcatcatgaacttgggtggccaccaggatattgctcatgaaagctgcttttctttctttttttttttttgagacggagtttcactcttgttgcccaggttggagtgcaacggtgcgatctcggctcactgcaacctccgcttcccaggttcaagcgattctcctgcctcagcctcctgagtagccgggattacaggcgcccgccaccacacccaggtaattttttgcatttttagtagagacgtagtctcaccatgttggccaggctggtcttgaactcctgacctcaggtgatctacccgccttggcctcccaaagtgctgggattacaggcatcagccactgcgcctagcccaaaagttgcttttataaacaggttcaaggccgggaaatccattctcctccacctcccaaagtgctgggattacagatgtgagccaccgcacccagccagttcatagtttaaaacaaagatgatagcagccccttctcaaaacaaatctccttcttgcctggggactagactgcctttgtaggactaacgaattaggcacaaaattaaacattatattttaggagtcatgcagctgggggctacaagattctgaccctccctaaactgctcctaagatcagtgcttgagatattttgcaggcctgcacttgatggatcagctgacaccacccagatcaattaactggctcatctgatcttgtggcccccacccaggaactgacttagcacacgaggacagcttcaattccctatgatttcatctcctacttaaccaatcagcactcctcactaactggcttcccccaacctaccaagttgtccttaaaaactctgattccagaatgctacgggagactgatttgagtaataataatactccggtctccattacagctggctctgcatgaattaattacagccggctctgcatgaattaattactctttctctattgcaattcccgtgtattgataaatcgactctgtctaggcagcaggcaaggtgaacccactgggtggttacaacattagatagcaaattggcaattaaagaatatatctgtagagacaggatcttactaatgttgcccagctggtcttaaactcctggcctcaagcagccctcccaccacctcagcctcccaaaaggctgagattacaggggtgaaacaccacacctggccaaattggcaatttttgaagaaagatttctcacaaggactttgcaagctttatgtactttatttgttgcaataatatgaaatgcatctttctgggaaggagaacacaggtaactgatttcagtgtaatacctagcactcatggcttgctaatcctttttatatcctatgagaaaggaaaaatccaggccgggcgcggtggctcaagcctgtaatcccagcactttgggaggccaaggcaggtggatcacgaggtcaggagttcaagaccagcctggccaagatggtgaaaccccatttctactaaaactacaaaaattagccaggcgcggtggcaggtgcctgtaatcccagctactggggatgctgaagcaggagaatcacctgaacccgggcggcagaggttgcgccactgctctccagcctgggcgacagagtgaggctctgtctccaaaaaaaaaaaaatccattttatggttagatttgggggcttcaagccgtatgtggaaaaggctctcttagggcatttggtctgtctgggctcctaagctgcttagaaatgaggtccttatcacagcagatacttaataaaagtgcactgatctttatatacctcttttttcagtcctttttctttttctcagatcgccttttccttctcttacttatcttttcccctatttcttttctctgcgtatggcttaggttagtccttggcggtgcagagacaccccccagaagttgttggaccctgctgcaacctccctgcagcttagacttcatttcttcacactcctgtatttggagcagcgacgctagtgccaggccctcagaccaggagacagttgctgcctcccacagtggcccttggggggcgatattggcagtcccaggttaggcttccacgtccttggctagccttaaggttagctctgaactctactgacctttgctcgctttggatgacaaaggaaatgatcgagtttagagatgggccagaggtgggtggaggggtggctgaaccttccggcttgcgctgtacaagccacaagaccaaataagggcgtgtgagccgcctccgtctgtattaaagttcagagtgcagtgtgcaaaagtgggactcggttttcagagataagctgttacccaaccctgcttgagttccagcagcggaggctgcgaagtctcctgctctgagcagggctgggtctgggggagaaagacctgggcccctgggcttgcttagctggggagaggaaagaaggggggcttccctcaccagcacctggtgactgaacggacccacaaccccacagattttcacaaagggtttccatgactctcccgactaaaatgtgccggccagtgtgactcattagaatgtgtaggaaaggtcactgtttgaggatattcagccagtgggggaaaaaaccacaacgttattttaatgaacgcttttagcctggcttgtttcctgaacattaaggtctagggcgggacttcgagtttggggccttttccagaggtattaacactgtgtttgctaaatacaccccagggaaggagtcgtcgggcttctacgagtcacacttaaaagactggcaagagttggcttcttctgttgtgttcttagcttccaaaatagtagtctctcctcagagccagacgcgcaatgccatcatgttaatgaggtgcctcatgtgcttcaatagccactgactgatggtaccccgaacctgcctggattcctcacctcttcccctgcccatctctccttcccgcagcaaactgctcatcctgcagcagtccgaacctctgcctcattggccctaagcttcctaagggaagggaccatgacttgtattcatgtttatatccctaaaactcagccctctgtttggcacatagtgtgtgcttagtccagatcacttaaatgtacaatgatttcattctctcggagccccgctctggtggtgtgggtccctgcggacccctccagatgcctttctccagccatggctgcgcaggcaccgagaagccgcaggctggttccagctcacagcctctcgcctcaggcccacactgctcctcctgctgtctgccccagggcttgcgattgcccgggggtccccaagcgggctcaactctgaaagattagagagctaacagcctatggagataaatacttccttctttatcttcctgggaagatggacagttgtaagatgattttcttacaactttcagacagtcctgtgggaacacacagccagtgcccataagtagggccacatcagtagagcatccctgcttccctgccttctccatctgtcagtggcttctgctcctggggtcacagtccccaataaagtacacactaagccttcttcctaggggagctgagactcgaatacattcagagccctttaagaagttctctcacagacttatttttgttttcaaaattcaattcctctaaatatatttctgttcctctttcgtctaagtctcattctttttgactgagaagtcagaagcaaaattaaagtttagtgactagggtttttttgtcctgttatacgttgacattccttaccgtgggtgtatctgtgctttctttgctcttactctgaacatgcccaaaaaaactcttgtgttatctttagcatatttcataagccacaattcaggaagttagagaaattgctccctggtgcagagcaacagaactgccgacctctttccactccaattgcggtgaaagtgatatctctctgcctgagctgacgttggcctttaggcttctctaattatttccttaggttagatttctagaaacacagggtcaaagggcacagatattcacatataggcaagttaccttcttcttgagatgtagcaatttaaactcataacagcagtacataacagtgcccctttctctgtgtctttctccaacacagacatcttgctttaattttgcatttatttgattctttctgagaagcagaaggaatatatgttggccgtttgcatttcttcttttctaaattacctgttttctttccttccttccttccttcctttctttctctttctttctttcgagacgaagtctcactcttgttgcccaggttggagtacagtggctcagtctcggctcactgcagcccccacctcccaggttgaggctattctcctgcctcagcctcccgagtagctgggattacaggtgcctgccaccacgcccagctaatttttgtatttttagtagagatggggtttctccgtgttggccagactggtcttgaactcctgacctcgtgatccacccgccttggcctcccaaagtgctgggattacaggcgtgagccactgcgtccagcctattactattattctttttttcttttcttttttttctttttcttttttttttgaaaccggagtttcgctcttgttgcccaggctggagtgcaatggcgcgatcttggctcaccgcaacctctgcctcctaggttcaagcaatcctcctgcctcagcctcctgagtagctgggattacaggcacgcaccactgtgcccggctaattttgtagttttagtagacacagggtttctccatgttggtcaggctggcctcaaactcctgacctcaggtgatccgcccacctcagcctcccaaagtgctgggattacaggcgtgagccaccacacctagctaaaaattctttaataggtctctttaatgttttaagtagtcctagatttcccctgtgaaccatcttgaaagttttgccttttattctcagttctcttttgctggcttcttatcaggaaacaccacctgactgatttgagatgtaaagtgatggagtgcaaagaccacaggtctctgtattcaaaggtctaggtgcaaggtacaaccttaccggatatttcagagcttgtcttttataatttttgagctgagaaggtcaggtgagataaactgtatggactggaattctgatttgagatgtaaagtgatggagtgcaaagaccacaggtctctgtattcgaaggtttaggtgcaaggtacaaccttaccagatatttcacagcttgccttttatcatttctgagctgagagggccaggtgagataaaccctatggactagaattctgaaaggagagcagtatgtcaacaaaggaggattcagcaactgcctgatgcaatctctagttatcttcgtcctgcaccagcagtatatgatgctatctcatccaactccattcttcagatttgtcatctctcctttacttggataaaacctggctggaaacttggcttcagtcctccatatccatctgttttaggcagacttaactcagctttacatctttgcaaacttacccacgcacatcagcatccgagaaatttccatactctttgattaaaattgcagtaaaagtcacaaaggaccttgcttaaaatgaaaggaagtttctaggaactctaagctcagtaactttatgaccattccctgtagagctgcaaaggtctggatttgaaaagtcataagtagcaagggaattgcgccagaatacctgtcttttgctggagcaaatccattgcctggttcatgcctatgtcacataggcagggcaatgccagacttttcttttctttttttaaagacagagtttcgctcttgttgtccaggctggagtgcagtggcacgatcttggctcactgcaacctccacctcctgggttaaagcgattctcctgcctcaccctcccaagtagctgggattacaggcgcccaccactaagcccggctaattttgtgtttttagtagagatggggtttctccatgttggtcaggctggtctcaaactctcaacctcaggtgatccgcccaccttggcctcccaaagtgctgggattacaggtgtgagctacagcacccggccttcttttttttctcttttttttaattttttttttttgagacggagacttgctctattgcccaggctggaatgcagttgctcactgcaacctccgcctcctgggttcaagggattctcctgcctcagcctcccgagtagctgggactacaggcatgcgccaccacacccggctaattattgtatttttattagaaatggggtttccacatgttggccaggctggtctcgagctcttgacctcaagtgatccaccctcctgggattacaagagtgatctgtcccctcccctcccctcatctccccttcctcccctcctcttcccttctctctcttttgagacagggtctcattctgctgcccaggctgcaggtgcagtggtgtggttatggttcactgcagtcttgatctcccaggctcaagtgatccttatgcctcagcctcccaagtagttaggactacaggtgcatgccactgacctggctaattttttaaatttattttttgtagagatgtagctcagaatggtcttgaagccctggcccaagcaattctccctccttggcctcccaaagtcctaggattacaggcatgagctactgcgcccagcccagacttttttgttgttgttgttgttgctgtttctcacccaggttgcagtacagtggtgcgatcacagctcactggagccttaacctctggggctctggcaatcctcctgcctcagcctcccaagtagctgggaccacacacatgccaccactctcagctaattttttttttaatttgttgagacagggtctcactatgttgcccaggctggtcttgaactcctgtgctcaagtgatcctcccactttggcctcccagagtgctgagattacaggtgtgagccaccacacgtggcccccagatattctttaagtgtaaagcttgactactatttgaggcttgacttctgctttcaaattgattttgaattacatacaagtaatttccaaggagagtcagttaacaagataaaattgtggtctttaccatatgtgcattcttttatattctcagccccattagtgcttgtataagtccatgtgtactaagtaaatctcttttaaccagttctttccaactgtgaaaagaagtaaattatatggggctgggcgtggtggctcgcgcctgtaatcccagcactttggaggctgaggcgggcggatcacttgaggtcgggagtttgagaacagcctggccaacatggtgaaaccccattttcattaaaaatacaaaaattagtcgagcgtggtggcgggcacctgtagtcccagctactcaggaggctgaagtaggagaatcgcttgaactcaggagatgaagtttgcagtgagctgagattgtgccactgcactatagcctgggcaacagagcgagactctggctcaaaaaaaaaaaaaaaaagaaagaaagaaattatatggatttttcagggagcttacaaggataagaaaataggacttggctgggcgcagtggctcacacctgtaatcccagcactttgggaggcagaggagggcgggtcacctgaggtcaggagttcgagaccagcctggccaacatggtgaaaccccttctctacgaaagtacaaaaattagccgggcatgatggcgggtgcctgtaatcccagctactcgggaggctgaagcagaagaatcacttgaatctgggaggcggaggttgcagtgagctgagattgtgccactgtactccagcctgggcaagagagtgagactcaatctcaaaaaaaaaagaaaaaagaaaatagggctgaggcaggaggatcacttgataccaggagtttaagactagcctgggcaacatagcaagaccccatggctataaaattaaaaaaggattaaaaagtagataatattaaaacaccttagatttttcaaagtaatggagctcttttttttttttttttttttgagatggagccttgctctgtcacccaggctggagtacagtgacatgatctcggctcactgcaacctccatctcccaggttcaagcgatcttcctgcctcagcctcctgagtagctgggattacaggcacgcaccaccacacccagctaattttttgatttttagtagagatgtgcttcaccgtgttggccaggctggtctcgatttcctgatgtcaggtgatccacccgcctcagcctcctaaagtgccagcaccaatgtgcccggctggaatggagctcttaatataaattgtacttattagtttttcgtttcagcctataaaatgtacaaatctttctctttaaaaaaaaaaaaacactcctttgatgctgtatgccttgcaagttaacacactttccatctactcttcatagcagagttcttacaagagagatccacgcatgtgcttttcatttcaccattgactcagaagttacatttatgattttatcacaaagaaatattgagagaggcatacagagttatggataaggatgctcattacaacctttttacaatactaaaaaattggaaacaacctaaataattgatgatagggaggctttaaaaaattatggcatctataaatgagaatttggctttgctgcaaatagcagatgacccacaataactgtggtaggaggagggatgctatctgggaccgtgtgatggctcactccccagagtccttgcagcttggtttcctcctttttcattactctactctgtctggcttcatacctaagattacttcacagaccaagagggcttctcctgttctagttatcagcaagagggactagacaaagaaaactggggcaactatcattcaccaactgtctcttaaggaagcatccaaaaactgacctacatgtttatctagggtagaattgttactatattagagaagacagaaactatgcttggacccaggccttgagctgattagggttgaactttaggcaaagaacaactcagatagttagtctaaaaggagttttttctacatttatctgtttgaaatttcccagcatcaaattttatattttcctatattgaggggaaggggccccattaggatattttgcccttttgcccaatgtatacactttttaacccataatctgttttataaaattgcaatctttcggcctggcgcagtggctcacgcctgtaatcccagcactttggaaggccaaggtgggtggatcacgaggtcaggagatccagtccatcctggctaacacggtgaaaccccgtctctactaaaaatccaaaaacaaacttagccgggtgtggtggcgggcgcctgtagtcccagctactcgggtggctgaggcaggagaatggcgtgaagccaggaggcggaggttgcagtgagccgagatcgcaccactgcactccagcctgggtgacagaaggagactccgtctcaaaaaagaaaaaaaaattgcaatctttcaaacatcttgcttacatgcatcagcccccagtggctggtataattccctttggttcatccaaatatagagtacttctgtcaagcaactagtgcttgttaaaccccctaacacacttccttgcatagggtagaagcacaattacttattgtttatttattttaaaaaattgttcattgacttgagttgtaccatgtaccacctaagaaatagaagaataaggcacaggcctagtcttatattttaagtttagctaaagagacacacaaaacaacagaaaataatagaatactattcaaatcaggtacgaagtggggtagtctaagctatagttggtagaggagttcagtgaaggtttctaaatacaaggaaggtgtgtagtaaagaatttggccttgtccaatgagagatctggtctctcattggcttttgggaggttatctgtgtcatacctgatagcagtgtctttgctctgtgagggaagctcacttggagaaaggctcacaggaacaggtgttgctccacgcctttcttttagtggctccaccccctgatagtgggtgagatcaatcatttgcttatgacacagtcctagacttaagagttggaaggactctcaggcagtcatcaggtgcatcccagaattattttatctttactgatgatgcagctcctgccaggtcacatggaaagcaggggagctagaactcgggttctgtgtcatcctaccccatgttctctctgccacatcacattgcctgctcgtgacactggaccactgtaatcatggacggtactctgtccctgagcttctggggtgaaactggctattaacccttgccatgtctcccttccctgagccttgaatcctgcttgccctgtggtgcccccatgtcccccagtacggttctccccgctgccctctataaccaagcacctggcaggttattgcttttccataaagctggaaaactcttagacagtgagaggcaggtggccagactgctgctgtcctttgaaggtttagggccaagactgagcagcaattgaaagtatccattgaacacctgctgtgagtaagacatcgcctctatcttaagcctttgctctattccaatggaaactacagtttccaggctcccatgtccattggcttctggaggggtttgaccagtagatggcaatgatggatgactaggaggtagcagagggaagaaccaggtatttcccccatcctccaccctaagtggcatgtccatcagcaggttggtgttttccctgacatctagctagttctcctgacatctagttcccaccactgctccccttccatggctctgctgtcccctatcttagaggtggtggtgcccttctgctgtggccagtctctgcgttgtttcactgtttcctgtttggcctctcagctcttcccatacagtgggtaaacaggtctctatattaaattccttctgaaatacctggtggtctccattttcttggttagaccttgactgattaatggctcatgtaacatccgtccatcgggggacttatgataggttggagagtcaagaattaaatatatgcagcctgtaatcccagcactttgggaggctgaggcgggcggatcatctgaggtcaggagttctagaccagcctggccaacatggtgaaaccctgtctgtactgaaaatacaaaaactagccaggcatggtggcgcacgcctgtaatcccgattactgacaggctgaggcaggagaatcgcttgaacccaggtggcggaggttgcagtgagctgagatcatgccactgcactccaacctaggtgacagagcaagactccgtctcaaaaaaaaaaaaaaaagtatatatatatatgtatgtaaaatactagtaaaataaaatgtagagattccatacatgtactaaaaatcactgagttattagctgggcttggtggctcacacctgtaatctcagctacttgggaggctgaggtgggaggatcacttgagcctggaagtcaaggctccagtgagctgtgattgtaccaccgcattccagcctgggtgacagagcaagactctgtctcaaaaaaataaattattagccaggtgtggtggctcacgcctgtactcccagcactttgggaggccaaggtgggtggatcacgaggtcaggagtttgagaccagcctggccaatatggtgaaaccctgtctctactaaaaatacaaaattagctgggcatggtggcacatgcctgtaatcccagctactcgggaagctgaggcaagagaatcacttgaaccggggaggcagaggttgcagtgagctaggatggtgccattgcattccagcctaggcaacaagaccgaaacaccatctcaaaaataaataaataaaataaaatattcaggagaaaaaatgaaaaatgaagagtgagtagattagactagtgatctccaaacatttttatcacactcccctaatggcaagaaacaacatttgagcttgcacctccatatttatgtacttatttattcaaactgtgtacatgttaaaccctgttggtatatgatgccttataaaatagctacaaaatataaatgtaaacagaaaaacaggtaaatagaagtcctggtgattcattgctttacctcaatgagtcatcttacacatctcctgtggtgcctaccccactttgaaatcataaaccgcttgtagaagtggccatcaaagagctctgcaagggactgcaagaaagaaggactgggggccaggtgcagtggctcacacctgtaatcccagcactttgggagactgaggtgggcggatcacaaggtcaggagtttgagaccagcctggccaatatggtgaaaccccgtctttactaaaaatacaaaaattagctgagcatggtggcaggtgtctgtagtcccagctactggggaggctgaggcaggagaatcccttgaacctgggaggcggaggttgcagtgagctgagattgctccactgcactccagcctgggcaacagagtgagactccatctcaaaaaaaaaaaagaaaaaagaaagaaagactggggagttctttcttttttttttaaaggagggtttaaattaggctaatgcagcaataacagccacacttttgatgtttacacatttctttacagttcttgaagtctcgctctgttgcccaggctggagtgcagtggcacggtctcggctgactgcaagctccacctcccaggttcacaccactctcctgcctcagcctcccaagtagctgggactacaggcgcccgccaccacgcccggctaattttttttttgtatttttagtagagatggggtttcaccgtgttagccaggatggtctcaatctcctgacctcgtgatccgcccgcctcggcctcccaaagtgctgggattacaggcgtgagccaccgttccggccctttttacagttcttaaatgctttctgacctgtgttatctcattgactctttcaaataatgagaaaggaagtgaatcaaaataggagatagattggggaaaacttgaacgtgtgaccaagaggagtttggacttgatcataaaagtaatgatgctttatcagatgtgtcacatcacagagcagatatttacagtccaaagtccctccctaaatgattggcctcacccacaatgactgggtggagccaccgaaagaaaggcatggagcaacacttcttcctgcatcgcccctcaaaagagcagatcccagttctctgaagataaatggaaggcagccatgaacttccccctctttgaggtttatctttcagcaccttagcacctcagaacaacagagaattagtaggcttagcctactatcctcctatcctttctctcgtgtgctaaagttccatacaatattactggtgtattccctctccaaaatgatgccttaatacatttatgtgaacctctcagccaggagtatgtatgtagctattgtcattccaagacattttctctgttcccattgtccatttctccttcagctgcgtgagctcaggggcttatgttttacacactatattcagctccatttccaggaaacaaaactgaactttgtcctgatcccgctttatccctttctcctgatcctgtccctcacctgctgagctgtctgtcctgctcactgcaggagcactatgagaaccacgtggagtggccgacaggatagggctttgaaaagtacaaagctgccctctgtagaaaacaccctaaagcagaggttcccaacccccaggctgcagaccagtacaggtccgtggcctgttaggaaccaggcagcacagcaggaggtgagtgacgggcaagcaagcattactgcctgagctctgcctcctgtcagatcagcagtggaattagattctcataggactgcaaaccttattttgaactccgcgtgcgagggatctaggttgcacgcccctatgaggatctaatgccccccacccctgtccatggaaaaactatcttccatgaaactggtccctggtgccagaaaggttggggaccactgccataaggggttggcagatgaaccagctgaagcaaaggaaacaattacattatttattgctgaggctcatgttgtttttgtgctgaaaaacctccagtgactctcctttgcccaaagtccgaaagggggccagttaatgacctttgtccatagggaggtgataacagcctgcctggtagggagcagagcccatgtcctctcagtagcattatgggtgttgctgtaggacctgacccaaagagagataggtatcagtttataagattatgaataatattttcaaaaaagggggccaagatgaggccttagtctcatatcaggtgacaccatagatcaaagcacagaaaagagacaggaaggatttcagcaggttggagaaggagataggcctgtgatgtggccaggtggagacacagataagttgaagtttattctggtaaagacctttgtacctgacatgcagcaagtcccagtcctgatggagggaggatgcagccagctccctagtgctaaagcattttggctttgcaggcaaaaacctgcattcaaaatctaactataacagccttgcaaacaagctacttaacttcatcggtaaaggctctgtcaaaggccaggtgcagtggctcacgcctgtaatcccagcactttgggaggctgaggtgggcagatcacctgaggtcaggagttcaagaccagcctggccaacttggtgacaccctgtctctactaaaaatacaaaaattagctgggtgtggtggcgggtgcctgtaatcccagctacttgggaggctgagcaggagaaccattcgaacccaggagatggaggttacagtgagctgagatcatgccattacattccagcctgggtgacagagcgagactctgactcgggaaaaatacataaataaataaatacaaaaattagctgggtgtggtggcacgtacctgtaatcccagctactcaggagactgaggtgggagaattgcttgaacccgggaggtggaggttgcggtgagccgagattgtgccactgtactccagcctaggcgacagagcagtaatcccagcactttgggaggccaaggttgggccaatcacctgaggtcaggagttcaagaccaggctggccaacatggcgaaaccccatctctactaaaaatacaaaaattagctgggcgtggtggtgggtgcctgtaatcccagctactcaggaggctgaggcaggaaccccggaggcaaaggttgtagtgagccgagatctcaccattgcactccagcctgggtgacagagggagactccatctcaaaaagaaaaaaacaaaacaaaacaaaaaaaacctctgtcaaaagatgttcatgaggttaatgaagtaacatatctttgtactttttattaaagtactattactaatattctcataaagtgcatatcatcatgccttgtgctcaagttcatttttaacacatttgtctccccaacttgtggacagagccttgtctcattgatgttgtttcttaccctcagcaacaagcataaagctccaaaagtgtgttgtgtggaattatgcattaatttctagttgtttcatgtttgtaaatctcaccttaactgaaatctgctgaagcttaagggcagggacccttacccccaatgtaactatcataaaactgggcatgcacctactggagcttagggagaaggttgtgcctgattagaaaaggtgttcaagttgtgcttctctcttgtagggatttcccagatgacccaggcatgcagtgggacacagagcacgtggccagagtcctccttcagcacatagaagtgaatggcatcaatctggtaagggggcagctccctgaatggaaaacctgaggtcttggtcccattcacaccaggtggtttctgtaattttttctgtggccaccctcccacttccagtccttctccagggccactctctaaggaggccagaacttccaatgctcaccattaaacctactgaagaacaaacacaccttttgatatctttacgatcttgtgtgagactgaataactaaattatcagtgctcagatagaggcagaagttttttctaaactgtgtcctccttaacaccctcaagcccccgcctttgtcctgccatctaaaaattcaggtcccccagagcctgcccagtgattctcatttatacagaacttgacctcaccttttaccaagcattttcacagagtatcattttaactttaaaagtaaaatttgtgactgggtgtggtggctcatgcctgtaatcccagcacatcgggaggccgagttggacggatcacctgaagtcaggagttccagaccagcctggccagcatgatgaaaccccatctctattaaaaatacaaaaattagccgggcgtggtggcatgtgcctgtatcccagctacttgggaggctgaggctcgagaatcgcttgaacttgggaggcagaggttgcaatgcgcaaagattgtgttactgcactccagcctgggtggcagagtgagactctgtctcagaaaaaaaaaaaaaaagtaaaattatcagtttacattgaagaaactgaggttttgcagaggccaagcagcttgtccaaggtaaacaagtggtggtgaagccaggatttttaagcattgatttcttcattccaaaaaacatgagaatgcattcatacccactaaggaagaaaatttttgatgcaattagagcaatagcagagatttgtatttactgcaatggtggacaagcctagcaacaccagtctcagctcttctaggatcagcaggactgcttagcccatagtcaattttaaagctgccaaggaggcttactgtctaccactcaaaaaatatataataatccttcatgaggtaatatctaaaattccacatttaaagcctcaccatttggcttaagttttgattaagttctcatgaaaacatgaatcctgctggcagagaaacatattaggcttttttttttaattttttttttttaagacacaggttctccctctgttgcccaagctggagtgcagtggctgcctcagcctcccaagtagctagaactataggcacatgccatcatgtctggctaatttcttttttcttttttttttctgagacagagtttccctccatcgcccaggctggagtgcagtggcgggatctcggctcactgcaacctccgcctgccgggttcaagtgattctcctgcctcagcctcctgagtagctgggactacagacacgtgccaccacgccaggctaatttttgtatttttagtagagatggagtttcaccatgttgatcaggctggtctcaaactcctgacctcgtgatctgcctgcctcggcctcccaagtactgggattacaggcatgagctaccacacccagccaatttttaatttttttttttttttttgagacagagtctcgctctgttgcccaggctggagtgcagtggtgtgatcgccgctcactgcaagctccgcctcccgggttcacgccattctcctgcctcagcctcccaagtagctgggactacaggcgcccaccaccacacccagctaattttttgtatttttaatagagatggggttcccctatgttagccaggagtctccatctcctgacctcatgatccacccacctcggcctcccaaagtgctgggattacaggcgtgagccaccacgcccagcctaattttttttttttagagacaggatcttgctgtgttggccaggctggtcaccatctcctgggctcaagctgtcctccctcattggcctcccaaagcactgggattacagatgtgagccactgcatcaggccctgagagcagattttcattgatatattcattggactgtttctgttctctaatgacagaaatacaactgaaatttagtacacacaggccaaaacaggcacctaatttgctcaccctgagtcacctaaaagctgagctgcagatgggcctcaggtaccctgaccctaccacgactcatctccatctttctctgcatgttggttttattccttttcctggctggaaaaatggtcaccagcagcttgcaggccccacactccctgcctacccttcccagaggatctgagcatgaaagcggtaatgttagatccatgggcttaggaataatgcctagctgtgctgactggggcttgccttggttctcttactcctcctcttcagcccacacagtttgaagttctcagagcctccacagcctcgatatgtagacagagctgaggttggaggttgtcatggccagcctgaagtactccctggcacctcattttccatgctagtgccttcccagtccctaaatactctctgtcctcccctacttcagtgcacgagaactactggtcttccaaattgctcctgctgtagggtactcttatctttttttctttttcttttttttctgtgagacagagtctcgctctgtcaccaggctggaatgcagtggcgcgatctcagctcactgcagcatccaactccctggttcaagtgattctcctgcctcagccttctgagtagctgggactacaggtgcgcgccaccacgcccagataatttttgtatttctggtagagatggggtttcaccatgttggccaggatggtcttggtctcctgacctcgtgatccgccttccccggacttccaaaatgctgggattacaggtgtgagccaccgcacccaggctactctcatctttttaaacttggaatccaaaatcctctataatctgacccttactgaagtcctgaacactggtgaacaacgttggtctttgccgaggggccagatttctttttcagaccatgttgcagctgaccttgaccctgagtatctgagggaggagctttggggcacaggcagctctgtgtgccattcttgctttcagaagagtctcccatgtttgggtcccagaaaagtgatctgtggtccaggcacccctccagaccttcttctcaaagaagagctaactttgatgagccctttttgaggctccggcagtatttgctgtgtgtactgcaacatatgttgctgtttattcttaaaagtgcagaccacgtcttgcaaactagactaaggcctgtgaaggccaaggctgtgcctggtatctttatatctccaagaactagagcaggcccctggacagtgctccttaccaaactgctgcagctgttaactgccacctccctgcctggaagtctttcctgtggtgctgagctgctcacacttactcaagtgagtcgacttttattgtcaagagaatcttcaattgatttaattgctataaacaaggaaatcgtataaaacagctccttactaataaatttctccttttttttttttcctgaaatgaagtctcgctctgttgcctaggctggagtgcagtggcatgacctcggctcactgcaacctccgcctcccgggttcaagcgattctcctgactcagcctcctgagtagctgggactacaggtgcatgccaccacgcccagctcatttttgtattttttttttctttttttgagacagagtcttgctctgtcgcccaggctggagtgcagtggcgtgatctcagctcactgcaaactctgcctcccgggttcacgccattctcccgcctcagcctcctgagtagctgggactacaggcgcccgccaccatgcttggctaattttttgtatttttagtagagacggggtttcgccgtgttagccaggatggtctcgatctcctgacctcatgatccgcccgcctcggcctcccaaagtgctgggattacaggtgtaagccactgcgcccggcctactaacaaatttcttgtgacacacttgctattaataaggaaactcaagttgacagtacagttgggaataatttctctggcctgcacttagtgccatagtagaagtataggatcatgctaacaccgttgctagtgtagctataactggccatcattcgagctgagcatgggtttccattcagcccagaagtttcaactgcacacaagagatgatgaagcagcaacacagaagcacagacagaggtgtggagcacagtctaagccatggggagagattttctcacctgggctgcaccaggatgagagcataagctctccaccatcatccaaagcaaagctggctctgcagccatcaatgcaggaaactgggttctgtctggtcccagctctgtagtactgcaggaacatcataaagaccataaggaatggcagacaggacagagttttgaaaagtacaaagctgggtgggtgcaatggctcatgcctataatcctagcactttgggaggctgaggtgggaggatcacttgaggccaggagtttatgaccagcctgggcaatatatcgagactccatctctattttttaaaaaataaaataaaataaatgttaaaaagaaaagtacaaagctaccatccttggaaagcagcctaggggggtagtagtgtcttctctgggtgttaagcaggctaggtcctgggcctcaacccctctacctcaactttcattcagtaagtatttattaagtacccaatatgggacatttgctttaggtggtgaactgggaatacaacagtgagccagaagcacttagtccctgctcccatagagcaggatgtgtcagtacagcactattgcgcatttgagactggataatttgttgtgggggttggccttgtgcattgaaggatgtttagctgcatccctggccactacccactagatgtcagtagcaatccccctcctcagttgtcacaatcaaaacgtctctaggccgcaagcagtggctcacacctgtaattccaacactttgggaggctcaagcagggggtggattgcttgagaccagcctgggcaacacagtgagaccctgcctctacaaaaaaatttaaaaattagctaggtgtggtagcatgcacttataatcccagctactcaggaggctgaggctgaggtgggagaatcacttgagcctgggaggttgaggctgcagtgagcatgatcacgtcacgtcactgcactgcactgcagcctaggtgacagaatgagagcctgtctcaaaaaaacaaacaaaaaaaacctccagaagttaccaaatgaccctggggcaaaactatcctaggtgagaaccagtgtcttagaaaccagagcagccccacagttacctatttattggggtctgggtaagattttatttgaacaaatacttttgcactttaggaaaaaataaaagtggatggagttttgtaaagaatgacaggtgccattgtcatgtacaaatctgcaaagttcagagagctgaatacaatttagcttaaccctacttgcaacagaaagggggaaactacaaggtacaggatgagagaaaaaacaaagactggagaatttcaaaagtgatggagctgaatttcatgtgaccccaaatccactaaccaagggactgcctgccctccagcacccttctgatatccatccagccagagtgctagccagctccacctgatggcaacagcctgggagttgagatactctagggttttctgctgtacagttttcttttttgtagcaagatggggttcttgttcttgtcgcctaggctggaatgcagtggtgctatcatagcccactattacatcaaactcctgggctcaaatgatcctcctgcctcaacctcctgagtagctggggctacaggtgcacgctagcaagcccagctaattttgttgttgttttttgagatagagtctcactctgtcaccaggctggagtacagtggcacgatctcggctgacttcaacctccgcctcccgggttcaagcaaatctcctgcctcagcctcccgagtagctgggactacaggcacgcgccaccatgcccagctagtttttttgtatttttagtagacacggggtttcaccaacctggccaggctgatcttgaactcctgacctcgagatccacccaccttggcctcccaaagtgtcgggattacagacgtgagccaccgcgcccagcctcgctgtacagtttttaaacactatttcttcacttaaacctagcaaggaaagtagagctggcattacttttcctgatcttacacatgaggaaaccaagacattccatgttgaaataacttccagtagtaaagttttctgacttgcccaaggtgctgtaattaactagagttagagataaaagtagactttgatctcccccaaccaccaccccaccacccaccttgttctgcatggaagggtgggatcagaaccaggtgtttgagttatacgatctttttttttttttttttttttcttgagatagagtttccctcttgttggccaggatggagtgcaatggcgcgatctcagctcaactgcaacctctgcctcctgggttcaagtgattctcctgcctcagcctgccaagtagctgggattacaggcatgcgccaccaggcccagctaattttgtatttttagtagagacggggtttctccatattgatcaggctggtctcgaacccccgacctcaggtgatctgcctgcctctgcctcccaaagtgctgtgattacaggcgtgagccaccgcacccggctggcttttaaacaatatcaacaccgaaggggtgagattcttagagtgacagttcagagacagtcaggagagtaggggagatggaaacacctgctactaatggtaaggctcggctgcgactgcccagccctgggaaagcctttctctgcagagcacttgatcccacggaaacttggcagtaagagctttaaaaggaaagggagagggaaatgaaagcgagagggttctgtcagggagctgctcggttttaacaaaggaggccattcccatggcacaacccttctttctgttatcaggagaccatgttgacattaccctgaattcacctaaactggtgctgactcttcatgaggttcccaatgattcctgaatctcatgatggccagaagccggtctcctcatggccatggcactctgagaggatgtttggtgactggaccttgtgttttgtggttgtttccactgtctccacttcttagatttggtcctcttgctaggccatagggtgtgccagtgcagtaaagtccagggcaccttggcctaggtgctaactccttcaaagtttctgctttgtttccacagctgcatgtttccagcctgtgctgtgcacgctgggtgggagagggcaacttgaatgcaataactacacctagcacagttggcaagactctttctttactatcatgaaggaaaccacatttaaaaatgtgtccccttatgtatcctctgggcattgcatatagttctgtcatcaaaggtaagaatgattttaaccccagtgcctggtacagagtaagtgctcagtaatgtcattagctgttattacagctattaccacaacctcaaaaaaaaaagtttggctgagcacagtgtcttatgcctggaatcccagcatttcaggaggctgaagtaggaggatcgcttgaccccaggagtttgagaccagcctgggcaacatgacaagaccttgtctttacagaaagaaatttttttaagtagctgggcccggtggcacgtgcctatagtctcagctacttgggagaggaagacaggatttcaaggagcccaggggttcaaggttacagtgagccatgatcacaccattccagcctgggcaacagagggagaccttgtctcaaaaaaaaaaaaaaaaagcctggatgcagtggctcactatttttaaaaagtaaaataaaataaaataaattttaaaaagaaaagcacaaggctgggtgcagtggctcatgcctgtaatcccagcactttgggaggctgaggcaggtgcatcacgaggtcaggagtttgagcccagcctggccaagatggtgaaaccccatctctactaaaaatacaaaaattagccgggtgtggtggcagatgcctgtaatcccagctactcaggaggctgaggcagggaactgcttgaacccgggaggaggaggttgcggtgagccgagattgtgccactgcactccagtctgggtgacagggtgaaactccgtctcaaaaaaaaagaaaattacaaagctgccatccttggaaagcagcccagggggatagtagtgtcttctctgggtgtcaagcaggctaggtcctgggcctcaaaccctctatctcaactttcattcaataaatatttattgagtacccaatatgggacattcactataggtggtgaactgggaatacaacagtgagccagaagcacttagtccctgctcccatagagcaggatgtgtcagtgcagcggcactattgcgcatttgagactgtaatcccaaaatgcctgtaatcccagcattttgggaggccaaagcaggcagattgcttgagcccaggagtccaagaccaacctcagtaacatagtgagaccttgtctctactaaaaatttaaaaaattagccaggtatggtggcatgcaccatactacttatacactaatttaaaaaagccactgcatccaggctttttttttttttttttttcgagacaaggtctccctctgttgcccaggctggaatggtgtgatcatggctcactgtaaccttgaacccctggactccttgaaatcctgtcttcctctcccaagtagctgagactacaggcacgtgccaccgggcccagctaattaaaaaaatttctttctgtaaagacaaggtctcgccatattgcccaggctggtctcaaactcctggggtcaagcgatcctcctacttcagcctcctgaaatgctgggattccaggcataagacactgtgcccagccaaacatttattttttgaggttgtggtaatagctgtaataatagtgtataagtagtgtattaatagctgtaaaagtagtgtcttcccagctacttaggaggatgaggtgggaggattgcttgagcccaggaggtcaaggctacggtgagctatgatcatgccactgcactatagcctgcatggcagagcaggaacgcttaaccatctcatagataactagattagtcttcttctagggacctaaagggcaaagcgataaagcgagcataaaagcagtttgaaaagtaagtgacagaagcatgaaaagcatcgtttttgaattagttcttacttggattccattgatgagcacaaaacagtaatctggttcaggatagaaatataaacattaggccgggcacggtggctcacacctgtaatcacagcaccttgggaggccaaggcgggtggatcaccaggtcaggagttgaagaccagcctggccacataacgaaaccccatctctaccaaaaatataaaaaattagctaggtgtggtggcatgcacctgtaatcccagctactcggaaggcggaggcaggagaattgcttgaacccgggaggtagaagttgcagtgagccgagaaattgcgccactgcgctccagcctggccaacagagcaagactccatcttaaaaaaaaaagaaagaaagaaatataaacattaggccgggcacggtggctcacgcctgtaatcccaacactttgggaggccaaggcaagcggataactttagtcaggagtttgagaccagcacagccaacatggtgaaaccctgtctctactgaaaatacaaaaattagccaggcatggtggcacgtacctgtagtcccagctactcaggaggcagaggtgagagaatctcttgaacccaggagacagaggttgcagtgagccaagatcgcaccactgcactctagcttgggcaacagagtgagactccatctcaaaaaaaaaaaaaaaaaagaaagaaagaaagaaaaaagaaatataaacattaatcattagaagactttcttgaattatggcattctgttgttaaaattcttccattacccaccacttctgttgactttgtcaacatgttaataaattgaggctcatggtggtaactttaaagttacaggatcctaaaatgtcttctgaattattaaaaagtgtgtgtgtgtgtgtgtgtgtgtgtgtgtgtgtgttcagtgccatgaacagtgaagttaactatgtacttatcttttcaaataagggatccagtaatgactctcaagatgatccttctaaccagagtgtttgcttgcctgaaatacgatattccctcacagatgagctctccagaccccaggagaaagaataactgatcgaaactcatgtacttggttggtagctgtcagaataagagtgcaggtcttctgattctttttttttgagacagagtttcgctcttgtcacccaggctggagtccagtggcgtgatattggctcactgcaatctccgcctcctgggttcaggcgattctcctgcctcaacctcccaagtagctgggattacaggtgcccaccaccacgcccagctcatttttgtatttttagtagagagggtttcgccatgttggccaggctggtcttgaactcctgacctcaagtgatctgcccgcctcagtctcccaaaggtcttttacacagtgcttcttcctgcagcgtagcacgccttctcacatagaggatgcttgtaaagagcgtggactgtggagtcagaaagatctaaaccccaagaacagctccaccactcagtggcaaggtgatcacagctttggcctctgcttcctgaacttcctcaggtgtaagatagggttaatactatgtctttgctcaataaatgttagccactcttattataacagagggcttgctgtacatgcagtcattatgctttacagtttaaaatagaaagaccaagagcgaatcccttcccagcccattccaatcccagttccaggttccttcatccatgcaggatggtcacctttccttggggacagcttgcctcttttcatcacccctaatcaatcattctatcctttcttcagtccttgttgtcgtttttatatttcttttattatttgagttagccttattattattattattcaaattattatttgttttttctttttttttagcaattattattatcatttatctcagaaaatctctatgacaattgtgtgaagtacaattatgattacatatgagataattgcaccacagacatgttatataacttgcaaaaagccacaaacccaataagtggtaaagcccaaagcacagaggttttctttctgttcttttttttttttttttgataattcttgggtgtttcttggagagggggatttggcagggtcataggacaatagtggagggaaggtcagcagataaacaagtgaacaaaggtctctggttttcctaggcagaggaccctgcggccttccgcagtgtttgtgtccctgggtacttgagattagggagtggtgatgattcttaacaagcatgctgccttcaagcatctgtttaacaaagcacatcttgcactgcccttaatccatttaaccctgagtggacacagcacatgtttcagagagcacagggttgggggtaaggtcatagttcaacagcatcccaaggcagaagaatttttcttagtacagaacaaaatgaagtctcccatgtctacctccttctacacagacacagcaacaatctgatttctctatcttttccccacctttcccccttttctattccacaaaaccgccatcgtcatcatggcccgttctcaatgagctgttgggtacacctcccagacggggtggtggccgggcagaggggctcctcacttcccagacggggtggccgggcagaggcgcccccaacctcccggacggggtggctggccgggtgggggctgcccccccacctccctcccggagggggcggctggccgggcgggggctgcccgcagccccccacctccctcccggacggggcggctgctgggcggagacgctcctcacttcccagatggggcggctgccgggcggaggggctcctcacttctcagacggggaggcggggcagagacgctcctcacctcccagacgggggtcgcggccgggcagaggcgctcctcacatcccagatggggcggcagggcagaggcgctccccacatctcagacgatgggcagccgggtggaggcgctcctcacttcctagacgggatggcggccgggaagaggcgctcctcacttcccagactgggcggccgggcagaggggctcctcacatcccagacgatgggtggccaggcagagacgctcctcacttcccagacggggtggcggccgggcagaggctgcaatctcggcactttgggaggccaaggcaggcggctgggaggtggaggttgtagctagccgagatcacgccactgcactccagcctgggcaacattgagcactgagtgaacgagactccgtctgcaatcccggcaccttgggaggccaaggctggcagatcacttgcggttaggagctggagaccagcccggccaacacagcgaaaccccgtctccaccaaaaaaatacgaaaaccagtcaggcgtggcggcgcgcgcctgcaatcgcaggcactcggcaggctgaggtaggagaatcaggcagggaggttgcagtaagccgagatggcagcagtacagtccagcttcggctcggcatcagaaggagaccttggaaagaggggagggggaggggggggagagggagagggagagggagctatttgttttttctttaattcatttgtgtagaaatgaaatgttggaatacagactgagcttgtagttaataaacagatattgatatagctgtgaaaatggaaacagaggcaatctatgaataaatacactttttccatgaactcaaccccaggacacggtggacattgtccttcaaagctttttttgccctcattatggcatgagaaaaagagaaccagtaattcaggctgtatctgcataaacagagttcacttagaagctagccaggaattctaaatgtgctaataaatggctaaaccaataagcaacaaagatattctgaacccaagttcctatcatggctgaattccactctgctccactggctaggaacaagagtaaaacatcaaaccctggaaaacagtctctatgtggtcaaccacagcactagctacacaccactgatctgctcagaagtcacttcagatagatgctgcatttgaaaagtttcagggttctgttctctccttcccaagggaaggagacagctccattgaagttgaggtggtggagaaggcattcagtgaaaaccctgtgtttctctacaggtggtgactttcgatgcagggggagtaagtggccacagcaatcacattgctctgtatgcagctgtgaggtatgattctccgggtgatggatgtgggggagggtttgtttatttgattagggctcatggtttaaagtctaaagcactttcccacttgttatctgagcccatgaaactcactgctggcttatcttctagccctttttggccatgttgctcactgcatctcaccatgtcctctcgctgagaaatctctctcaagtcctagtacgaatgctcgtctcctaaacagctgaattcttttttatacactgaatactgcgaatggggtaattgactttattcatctcttttctgtggccacaggaagcttgagggccaaatttgcaagccctgtggcactggacaagactttaaggaatgagtgctgtcaatcagtgtgcctccaccttcaccatcttcttccccttactctcacttccgtcatgtgttttatacaactctcaaatctttcttggagaaggaggatatacatacataatatgaaatgtgtttgttcttcacagtcacccgattttactgatatttatttgcattttaccaataaaaagaaaatgcaagctcaaaggtattgagtgacatagagtcatacaaacatagatgtgtttcctgtcccctagcaaagtgcttctcctgggcccctgatcagtggtgtggcaggcctgtcccagctactgaggaaggaaagaagcaacttgaagggaaggacttatttaataaccttcttctaaacatgcttaacactcagactgaagcaatgcaatatgtaaagttggaaatgacctcaccaaccattaagtccaatcactgggaagtggtttgcccagcaccacaaggttaaactatggcagaggcagaattcaggaatcctagttctccattcattattctgtcagatgtatgtgaagaccaatccaaactgaagaccctccttgtccttaaattttacatcacttggtggaagatgctagaattttacccacatactctttctaggcagatttccctgtttccttgactatggaatgaggggaggctagactgttctccctgtaaagactattcggttcctggtccagccagcagccacagctttagaagagacgtgctcctagtcgcattaggtcccttcaaattcaggaaagaaacattccctggttacagtctgaaatacaaatttttttgatgatatatggaaaaatgaggcagccccagagtggtctttccaaccacatggttactctgaggccttgagcttccaagactagcatggacagcaagccccatggagaactggaaaaatggtcccacctcattctggatgcacactgagcctggtgatttctctccgagaatttacactgcaccagagaaaggatcaggtcaggtctattgcaaacaaagagtacctcaacaggcagggggctggggcacttgagattgagtcacctggtcccattcctggtccagtcaccactgaagtggagaaaatagagaaggcgtcattctgggcagagaaagaacccaaggggacaactctgtgtagatagaactgcctggggccattttcctcagaagaggctggagtgccacaggctctcagcacgaaggagggccactgtgcttcagataaaacaattcatggacatgccaccaatctgccacaacctttttccccacagtcatctcttgcctgctaaattcgttagactcacgttagtcctcagccaccttgaaccttctgtggcatctggccctgcctgtccgtcactgcaatgctgctttgacttatatggcaccagcttgccctcctcactctggcctttctggctacttctcattctcttcccggcttccctcccaccagtggccccttggtccccctgtccccagggctcactccccagtcctcctcagcacagcttcccctgtggctttaagggctataagctctacttccagacagcgcctctagctcactgctttccctggacatcagaatatccacagggctttgcccagagtacaggacaagccacttcattctcaggatcccagaaagttttttcagtcttttcttttctttctttctttctttctttttttttttttttttttttttttttgcgacagagtctcgctctgtcacccaggctggtgtgcagtggcgtgatctcagctcactgcagcctccgcctcctgcctcagcctcctgagtagctgggaactactggtgcatgccaccacgcccggttaatttttgtatttttattagagacggagtttcaccatattggccaggctggtgccgaactcctgacctcgtgatccgcttgcctcggcctcccaaagtgctgggtttacaggcgtgagccaccgcgcccggctcctttttcaggtttttctacctctcaggctctgccaggcagtcagttccatgaatttgtcaattgtctctcaacttctcttgtttaacccctgctcccaagagtctctgttcatatgtgtgtctgtgtgttgctggggctaccttcccaatccttctctgcccccagctttctaaacaacaaagtggggaagagacttggagctcattgcagttgacactcccctcctcttaaggtggcgagcacagaatgacctgcactgtcagaaggtaggcgtagggaagctcagaaaggagaaaggaaatatcagggaagagctatcagttagcattgtaaaatattcccccatcatactcacattacacttccaagagaaaaactatgaagagtccagcacagttaccttcattctctaatgggcaaagcttggaccagagtacttcacaaaccacagaccagcctctggattggctgtccctagcttaggtgcccatcctggtcccttcagctgttgccagaggtatgggatcctggaaatctatacagtgatttatgcaaaagaaaccacctggagactcacatggaggggaccatgggcatggcagcctttcctctgaaggcccctcctgttacctacaaaggaaatgatccttactcctctcactcttgtcctatccctcctccagggccctgcactcagaagggaagttacctaaaggtaaggcttgttccttttgcaaagggccacaagatactgtccctctgagaaacttatgagggggaaatttgcaaatccacagagagctgccctcagccgagcagaggcagtggttggggaggccgccacactcttcctgactcacctcaaggtacctggcaggttgtatctaccagcaagtgcctgcctgcagggccacctctggatgagtggggaggccaggtttgcccctcaacctgtctagctttttcacagggtggatgttttacacctctggtattcttccagtctgaactcaatcccatcccccaaccaattaggcaggttgtaaatgactgctgggtgcttgatgaaccaatctgcctgagttaggaactcttcctaacccacataaagtatttgaccctacctgaccatttactgcatgacccccatgcttagcctctctggaccagtttctggtctgtcatacctcaccggcgcaatacgaagattcaatgaatgaaaacgtaagtagtttgtgccctttctatgtgggatgactgaaaggagcttaccaagccatgatgactttggaacatgactatagtttgtttgattcttatatcaatcctgtgagacaggcaggtctcacactatcaacaccaatttacagattagaaaactgagactgagagtggttaagggactttgccaagtctgtcaattcttgactgacagagctggaaccaggtctctaaactcccaatacagtaattcctgtctcctttacttcctttggctttgaggtagccagatctcaacctctagcagccaacctttttctggtagggcacaccgcagggtagagggtagccagccaggtcttctatggcccttttactcgttctagctgcaagaatcatgggcacagggcagctttagtgccacagaaacacgtggcaatgctgtggccactgtcctgccctgccctgagccacagggtagagggaggatgctcaggggaaaatctggctggaggcctcaaggcttatcacttcaccctgtctcctctccatccagggtgctctgtgctcacgcttcagtctgtgaatgtgctgcgcaagtacatctcccttctggatctgcccttgtctctgcttcatacgcaggatgtcctcttcgtgctcaacagcaaagaagtggcacaggccaaggtgaggattgtaaattcctggacaccccaactcagatccctgccccagaccccctgtctcctcaaagccccacctctgcagaagccctaactgaaggtttttcacagtggttcagcacctgtccctgagaattagggctaggccagctagatcttgggaggcatagatttttcaatgactttagccttttttttctaattataaaaataatatatgctttttctaaaagtaaataacacatgctcattgcagaaaatcttgaaaaacataaaagcatcaaaaagaaaataaaaataagaacaattacctgcagtcccaccaatcacaggtaatccttgttaacatgttgggctacatctttctactctttttttttttttgagacggagttttgctcttgtcacccaagctggagtgcagtggtgcaatctcggctcactgcaacctccgcctcctgggttcaagtgattctcctgcctcagcctcctgagtagctgggattacaggcaccgccaccacacccggctaattttttgtatttttagtagagctggggtttcatcatgttggccaggcttgtctcgacctcctgacctcgggtgatccacccacctcgacctcccaaagtgcagggattacagacatgatccactgtgcccagccctactctttatatatatataatgtgtatgtgtatacacatttcaaatgggatcacacagtgcctatttaaaaccagctttggccaggtgtggtggctcatgcctgtaatcatagcactttgggaggctgaggcgggcagatcacgaggtcaggggttcaagaccagcctggccaacatgttgaaaccccgtctctactaaagctacaaaaattagccaggcgtggtggcatgcacctgtagttccagctacttgggaggctgaggcagaagaatcgcatgaacccgggaggtggaggttgtggtgagctgagatcatgccactgtactccagcctgggtgacagagaggattctgtctcaaaaaaaaaacaacaaaaaacctgctttaacaatacgttatgggctgggcacagtggctcatgcctgtaatcccagtactttgggaggccggggtgggtggactgcttgctgggcaacagagcaaaatcccatctctacagaaaaattagccaggcatggtggcacatgccagtggtcccagctactcgggtagctgaggcaggaggatcacttgagcccaggaggtcaaggttgcaatgaaccctgatcgtaccactgcactccagcctgggcaacagagccagaccctagccaaaaaaaaaaaaaaaaaaaaaaatcaaaactatttattatgaacattttctcctatttcatttagtattcaaataccaatggctgccaattacgccactgtatgtatataccataagatatatcacgaatcccttactgttagacattttgatttgccactttatcactgttatacatggagcgatgctcccagcttgagtttaagaagaattcagacctgccaggagcctctgtaaagagcctaggggaggccagacgccgtggctcacgcctgtaatcctaacactttgggaggccgagacaggcagattgtctgagctcaggagtttgagaccagccagggcaacacggcgaaaccccgtctctactaaaatacaaaaaagtagccgggcgtggtggtgggcacctgtagtcccagctactcgggaggctgaggcaggagaattgcttgaacccgggaggcggaggttgcagtgatccaagatcgcaccactgcactccagcctgggtgacagagcgagactccgtctccaaaaaaaaaaaaaaaagagcccagggcagactgcaagaagcccacatgcagggtgaggaagagctaggccagctcaggtcatcctagggaaaactcttagctgtccatggaacaggtgactgagtgccatcagagttagggagagggtgggctgaggagaattattcctcagtttgtctccaggtgcatccccctgtagacttaagccccccacagagagatgggtagcataacaagtgaaagaaccaagtcggggattgtggctcgtgcctgtagtctcagctgcttgggaggttggggtgggaggatggcttgagcccaggagtttgtgtctgccctgggcaacacagctttattaggaaaaagggaaggggaaggggaaagggaagggagagagaggaaggaagggagaaagagacagagagaaggagagagtgagagaaagaaaaggaaggaaggaaggaaggaaggaaggaaggaaggaaggaaggaaggaaaggagggaggaaggggaggagaggggaggggagggagggaggaaggggaagggaagggaaggaaggaagggaagcgaaggaaggaagggaagggaaggaagaaggaaggaagagagagaggaaagaaggaagaaagaaagagaggggagggagagaaaaggagagaggaaggaagggagggagggaaggaaagaaggaagggagggaaggagggaaggaagggaggaaacaagggagggagggagggaaagcgggagagagagagagagaaagaaaagaaaagaagaaggaaggaaggaaggaagaaaggaaggaaggaaggaaaatctaagagaatagaaactcaggataatgattttggttttggggtttttttgtttagctttattttctaaattttctttgagatgaagtcttcctctgtcacccaggctggagtgcagtggcacaatctcggctcattgcaacctccacctcccaggttcaagcaattcttctgtctcagcctctccagtaactgggactacaggttcacgccaccaggcccagctaatttttgtatttttaatagagatgggatttcaccatattggtcaggctggtctcgaactcctgaccgcaggtgatctacccacctcggcctcccaaagtgctgggattacaggcatgagccactgtgcctggccattttttttttttttttttttgagacagagtcttgctctgtcacccaggctggggtgcaatggcacgatctcagctcacaacaacctctgcctcccaggttcaagcaattctcctgcctcagcctctcaagtaactgggactacaggcgcatgccaccacgcctagctaatttttgtatttttagtagaggcagggtttcaccatgttggccaggttggtcttgaactcctgacctcaaatgatccgctcccctctgcttcccaaagtgctgggattacaggcatgaaccactgcgccgggcctttttttttttttttttttttagatgtagtttcgctcttgttgcccaggctggagtgcaacggtgcgatctcagatcactgcaccctccacctcctgggttcaagtgatttttctgcatcacactcccgagtagctgggattacaggcatgggccaccatgcccagctaattttgtatttttagtagacacggggtttcgccatgttggtcaggctgatcttgaattcctgacctcaggtgatccacccgccttggccttccatagtgctgggatcacaggcgtgagccaccatgcccggcccatattttctaaattttctaccgtaaacctttgtacctaataagaggcactttgctaggtactgagagtgcagtgttgagcacatattaattatcttgtttcttcaatagtgcattcgtttttgtattttattatttctgtcctacttcatttatggttttattcttttccttccttccttccttcctccctccctccctctttctgtctgtctgtctgtctttctttctttctttttactgttattttatggtttttttttgagacggagtttcgctcttattgcccaggctggagtacaatggtgcaatctcggctcacctcaaccttcgcctcccgggtttaagcgattctcctgcctcagcgtcccaagtagctgggatcacaggcacacgccaccacgcctggctaattttgtatttttagtacagacagggtttccccatgttggtcaggctggtctcgaactcccgacctcaggtgatcgcccacctcagcctcccaaagtgctgggattacaggtgtgagccatcgcacccagcctatttatttattatttatttttattttttgagacagagtcttgctctgtcacccaggctggagtgcagtggagcgatctcggctcaccacaacctccacctcctgggttcaagcaattctcctgtctcagtctcctgagtagctgggactataggggcccgccacttcgcccggctaatttttgtatttttagtagagactgggtttcgccatgtttggccaggccagtctcgaacttctggcctcaagtgatccacccggcttggcctcccaaagtgctgggattacaggcgggagtcaccgcacccagcctgttcttctttaaatctctttaacttgaaaggttagctttgttttcattttcaatctttaaaaaaaaaatactttaatactattaattttccttgaagtgtttctttagctacacatgataagttttgatatgtagttctcctattgtcatttaattataagtaatttatagactccattgtgagttcccctttaatctttgagggtataatttacagttacaaacatgtgtcgatcttcattatttgtagttctatatttatgaatgcacctactcactaaaattcatttgtaactccaaagtcagtgctcgaagtgcttttgtagtcattcgtggacactcgcagaggggtgaaacatgagtcactggatgcacatatgcatgttcccagctgtttcagctctcctactgtaaaaaaatacctttttgtgtatatttaatgccccatttttctcatttttgtggtttttgttgattttgctgtttaaaatagcctctaaggatgatgctgagtgctgtcttgcattcctaagcacaagaggctgtaatgtgccttatgtgggtttgatcacaagcatgagttacagtgccattggccatgagttcagtgctaatgaatcaacaacatgtatttcatatggagtttttaaacagaaatatacacaaaacaaggttatatattgactgattgatgaaaatattgtggccaaaggcttggaggaacccaaccctgtatttccactagaaacaatggttcagtattcactaattcagtgttttcagtgactttgtagaactaccacaaatgagaatggcatggctgtgtgtgtatatgtggtctttttttttttttctgagacagagtttcactcttggtgcccatgctggagtgcaatggtgcgatcttggctcactgcaacctccacctcccaggttcaaacgattctcctgcctcagcctcccaggtagctgggattacaggcaggtgccaccacgcctggctaattttgtattttttagtagagacgaagtttcaccatgttggtcaggctggtctcgaactcctgacctcaggtgatcctcccacctcaacctcccaaagtggtgagattacgggtgtgggccactgtgccctgccgtgtatggggcctttttattgttaatttataatttaattactttgtggtcagtgaatggttttcgtaacactgatcttttttttttttttttttttgagacagagtctcgctctgttgcccaggctggagtgtagtggtaagatctcagctcactgaaacctctgcctcctgggttcaagtgattctcctgcctcagcctcctgcgtagctgggattacagacaggccggcaccaccaagcctggctaattgttttgtattttcagtagagatggggtttcactatgttggccaggctggtcttgaactcctgacctggtgatctgcacaactcagcctcccaaagtgataggattacaaacatgagacaccgtgccctgcccaaagctgatatatttgttagcagattatttctcttatttatttatttatttattttgagacagagttttgctcttgttgcccaggctggagtgcgatgatgcgatcttggctcactgcaacctctgcctcctgggttcaagcgagtcccctgcctcagcctcctgagtagctggggttacaggcgtgcaccaccatgcccagctaattttggattttttttttttttagtagagatagggtttcaccatgttggtcaggctggtctcaaactcctgacctcaagtgatccacctgcctcgggctcccaaggtgctgaggttacaggcatgagccattgcgcctagccaattcgtcttattatcttataatgtctctcttttgtaatggttttccctttatcttctattttatatttatttatttatttttttgagacggagtctcgctctgtcaccaggctggagtgcagtggcgatctcggttcactgcaatctccgctaattgcaatctcctctaattgcaatctccgcctcctgggttcaagcaattctcctgcctcagcttcccgagtagctgggattacaggtatgcgccaccacgccggctaattttgtatttttagtagagacagagtttctccatgttggtcaggctggtctcgaactcccgacttcaggtgatccacccacctcagcctcccaaagtgctgggattacaggcgtgagcctccatacctggcaagtcatgtagggtctgacaatgaatataaaaggggttatttacataaaagtttgtgaagatattagcttagagaggcaagttaattatggtacttagagataaacaggcacatccttttatgtatatctagtgaagtcagttgctgtaatctattctgtttaaaaactgaactatactaggtctgaataacaagataatgtacatttcccctagaagataggaacgacaactcacacctgtgtgccattcctttttttcttcttctgatagtgattggacctccccaaacgacctaactcagaggaatttgggcatagtgtactagctttcttcccatgaaacatccctgtttgtgttgtatatttgaggtagtagcaacgtgattaagaatgtggactctaactggccaggcgcggtggctcacgcctgtaatcccagcactttgggaggccgaggtgggcagatcactaggtcaggagatcgagactatcctggctaacacagtgaaaccctgcctctactaaatatacaaaaaattagccaggcatggtggcaggtgcctgtagtcccagctactcggaaggctgaagcaggagaatggcgtgaacccaggaggcagagcttgcagtgagccaagatcgcgccactgcactccagcctgggcaacaggctcaaaaaaaaaaaaaaaaaaaaaagaatgtggactctagaatcaatcagttggctctgggttaaaatctcagccagctctactacctactagctgtttgagactgacgagtttcctcatctatttattttttaaaaaacagtaataacagtacttgattcacagggttgttaacattgagatgatgcatgtggactgttctgccagttttctggtatcccatggtgagtgctgtagctacggtgagcattgtgtgttataatcacaggtagtaggagatgggaaagcaggggccatgacaggaggccaatccagagaggttcgtgggttacaggaagaagacagataaggctatagcatgaagcatattagttcgaggaaggatttaaggtgcggaggccagatctgaaagtaatgaaacaactccagtgcaactgtttcataactggttctctttgattcttctagaaagccatgtcctgccaccgcagccagctcctctggttccgccgcctctacattatcttctcccggtacatgagaatcaactcactgagcttcctctgaagccttgaagggttttcaggtccaaggaacaaaggggaaaatagacaaaggagtgcagaggacctggcctggcactggcttatttacctgagctcaaggagatccccgctggagcagcctctgcaaaagggagcccatgtaggccaggggctgtccaaactccagcttcttcccctgggaaaaaacccaaagaaccaaaaacaaaccaccccaaggataataatagctacactgctagcttctcaagttcttgtgaaaaacaatttacataatgacacagtagatgtggaacacctagcccagtgcctgggcaggtccctattatcataaatgaacataaaagtgctctaaaaacactccacagatgtgacttttacattgtttccaaagcaggttcaccaaaaacacatacacaaaatgcaacagtgtgtgttgaattggttcaatcataattcctttgatttttcttgtatcagaatgtgggtctaggaaaaacttgctctatttaacaggacagctctgattgaagcatccaagtacaggtcactggggtgggcactgttttatacagagacgattacaagaactctgcctcaaagagcttacaatcaaatatgtcagctctcagtctttttggagaagtaggaagtaggaagataaatctgagacttaaaaaaacacaaaacattcaagaacctgatgtcttaaaattgtcctacgaacaaaagctctctgaaagctctggcttggaaactactctcagaatccagctaacgctccagggaagtggcctgagtcagggaagctaagtggtgaagagcacaggctggtagtcctgcgattgaagccagaatgaccagctgtgtaaccaaaggcaaggtgctgaacctttctctgcctcaattctctcatctgcaaaatgggaaataataatgatcccaacctcagagaactgaacaagataatacatgaaggtgcatatcaaagagtctcacatgctctgctgggtaagtatgccctccacccgccacaggaaacactgaattgcttctccatagctgcaggttagagacctgcttgttcagacactccacctcaacttgccctcctttgcttagtgtcaccattatcttgaatgcctcctaggggccacataagactaatagagctattaggctctgaagccggaatcaaaaatgcaaatctggttatgtgatttgtctacttaaactttgtcaatagctcctaatagccttcatgtgaaaatgtgaccagaagcacgttactaacactggctagagtgcagtaggagagtgtggtaggacaggctgacctctgccctgttactaggaagacagacactcacccagcctttctgaacagcaactctgctaagagcttttaaaatatgcatattctatgacctaaggaatacttagaaaatcaaaattatatacacactggctgggcgcagtggttcacatctgtaatcccagcactttgggaggtcaaggagggtggatcacttgaggccaggagttcgagacaagcctggccaatgtggcaaaaccccgtgtctactaaaaatacaaaaattagccaggcatggtgccgcaggcctgtggtcccagctactcggaaggctgaggcacaaggattgcttgaacccagaaggcggaggctgcagtgagctgagatcgcgccactgcactccagcctgggcgacagagccctgtctccaaaaaaacaacaacaattatacacacaaagattatcattgtattatttataatagcaaaactggaaaaatccagtgatgcagttgtgttttgtaacaaggaagaacgttcacactattaaatttttaaaagcgggttaggaatagcacaatcccatttttgttgaataaatatatacacaagtatataaataaatacatatatatcaaaagatatatatccaaaagataaatactagctggcaaggtaatctttcaacaatgaacatttataattgtaaaggactttgttgttgttgtttatggatcatttggatgtgagaattttgatatcatgtgaagttttttaaaaagtgtgtttataggcccggccgcggtggctcatgcctgtaatcccagcactttgggaggctgaggcgggcagatcacaagtcaagagatcgagaccatcctggccaacatggtgaaacctcgtgtctactaaaaatacaaaaattagctgggcatgggggcgggcacctgtagtcccagctactcaggcggctgaggtaggcaaattgcttgaacctgggaggcggagattgcagtgagccgagatcgcgccacagcactccagcctgacaacagagcgagactccatctaaaaaaaaaagtgtgtataggccaggtgcagtggctcacacctgtaatcccagcacttcgggaggctgatgcaggaggattacttgagctcaggagtttgaaaccagcctgagcaacatagtaagaccccatcttttcaaaatattttaaaattacccaggcttggtggggtgtatgtatagtcccagctactcaggaggctgaagtgagaagatcacttgtgcccaggaggtcgaggctgcagtgagccatgatcataccactgcactccagcctaggccacagaatgagactgcctcaaaaaaaaaaaaaaaaaaaaaaaaaaaatatatatatatatattaatcttagaggttagaaagatgaacaaaattatcaatatttgtttctggatggtgagacttaaaacatttcctgcctcttttgttttactgtacattccaacttttttgaaataattaagtagaagtcggccagtgcggtggctcacgcctataatcccagctacttgggaggctgaggcacaattgcttgaacccgggaggcggaggttgcagtgagtcgagatcacaccactgcactccagccttggcgatagagggagactccatctcaaaaaaataaaataaaataaaaataaataagatttaaaaaataaaaaaaagagggttgctgcatctgagactgcaggttctactctgggttctggaaagaggacagaccagaactaggctctccttggtaccagcagagagccaagggactgcagcacaggagggaaggaagcccctggaggccagttagggcagccactagcagtgccttcatgagaaaagtaccctccagattcaatgcagccctggggacacttgtcctggcaagaaaagagtgtcctcgtgcaaattatcaacaagtagtctttcctgcctgcaaacacactccctccccagggacagccacaaacagccttgtagaaggagcagagacttaagcatccacttagccagatgctcttgtttggttaacaacctgcaaaactaggcagcagtagccccaaagcctggagcaaaaatcagaatttcatggttccttgaaggaacaccaaaaaaaaaaaaaaaagaagaagagagagaatcctctcctccaactgcccaaatagaaaggatctcagtgaattaagaatcctctgggaggggcagcaatcccacttgctcagagacctggagagtgaccaggctggggtgggtgtgctgaagtcaggagagggtcaccccttgtcagagagacctgcaaacaatcccccacccaccccatcctcggcaagggctgatggtttgccagttctcacctcggtccagagagcagaaactgccaacttcaaccactccccgcttggctactactcagcagccctgactcattaagaaaacacaaaaatcgagagcaaccagacacaatacaaaaggggaaccctcacctgaggaggctcagaaggaggggaatagggcagatctcactgaagtagcaattaaatggaagagactttatcagaaacagtagtgaaagcccgggcactgacccagacaaaaaagcacacttctccgtggtgactaaattagtaatgtggaatatcaagtagaagatatattgcagaacaaagaggttaaaaagccaagaaatggaaataagggtgggaaagagatttgaaaacacattaaggagagccaacgtgaataatggaagttccagaaggagcaaaagcaggaaggtaataaaggagaacttccgtaatctgaaggagactgagtacactgaaagagcccgccaaatcctaggcagctttgatttttaaaacagatgcacaaatatgctgcgaaattcctaaattcccagtgagaagggggagattaaagtattcaaaaagtctcctcttggggccagccaccgtggctcacacctgtaatcccagcactttgggaggctgagactggcggatcacttgaggtcaggagttcgagaccagcctggccaacgtggcgaaaccctgtctctactaaaaatacaaaaattagccaggcgtggtggcgcatgcctgtaatcccagctacttgtgaggctgaggcagcagaatcacttgaacccaggaggcagaagttgcagtgagccaagattgtgtcattgcactccagtctgggctacagagtgagactctgtttcaaaaaaaaaaaaaaaaaaaaccaggccgggcgtggtggctcatgcctgtaatcccagcactttgggaggccgaggcgggtggatcatgaagtgaagagatcaagaccatcctggttggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgaggtggcgggcgcctgtagtcccagctactcgggaggctgaggcaggagaatggcgtgaaccccagggggcggagcctgcagtgagccgagattgcgccactgcactccagcctgggcgacagcgagactccgtctcaaaaaaaaaaaaaaaaaaaaaaaagaccatcctggccaacatggtgaaaccccgtctctactaaaaatacaaaaattagctgggcatggtggtgcgcgcctgtactcccagctactcgggaggctgaggcatgagaatcgcttgaacccaggagacagaggttgcagtgagccgagattgtgccactgcactccagcctggcaacagagcgagacttcatcaaaaaaaaaaaaaacaaaggtgtcctttgcggccaaggggaagctgggctgggggtaaagctgcatggtgcagggtgacaaatagacaactgatgggctgcagtctggattgtgaggaactgaaaggtatacagttccagggctgaaactaaaaagcatgggatctcaattaacaaagaggaaagcaggaaatgaagaaaaacttaaaagactgcaaaagtaagaaaaaaggaaaatagtataaaatgtaataaatataatagaagtaatacaaaaagaataaaatcagagctacttcaaaaaatatgaacaggctgaatttccagaccaaaacagactgtgaaatcaatgtgttagaaaacaaaatctagctacatctaaaagtaacaaaggctaaaaataaaaggatgaaccatataccatgtagcaggagaacaaaaagaaggaagagcaacaccagaaatccaggccaaacccaatatgacaccaagaagcattaaattggacaaagatgggtatgttaacaggttcactccatgagatgacaggcacccaacatcacagtagccagatacataaaacaaaacctcccagacatacaagacctttattaaaagacaaaaacaaacaagacaccacgataatagtaggaggcctcagtattcttccagaattttgaaaaattgagttggcaaaaaataacatcaaatattggaataaagcaaacattcacttatgtgatagaatgtttacaaaagttgactgtttattggccactgataaatccatttatttatttatttatttgagaccaggtcttgttctgtcacccaggcttggaatgcagtggtgtgataacagctcaccgcagcctcaaattcctgggctcaaggaaccctctgcttcagcctcccaagtagctgggactacaggcatgtgccaccacccccggttttttgtgggttttgtttgtttgtttgtttgaaatggagtctcactctgttgcacaggctggagtgcagtggtatgatcttgactcactgtccgccttccgggttcaagcgattctcctgcctcagcctcccgagtagctgggattacagatgtgcgccaccacgcccagctaatttttgtattttcagtagagacaggattttagcatgttggccaggctggtctcaaactcctgtcctcaggtgatctgcctgcctcggcctccgaaagtgctgggattacaggcgtaagccaccacatcctgccgttctttttgttgttgtttgtttgtttgtttgttttaatgagacgaggtgtcgctatgttgaccactttggcctcccaaaacattgggactgcaggcataagccactgcacccagcagagaaatccctaataaattccctactgtagagatttaataggccacattcttggatcataattaaataacatgcaagtaaataataaaattactaaagagggggataaacaacacaactcagaaatcaagaagccccttcctaaataacccctagatcaaagaggaaatcaaaattggtattatgaattatctagaaagtaatacaaattaacacttgatgtgggatctgtatttaggtaatttgtagtcttaaatgcttaattttttaaaagattgaaaataagtgaactacatgattcaatttgagaaaatcaaaaatagaaaccaatagcaagagggacttaatagagatataagattagattaaataagtgaaaccaaaaaatagtggaaagaataagttttctttgaaaaatgaaataagccaatatactgcaagtctaattcaggaaaaaagaaaacaaaagtgcagttattgggaacagatggatatataaccacaaaagtgaaaaaggctgaaaaaaattataaaatattatatggcttgaggtcaggagttcgagaccagcctaggcaatatagtgaactaaaaatacaaaaattgcccagggaggttgaggtgagaggatggcttgagcctgggaggcagaggttgcattttgccattgcactccagcctgggtgacagaaccagaccctgtctcaaaaaaataataaaaaataagtgttggtgaggatgtaaagaaattggaaccctcatacattgttggtgggaatgtaaatgatgcagctgctatggaaaacagtttgatgttttcttagtaattttaacaaggatttaccacatgacccagcagctccactcctaggtacatttcccatagaatggacaacattcagacaaaaccttgtaaatgagtattcatagcaatattattcataatagcctcaaagtagaaacaactcaaatgtctatcaactggtgaataaacaaaatgcggcattttattattcagccataaaaaggaacaaagtcctggccgggcacagtggctcatgcctgtaattccaacaccttgggaggccaacgcgggcggatcacaagatcaggagttcaagaccagcctggccaatatggtgaaaccccctctctactaaaaatagaaaaaaattagctgggcgtggtggcacatgcctgtaatcccagctacttgggaggttgaggcaggagaattgcttgaacctgggaggcggaggttgcagttaactgagattgcaccattgtactccagcctgggcaacagagtgagactcagtcacaaaaaaaaaaaaaaaaaaaaaaaaggaacaaagtattgatgcatgctacaaggcaaatgaacttcaacagcattatgctaagtgagagaagccagacacaaaaggtcacctatgtaggattccacttccgtgaaacatttaaaataggcacattttgagatggaaagcagattagtagttgccagaggctagaggaagtggggagtgggcagtggctgctaatggtacagggtttctttcttttttaaaaacaattttatatattaaaaatattttaacatagggtcctgccttgtcacccaggctggagtatggtggtgtgatcatagttcactgtaacctagaactcctaggctcaaatgatcctcctgtctcagcctcccaagtagccaggactacaggggtgtgccatcacacctggctaattttgttttttaagagactgggtttcactatgttggtcatgaactcaaaaacactgaatactaaagtatactaacactgaattgtacacgttaaagggttgaattttatgttattcaaactgtatctcaattcaaaaattcacgtgaaaataagattgcattaaaatattctagttcactataaaagatatacacaagctaaatttgatgatcacgccgggtgcggtggctcacgcctgtaatcccagcactttgggaggctgaggcaggcgtattacgaggtcaggagatcgagaccgtcctggctaacacggtgaaaccccgcctctactaaaaatacaaaaaattagccgggggtggttgcagacgcctgtagtcccagctactcgggaggctgagtcaggagaatggcgtgaacccgggaggcggagcttgcagtgagccgagattgccactgcactccagcctgggagacagagcgagactccgtctcaaaaaaaaaaaaaaaaaaatctgatgatcgctttctgcacctagtgatactcacctaacacactagcccattaaacacaaatactacagaatacaacatttgttgttattttgaacaacttttagtgcttcctgtttttcttttaacagtttttaaaagataaaacgaattaatgcagaacataaaacaagaattgaataaatggagagttgtgccatgttccttgatagagatttaaaaatcctcatacagttcatatataaatttaatactacctatagcatctataaattccaatatagaaatttaaatatttacatatgtatttatatatgtatatttattcacattcttacaatgttaatatataaatttaatgtaattctagtcagaatatcaatggattatctttgggatttgaattaaattattttaaaaatatattagaaaagaaaatgtccaagtattgccaaaatataaacatcaaaaaggatagtgacgtgaggcctgcctttctatatattaaaacttaggccaggtgtggtggctcacgcctgtaatcctagcactttgggaggctgaggcaggcggctcacgaggtcaagagttcgagacagcctggccaacatgatgaaaccacatctctactaagaatacaaaaattagccaggcatggtggcgcgtgcctgtaatcccagctactcgggaggctgaggcaggagactcgcttgaacccgggaggcagaagttgcagtgagcctggtttgcaccactgtgctccagcctgggcaacagagcaagactctgtctcaaaaaaaaaaaacagcaacgatcccatgcaaaaggacgacaaatagcataagacagctaaggataaaccgaaccctacagcgtgctgttcatactgtttccataaagagaacagcataaaacttgaagagtgggaaagaacaaacccattggtgagccatattaccttcctggatgataaagcagtactgtacagaagtctgttctccctgaattaatttataaatgcaatataattgcaaccaaaatccaaacatgctttgattgcatgatacttgactcactaattctaaaattcatctgcaggacacagtgcacaaaaacagaataatatggccaggcacggtggctcacgcctgtaatcccagcactttgggaggcctgaggctgacggatcacctgaggttgggaattcaagaccagcctggccaacatggtgaaaacccgtctctactaaaatataaaaattagctgcgcatggtggacacacctgtaatcccagctactcaggaggccgaggcaggagaatcgcttgaacctgggaggcggaggttgcagtgagccaaggtcgcaccactgcactccagcctgggcggcagagtgagactccttccccaccccccaccccacaaaaaaagtgtaatatggcaggatttaccctattagattgtttaaggcacattataaagcttggggatttaaaataatttgttatttgt

SEQ ID NO: 1241 - DNA, 1123 bp, Homo sapiens
ccatcatggaagcaatgtggctcctgtgtgtggcgttggcggtcttggcatggggcttcctctgggtttgggactcctcagaacgaatgaagagtcgggagcagggaggacggctgggagccgaaagccggaccctgctggtcatagcgcaccctgacgatgaagccatgttttttgctcccacagtgctaggcttggcccgcctaaggcactgggtgtacctgctttgcttctctgcaggaaattactacaatcaaggagagactcgtaagaaagaacttttgcagagctgtgatgttttggggattccactctccagtgtaatgattattgacaacagggatttcccagatgacccaggcatgcagtgggacacagagcacgtggccagagtcctccttcagcacatagaagtgaatggcatcaatctggtggtgactttcgatgcagggggagtaagtggccacagcaatcacattgctctgtatgcagctgtgagggccctgcactcagaagggaagttacctaaagggtgctctgtgctcacgcttcagtctgtgaatgtgctgcgcaagtacatctcccttctggatctgcccttgtctctgcttcatacgcaggatgtcctcttcgtgctcaacagcaaagaagtggcacaggccaagaaagccatgtcctgccaccgcagccagctcctctggttccgccgcctctacattatcttctcccggtacatgagaatcaactcactgagcttcctctgaagccttgaagggttttcaggtccaaggaacaaaggggaaaatagacaaaggagtgcagaggacctggcctggcactggcttatttacctgagctcaaggagatccccgctggagcagcctctgcaaaagggagcccatgtaggccaggggctgtccaaactccagcttcttcccctgggaaaaaacccaaagaaccaaaaacaaaccaccccaaggataataatagctacactgctagcttctcaagttcttgtgaaaaacaatttacataatgacacagtagatgtggaacacctagcccagtgcctgggcaggtccctattatcataaatgaacataaaagtgctctaaaaacactc

SEQ ID NO: 1242 - protein, 252 aa, Homo sapiens
MEAMWLLCVALAVLAWGFLWVWDSSERMKSREQGGRLGAESRTLLVIAHPDDEAMFFAPTVLGLARLRHWVYLLCFSAGNYYNQGETRKKELLQSCDVLGIPLSSVMIIDNRDFPDDPGMQWDTEHVARVLLQHIEVNGINLVVTFDAGGVSGHSNHIALYAAVRALHSEGKLPKGCSVLTLQSVNVLRKYISLLDLPLSLLHTQDVLFVLNSKEVAQAKKAMSCHRSQLLWFRRLYIIFSRYMRINSLSFL

SEQ ID NO: 1243 - DNA, 22439 bp, Mus musculus
  misc_feature (1)...(22439): n = A,T,C or G
ctcttcccggatctctcctttctgcatctggattctctgcatacctgaaggtgctccttcagagtttctttttataaacaaagtgttcttttataacccccgggtttaccagggtctctggccctgcacacacgggccgacctgatactgctttgacccttatgtccccacaggatgctgggtgtggagcatgggggttgactgcagcccaccacgtgctccatgagtaaccacaggaagtgctcagtctaggacacatcccaagactggagaaaacatggggctttctcagggttgttgaagaaagttcattcaccttcttctgtctttcaactcgcctgtctcaagccagctctctcctcgtggttaattttttattaccttttatttacttagggggaaaacagccatgtcctgtggaggataaaggtcagcttcaggagtccgctccctccnnnnnnnnnnnnnnnnnnnnttgttgttgttgttgttgttgttttttggtttttttttgtttttgtttttgtttttgttttttttaatgtggataccagagtaggttcaggatcctccattcatgctgtggtaaccagttgacaggctggtcaaagctctgagctcccaggaagacaggattagagacacagccgaatgcaggacccaggtctggctgtttcatcccagggggtcggggcttccagactccacccctttcttactctgagttcacacaccagccaggatgctttgcagagaagggctcttacaagcgccttctcatctctttccatcttcctctccctgactccgtgcttctctcagttttggtgtcctccttcatgtgctcatttctgcaatcgggcaaaacccacctacaatatcaggcaaggtccaaggcacaggacttcctggcgacaaagcaaggcttctgtctgcaaggaattaaatctacgtgtgtgctttgggggggacagacaagtgcttagagacacagaaggcacattttgtctgatattgaattgtgccaatcattttggggtgacatctagatttttagtactagcaccagaagaaacaaccacactaccttgagttagagccacactgggagagtactgggcatgcctggatatgtcttttcaggggctccaagtacaaaagaccaaaggaatgttggactgtacactccatgcaatctttagctcaaatgtaaaacttccctggggttccaggtcacagtagaagttacagatagtagctgtccccaggagaagatgaccaactctgagaactgtaatctttactcagtgactttggggcctacctacgctagggaaacatggaagaagagagtttgggaactggaaaagaagttgacctctaagcagtgtcttcaagtaaagctggcttgtctagacacatctggatatggtgtgtgttctgggggggggggggactagtacctcctttctacctttgttgttcttttccccagagctgagggtttcataagtgacttgatcatgccttatcttcacactcatcaataccactgagcactccctggtcatttgtgcctgagcacagagacacactttctcgttagtctgatttccagctcatttcccccctaatttcactcagctaactccagctgaaaccagattctgaatctctccagttttctctcctgtgatcccagggctacaatctgcgtccttacacgtgtgcttctccatcatttccgagtctacctctttgtctcggctcagactgttccaggtggtaaattccttcccattatccctccagtgggtacaatatgaagaaggggcattcagtgaaaacactgacagtctgtctgtgactgagagtctttgagcacacacaggtttggctaccattcaaccttagggaatttctattctgcattgacatactcttccccctccctacagccttcagtaggactcaccctgtagtcctgtgtcattaactattttgcatgtggaaattaccaaacttcaggaactgacatcagaaatgaagaaacagccacaagatttggagacagagaatctagcagaaccttgaaatcctgtccaagaggcaagttgtgggaagctgttgcagagtggcagttgcagagtggcagttggctactgctggccaccacacatacataggcagtgaaggttcttttgccaagacaagttaaccaatcagatgtgagacatgcctctcctaggcctatgtaagcagcaccagttctgggctcagggtcttttcgcctctacaatcgagctctctcaataaacgtgtgcagaaggatcctgttgcagcgtcgttcttcctggccagtcgagcgcgtgcaagagcaagtgtgaaagtgttctgcaggggatccagaaagtccacgagccaatttgtgaggaagaatattggcagggggaagcattgcaatcccttcagcatgcagacacatctgggtgttcctagctaagccaggagcttcacttgaagagtccaattcataaatgataaaacttgaactgttggttggagggagtcaaatatgtaagatctgacaatgtgtgttctccaaggcgtctccaaatctgactaacgcaaagtctccccaagccagaaatttggaaattatctatggacagctaaaataattttcatagagattttgattcataaacatgtttctataccttttttgttttattgatttgggggcagggcttcactatacagtctatgttgtctaagaacttctgctcctgtcttggcttctctagtgttggcattttgtttgttctccacagttagtcccaaagccttatgtttagtaaatgtttcttgcctcctggtgtctctgatgcagttggaccagggaccccagattgggaatttgttctcctggtcccctcaccgacccaatggtaagaagagtcacagactttggcactcagaggactctggacaacttgggtcgggaagaacgttaacaaaacatgaagaccacgttggtatccttcaacatctcctgagagacaccgttgtgcctggagctgaggaagccacagctgtagggttgtcacttttttgatagttcccaggtttgactggttcacaccatgtcagctttttggttttttttgtttgtttgtttgttttttgttttttcttgtggtttctatttggggagtgtatgatatggctgtttgtttgtttgtttgtttgtttgtttgtttttcgagacagggtctctctgtattgcccaggctgtcctgatactcactctgtagatcaggctagccttgaactcagaagtccacccaggtacttccttccctggtgcagactcgcctttcctggggacagtctctgactgggcttggggaggtccccacctcttacttttgtttctggtgtgagcatgggcttcttcccagagcctgccagaagtcatccagccttctgagctgagttcagggtgttcagaggaagcctgatgatgtaaagctagaggaagtctcaccagtggggtggtgagcatgttttgtagtgggtgtctcccctacaaaacttaccctcctagggctaagagaccttagatctaagacatcttgtcacagtcacatggcagtaatatcttgtccccagcaggagctgtaacctaagaggaaaataatagctcttagaggcttttctttacctctagcctctgaccatgaatctacctctagtcatattttgacttttagctatgttcctataacaacagtctcccagactgatcgctgtatgaaggctactcctcctgggggcttgccatctcatgctcatcttctaaggcttttccacatatttcaaatggatagggaatacagaggacttttggaatggcagtcattttcttacccccaccccctttcttagacgggatttctttagcccaggctggccttgaactagcaacatagctcagaatgcctttgcctccacttctttgctctggcctccacttcttgattggtgagattataggcatgtgccattatatctgtttgatggagtgctggaaataatccagggcctgctgtatactaaatttacattctagcaactgaaccacatccccagaccctggaattgaaatctatctactccaaggtttaatctagccatctatgctggcatctgcttcccctcttaggcatcatgagagctaatgagatagcccatcactgtgtgagagaaggctgcacgcaatgtgatgacgtgggccatgggaccacttaggtcacactagcaagttctatggtcttttctcactctgcagactttctgagttggttattgcagtgtagtgcagaggtttattgatccatgggctaattgagtgtagtctgattttcacaaattgttactagttcatcatctttggcaatggttctagactctccttgtccttctcatagccctccattgttgttttctgcactagaaaatggaacccagagttttgtgcatagtaaacaagctcactctaccgctgagctccgtttttaaaacgttgtgttttgaggcagggtctctctcacaaagttgcccaggctggccttgaactctatcttgtaagctggccttgagcttgtggtcctcctgctttagtatcccaggtagctaggattatagggctcttaccaacaggctctagattttgttgttggttttgttgtttgattttatttttcattttgtcttttgaatttttatttttaaagacattttatttatttatttgtatttatgtgaatgtatgtatgcttgtatgcaagagcctgcagaggtcagaagagatgttggattcccctggaattagagttgcaatggttgtgagtcacttgatgtgggtgctgggaagtgaactcaggtcctctgcaagagaggcaagtgctcttaaccactgagccatttataatccctatgttttgttttgcttttaaaagagaagttttaagttcctaataagattgggaggaagagatggcaatatctctcatgccctcacttatgcatgccctcccctgttgtcaatatggccaccggagtggtatcacttagcttatacagcattattagccgatgtctacaactggcacttgtttcactcttggcatatatgctacagacttgggcagtgcatgagaacatatatacactgatatagtatcacaggaaacattttactgtcctaaaagtcctctaagctcagctcacttatgccatctctccaatccctggcaactactgacaattgtactatctctataatttcaaatttctaggatgttcatcaggaaacaacatttttactagtaagctctgcttagcaacacactcctaagtgctttcatagttgccccttacttattctttgtgtttagataatgctctactgtttggatgtactcagcttgctatttactagcttgcatccttgttgctttcaagtcttgataattattcataaagttgatagaaatatgcacatgtggagttttatgagagcaccatttttttattcttttggataattgtccaacaatgatatttctggatcatatgtgtaggcttagatttttcaaaaactactttaataagggttcttaaatgctttaacctccctgctagcccaccgtctaccagaggtagtggaaaggaaaggttaataggataaagggagatgtggacctgtttagaaatagtttagaaacagaatagttagacatagtttgggtgattctaatcttcaatgtcaggatatcaactgttcagttcatacaaattgacagcagtaatttggtccactctcaaacactacttatgagtcaggaacaacagatctagaagatactgcaaagctctgcagattggcctgagttagcaagaagccactggaacaccaccagaagttctttggtgcatttctatctgcaaagttacaacaaacaatgcaaagaaggcaaggcaaaccaatgccacagcattgccagtgaagaccagcatcagcaaagcccaattaagatcagcaaagagtggcaaggtgaaccaaagcctcacagccttgtctactgtgttgagttatatttataccctttctgtgggttaaatggtggtggcccacatctaccccagggcttggaatgtggaagttttgaatgctcagaccccacacctgtgccaggtgggcattgggctatgagaagccttgggactctgttctggggttggggaagcacagtctgaggtccccagggactgccagagtggctcaggggtccctggacctgtgtggtggccagggatggcaggttctcagactcttaggcaccccagacgctgctggatgctgcagaaggactgagaatggagtgggggcccgagggctggatctggcccagggtgaaggggaaaagaggggagcagagagagccctagctgggtccctggggaggagtgtccttggcttgctcagtgggcagcttggcttggtggagtccatggctgggagtgagagaagccttcgggggagactagatgcagctctttagaaaaaggcctgtttcattgctccccggggtggattccaatgggaagagacagttcatattttgaaagcatttattgccatagcagagagtgtagatgaaaaagccaaaccccactttctcagggtgggcctgaggttaaatacattttgcaggcagggaggagtgtctgggaaggagaacttaattggctaagcccttcaggcctttaggtacctcattaaaatggagagctgtcttgaggctacttgatctgtggtcacatcctctacctgtggaggggcttggggcgttgcccttacataactgatggccacagacttatggagagctgcagcctcatgtcaggagcctggtatctaggagcgtggcaaaatgcttactgttccttgcaggactatccctgtggagtcactggggttttaaacctagctcaaccagaaaacaggctgcctttcatggtcccacacctttccaaacatcatatgttctctcaagtgctcactcttagcaaaatatcacatgccctttttctaggcagcttccagaaaaccaccatgtttctgttctcagcaaaaacatcctctcatgagacaatttctagaaaaacatcatatggcacaactgagtctccaaagaaaccagaaatttccacttcacatatggcaagagtatatttacttttgtaagatgctagcagcctgtcttctgaagtgcctgtaccattccacattcccaacagtaaccaattaaggttcccattcttccgtatctgtgccagcgtttgaagccatcagtgtccgaactttggctgttctgggaggtgtatactggtgttttgttttatgtctccttgatgacatatatttgggatcgtttctccatataaaacattagctatctatgtgatctttctgcgtgaggttgtactaagtcctttgtcctgtttttattgggttgtttgtttccttattattgggacttaggaattattcatatatggttctggcataaacacagaaacaaaagtcaacattcttctgtattcttttgaacataggaccgagaaataaatgtgcagttatagccatctgatttccaataaagctactagagagacatgttggagaacaggtggccttttagcaaatggtgtttgagaacctgggtattgcatgcagagaactgagacaaggttccacatccttcacctcagacaaaaattaattacaactgaatgagaaatcttcatgtaaagtctaaaagcttggaattagtagaggggacataaggaaaatagttgaagatctaagcctctttgtatgttcagtatcactctagacatgaacaaaaatatttttgaagcctggtgtggcacttcattgtaattgttttttatgtcaacttgccccaaaatagggccacctgagtaaggagcctcacctggagagctgtcctgactgccttggtttatttcggggcccagttgtgggccacactaactggtagcggccccgagggaaagggtgtggagaaggaggctcatttccttctttgctccctaggtctccctcctgcagacttgtactgtagctggtgctgattcctttactgatatcagaatcagcattttcaagttttcactgagggctatagggctcttacgcaccagctgtagtctcaggactcggactatattggaggatagctcatttattgacttaacagggctagcttatatagctcagtgagggaggggaggacaaaagaacaagggaggagccgggcgtggtggcgcacgcctttaatcaaagcactcgggaggcagaggcaggaggatttctgagtttgaggccagcctggtctacaaagtgttccaggacagccagggctatacagagaaaccctgtctcaaaaaaccaaaaaaaaaaaaaaacaaaaaaaaaacaaaaaaaaaaaacaagggaggaaacacctaatttgcatatgcagacttgactgaagtcaggcaaatgttaagccagttctctggcagggaatcagaagcttaactgattcttaacttaaaaagttgagtaggcccacgcctgatttggatagggagcagccaccctcctgcccagctctctgagagaagtccagggtatgggcaatgctctacctaccatctcttgtctgccttgggaaccaacaatcttgagacaactccaactgttgaggtatctagcttcaaggactgagtaattaccaggttctcagctttcagttcaaggtcatcctccacacactgtgagttcaactgtaggttgggctacatgagactgtaattgttagcattctgtctaaactccaccccacaattccctgacaacagccaggtaggcctcacccactataaaaggggctgcttgcccccttctccctctcttgctcttctcttcttgctatctgctcccttgtcccttccccattccatcccctcgtccctgccccgctctctccacatgcccatggctggcctttacttctgtactctctaacccctctgcttttctctgcttctactaccctcttgacttccctccccatgccctgaataaactctattctatattataccgtcgtgtggctggtccctcaggaacaagtgatgccttggaatgggactgctgggacaactcctcccatacctcaccacaccttccatagagcatatccctccttctctcgttatctttttataaacacatcagtaatctaaaaaaaaaaaaaaaaaaaaaaaaaaaaaaagccaaacaataataaaaaaaaatttagaaacgtttggcattataatagacatacagagaaaaggcttcaacttgacagagctgaagcacctattaaattacaagaaaatatttctgtttctttaaaagcaaatggtttcttcattggctcctgttgtaagccggcccgcggcctacatgaacggggtgcacctgggaggcaggctggggctgaaagagacttagactgtgagaaaagataatgaagccaagacaaaaatttctctgatcaggcccgcgagttgagtttactaagagagtgtgcttataagggggaaggcccatccccactgccagttcattctccgtgcctggagccattctgtcagcacgcggtcgccaggaatgtctcaggaagacaggttcagcctctgagcaggtagcagaagagcagggcagttgtctcttcaaaaggagccagcctagtcagaaagttgcaccgcaggtggccccacctccgtggcaacaaggtctgtacccgcccgcttcaggctggggggggggggggaagctacaattggctccacccatagaacttcctgtcagggaatgagggaagttttacttcatagttcagtagaaaacttgaaccaggtcaaattggttccttggagagatcctgaactctcattaactgttgcagaagaaggtgagtctggctggaagagacctggagcgagggagctgtgagagggagggcgaatggagcatctatgggggtggaagtattgtgtctgcacagggaggaagctgctggggggaggggtggaggctaagagatataaggagatgaactgatgcgttgcagtgtgtctgtggggaaggtcacagagggcctggtgccctttatagaaagttctgtgtcccccaaggcaggttcgttagagttgggagagaactcagatcatgtttaattcattttttcttacctcaatgtgctgactcctcttaattgtacaacagacagatttgcatgtgtggctgtgtgacccttggcttgacggagggctgctgaagccacagtgtagtctaggggctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatagccttgcctgtcctgaaactcactctatagaccaggctggccttgaactcactgagatcctaccctgcccctgccttccttacactttctttatgtttgagtccttgaatgcctctcctaggtcgtcataaaatatatagtaagctgttgacctctatagtcatcctgggctttcaggtatttggcacagtaacgatttgggcgcactcatttcccagacctggcattgggcatgagccaggaacatctgttccaatattggcatgaaggcggtagcaggactagagacagcctgtccatgccatcaggaacagcctaaatgatatccagatcatcagccttttaaaactatagaacactgcaaaatttcaggagaaaaggaaaaaaagaaaggatcgggagtgcttcccatttgtctaataggtaattttcctctcttctccttccttaagatctgtgcattcagatctttagagtcagcttgccttgacatggctggccagggagacactgaagtgaggatcattctggtagggaagactggaaatgggaagagtgctacagccaacaccatcctcgggagacgtcaatttgattctaagatttgtgccaatgctgttaccaagacctgccagagagcatacagggagtggaaggggaaaaaccttgttgtagtcgacactcctgggctctttgacaccaaggagaccatgaaaaccacatgtttcgagatcagccgctgcgttctctactcctgccctgggcctcacgccattattctggttttgcgactggaccgttacactgaagaagagcagaaaacggtcgctctgatcaagggtctttttggggaggcagccctgaagtacatgatcatcttgtttactcacaaagaagaccttgaggatcagagccttgataattttgtaagtgatgcgggtgaaaagctcaataatattatctcccagtgtgggaagcgttacttggcctttaataacaaagcagctctggatgagcaagaaaatcaagtgcagcagctgatagaactgacagagaaaatggtggcccaaaatggcggatcctacttttctgacaagatatataaggacatagatagcaggctgaaccattgtctagaggaactgaaggagacttatgctcagcaactcactagtgaaatcgaaagaatagaaaaggaatatgctgctaaattagaaaaaggaaaggcggcacaaattgtttttgcacagagaaatcatgatgaaaaattaagaaatttgaaggaaaaggctgaagagactgtatttatgtatattttccaaaagataaaagaaattctttcaaaactttgggacgagttgtggtaaattttatttatttatttttattaacgacatttgtttttgacaatttcatacaagcacacatataatgtgttctgaatatattaatgacttgcttggtgctgggagccatggcctcagccattgccttgtggacattttctagcttacataaacaatcctgacagaacattcgtggtcataacaggaagaatgtgggtaaagaggacactgtgaccgttgtttccagaacctcaagattgccacctgaccttcagagcgatcccagactcttcccccatcccctgaagcctcctcttgcttatgctcatattgctactcctgaataaaggttttcagagcttgatcagtatgattgacttcttgtccctcccactctctcactaccttttcctgggtcctcgctgatgatccctgtaggtgggggggggggggcagcttggtgtgttggcattgtagtttatagagtttggttaagactaatgatgtcttttcttccccagcagtctacatagcaacttccagcaacatgaaaagggaggaagcttccagcccagttcccgcctgatttcttcatatagtacagtgtgtagagtgtttagcaatagggtgggtatagcaagttctggtgggttctttataatttgacatgatttattaatgtagtatattgtattttctgaagatggttacggtgacatgttacattccctgactgattgaagcataattgataaataaaattgcttgcttctcatgtggacattgtggcatatatgtgtgtgcctgtatacatgtatatgtatgtaagtatgtgtaaataattaaaccaaggtaattaatagtcatgagccccatgcccaactgactttgaaattttaatttttgaagttaaactaatttcttccttacatttcctccctttaacccctctcatgttcctccttgctccctttcaaatgaatagctctcttctctttgttatttttacacatgtatgcatacataaacatataaatacaagttgctcagcctctttagtggctatgtatgtacagatttctgcgctgaccacttggtattgggtaatcagtcaggggagccacccctaaggacatcctgcagctcctgctgctgcacgtgtctgtggctcctttttggggctaagacctcctgagctttccccttccgtggtagcatgtctattgctgttgaacttgtagaggtcttgttttggcatccacatattgttgatgcatcatgggtgaagttttgggatcatttctaggagaaaggatctcagtcactgcagatttcctggttctgagatggtccccgggccttaggtgcggagttttgttatagatgcgtctgccgagtgtggctgggcacccccgagccccacttgagctttttggattgtatatgaacatgagatgggaaatgtttgccccctttagcacagtgtcctccagattcacccatgttactgcaaacgacagtttctgtggttagtttttctcacctttgtctcaggaggtgacagtttccttcagggtcacgtttccttgtcctcttcacctcttgtctctcttatgctgtcatcttccttcagatgtcagttctgcctggttacctttcatttcagaagaaattacaggggctggagagatgatgcagcagataagactgtgtactgctcttacagaggatccaacttctgtttccagctcccagaggggctgctcacaactacctgttgctccagctccaggggatccaatacctttgccttcctctggtacttgcactcacagcccacatagccatggccaggcaacacacacacacacacacacacacacacacacacacacacacacatttaaatataaactaagtaagtcattaggaaggcaggctggaagctctgtagtagatctccaagttccactataggtgggtgagcagtctgtgtggaatgagccgtaagtgctgggatgtgcaaggcttttgtgacatcctaaggcattttctcttcttaagagaagatgaaatgcagcattctgaattgaggagactatcaggcctaccgtttccactaaccccaagttcatcctgtagtaagcccagttcttcatagctggtacttctgaacttgaagcacctattgtgcttcagtctcagtcactaccaatctccagcctttctgggcgtgtgttggatgttgataatgctgaagatttcacttttatgccctcggaagactctgatcacgttagtaggtgtgctgaccacaagactgcctgtggtactcaacaggtgctacaccacagtggtgcctggagttgactttacgtaagccagcttatcttgactttgaaatctctcatctgttattaaatggaaataaaacatggcagaacaaaatgcacagaatgcttttacaattacacagacccattcatggtcatacctgtaccctcaatgatattttaaataactactgcttcaaaataactaataataaaaatatatttgtgttttgtttttattaataacttttgcttgttggcaagtccatgcatatgatatactctggtccttcttcccctccttcttcttttccttcccaccccctccacccccctctttcctaaaatcttttccctaaattatgactttttcttttgccttatatatcacagaattgaatagggctattcatgtgatcatgagtttggggatatacattaaagcctggctttatgtaccacactagtaggtatagaactggacactacagttcccccatccctgtccccatttctagaatctgtttagttagggggagctatgacattaatagtttttccaagctgtgagcttccttcagattatttaaaaattttttacatacatgggtttgttgcctgcatgtctgttatgtgcatggagcccacagaggctggaagagggcgtcagatcccctggcattggagttacaaatggctgtgagccaccactgagtgctggaactacagtctgggttctttggaagagcagctagggctcttgatgccatctctctagggaaattttgataatttttgtaataaatttactaagtattctattagtaatttaggccattaaaactccattacaatgactctaaaaggtagtaacagtatacacacatcacacttgcttaagactgaactgtgagtgaccagaactaagtctctccaggtggaaggcagaggagagctctgctttggaccaattccagtcctaagtgacatccaggaagaactctgagtctagtttagcagctgaaatctcctggagatcttcacttctcagtctctctatttcaagtaccatctcatgtcaatggcagtgtatacagcccctctatcttaaccattctgctctgtgatatgacatgagatgagtaagacaaaggtgaaggggctagcacaggaaatgtctgttggcaggaaggaggtgtctcagggcacatttaaaaatagctgttttactctcattagaaagggttccgggaaatgggctgacatcagcttgaaactcaccatttctggaggactgttatgaaaaatcatctccggtctcttcacacacacaaaaaaattcgaccaagttagaccagagatttctttaagtctgagagtggaactcatgaattgaaagaaaatgtcagtttatgtagtatagagggaacacgaaaaatgaacagaaattgttgagaaagaaactgtagggctggaaggtgttactgctgacctgtggaatctgttataaatgtctttctggactgggactgtatctggacatctgtacgcccagcatcccaattactgaaggtttcaaacatgggacccttcagtgcacagggcagtacatggaaaggtgagaggaggcttagaaggcccatggtgaagaattgaggtttgccaggacctctctcagaaccacctggttgcctggtgactctgtgccaagttactaaatttcacagatgaacgtgggaatcaaagtcacttcataaatagattttcctggtgggagggttggtaatctgactcactcccccgccaatcactcttatttttagttgtgttagggatccaaaatctaagctctttcctgctgatctctgcttgagtaactccccagagcggatggttccttggggcttataaactgtgtggatgtcaagtatgcgaaaacagtgtggagatatgaggacatgaggttcttctaatatgtatatatgtgtgtgtgtgtatatatgtatatgtattgtgtgtggatggagagattgaatagaatttgaaaggagactgtcccaagttgaagaggtaggcatgaagcctgaagcaaacagagagagagagagagagagagagagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatctaccaacaaagggtaacctcttagggcagtgctcctgataaaaaaacttcacaacttctctctctttctctctctctctctctctctcacacacacacacacacacacacacacacacacaaacactagcagcaatcaattgcccacagctctccttagatagggcaagagttcatgagcccttccccatcagcactgaggttttggtccatgcaaatttttgtgtgaaatgaccttgtcatatccagcaaatagtgtttcactgcagtgttcaatgactccagtcttttcacccctcttctgtaataagccctgacccctgaggagaggagatatgatatagatgtgctatttaaatccaactgtatcatgaattatatgacatgtaaaaatacctaaatatccaaattaaaagtagattctatttatatgctattaacaaggagctctcttctctctctctctcttactcaattatttctttctctcatttctttcttttttttttaagctcagctgcccagaagttagtggcttcttcttcttttttatttatttattgattgattgattgattgattgattatatgtaagtacgctgtagctgtcttcagacactccagaagagggagtcagatctcgttacggatggttgtgagccaccatgtggttgctgggatttgaactccggttcttcggaagagcagtcgggtactcttacccactgagccatctcaccagccccctttctctcatttcttaaacaaacatacaggagattcaatatcactgccagccaagtcattgtcattcacatttacagattgttctgccaaacaagagctgactgaccgttatttactatgatggaccatattgcagtcaactaaagtcctggtggtgaaaaaacgtgactattgatttatcacattccaagtgctaagtagctaccagcagcccatgggtaccacatgagatgacacagaacaagaggactgcagaacgttctgcagtgcagcttgctaggaagatgggtgggtcccttgcacactcctatttccacagttcctccccctcgcttcctctctgctactctgttttcttggtgtttagtattgtttcgaaatcagagaaggtcaaaggacccagattttcaggtaagagaatagggatggacgatgtgggtgttgaatttggtgaggaaggggcctctctactagctgtgtctagtaaacctcctgacagacctgctcttgggaattgtattcattggcttctgtttccagcctgataattttaggctgtagtccgagttgaaggctgagttctacaaattcctgtgtgcttcagggttcactgctttgaggaggacactttttctacagggaaagtattcctgcactggtcaaaaaaaaaaaaatttttttttaaatgtgactcttccaggaagagaatgactgagttagcttggagagagcaggcaggaagaaggcagggatgcggaggatccctaacaggctcagcttggcacagctcccccaagctgccataatgttgggattagcactagcctttatctttttcctgtaagctgcttcctagggaacctgcctcttggggaaactatttcccccccgagttcttagaagagctgagctccctccaggtaggtctaagtagggaggttatgtttactgtggctactgttctgaagccagtagtagacgtttggtcataggcagagcggggatgacttagtcaatgaaatctgcacctacagaaacacaggtcctggttttacagatgaattagagtctaaagagctcctctgtcaccctgtgccctctgtctcccccgaccccgagaaagttttgagaaattttctaccattgatactgggcctccttgctaatcaccaaatcaagtctgtgctaagaaccaatgctttgtgtgagtttgtggtttctttttagtttatgagaagctgtcttccacccacctggccttcaggcataaaaagcctctttcaaaagaagcatctagagttctgcttcacacctgtatctgagggctccctgtgtggggactctgtccttaccaaggagcattccaacctgtcctgattgtagttggctccagagttttcaaatgtgttcatgtgtattaggtagaggaaacactcaaatgagctgagtgtttctacataaccgtgtcttggttaacagggaaggatggctgggtggcacaggccacccccaagcagagagaggtaaagacccaagaaggtcaatttgcttgtttagtaaattgagacccgccctttgtccagtgctgtgtctgtgcctggaaagtttcctgtcacagagtcaaagaggagacagtcatatgctaaaaaatgatttcgtgttacaatcatgtcttcgatgaggaaatgctgctgtgcagttacagcaaaagcaagtgatctcaaaagtggagtctcaggttggcactgctgcaggagagagccattggagagagcatctcaggaagtagaggcagagcagccccagctgggggatgggctggagcagtgcccccagaaagggaaaattctgagaaagcataggagataaaagtgcttcaagggtcctgggaacagaggggaggtcagtgacttcagcgaaagatgtccatgaaggaacttctggaccattctaatagttcaaactatcctctaaagagaatcaaaagctgctagggaattcaagcaagaaaatgaaaatgaaattttattttgaaagtgagatctggtggtagagttgtgaagggaccaaggaagggatgattgggctgacaatgaacagcaatgggtctgatcaacatgaaggtagaaacaaagggacaaatgagatttctgaatgtagtcattgggatttggtgatgggctcatgcaaggcaggaaaccaagactagagtagagctcaaagctcagcaagagccatggtctgtgtggtgatagcatttatggagatgcagagtcaggcctggggtgtgggaggagtgtcaagggctctatcctggtcagcctttgttagagatgcccacgaaaaccacgatgagaagctgagccagaagtgtgggcaccatagtagtcattcactagctgaagggatggagggaaacagggccagcctgagaaggagctggtaggatttaagtttgtgtaaggaaaagaatagcctgaaaaatggaatgttgaaatgaccttttggggatggggcaggagaaataaaaaggctgagtttatggcaaaaagttcagtgttggatacaggaagtggggctccaagtggttttcataacttgccgtggtcgcttctttatctgcaggaagccgagctacaatggaagtccagtgcggtggtgcggggttcatcccagaaagttcaaggagcagccatggtgagaagagctgggatgtggggtggagtgtaaccaaactgcaggagaagtggggaggcagacaaggaggggtgcagtccctcctgccttgaccacgagtccctactgaatgggagaaaaccctgacgccgccctggtatttcttttcatttctctgctttcccattcctcttgactcagctgctctcccactggtccagagcttgacatagccctccctttcctcctctccttcttttcccactcttgcttgttttgacatgggcttccacacacactgtggccctggtcagcttggaatctgggacagacaccctgctcctgtctctccagtgcagagtgatgggtatgagtcaccatgtctgccttcagcacaacttcttacttcctctttcctacaggcagaaaggctgccatggcctctctgcttgtggcctttctggtcacatctctgtcctttcctgaaggagaatcgagagaaagcaatgtgggggtcattggtccctcgtctggctccttgcacccatcacccccattccaatcaacaaatgaatcagggtgccattgagcttctgatcctcttcccgccatgttcattaatgtcagttgagattttgctcgtttatcaaactaccttacaacatagtagcttaaaacatcagctctttctttgaaccacaccagttaaaactggcctgtgactcatgctcctgccagagtgccaatacgctcacagatgcatcactcatgtacctgtggcagggtagttgttccccatcagtcttgacagactcacagacaggtgtgtgtacttcagggcttcttaaacacttgcctccaatgctgcttttttctcaagaaatttttatgtgaccctaggtacatacatatataaaataggcttctgaaatgaacttttgatatacttactgaatggcagtcttacaatttcctattatacatttacaatatcaatcaaccctaaagattgacatgctctatcctccaaggtcaaatattcaatcaaaccttacttcagcaagacaaaaccaaacccaagtatagccacctcaccaatgtgcaaacatgttcttttaagttgaagacaacagtacatttatttactttaattttcttatttaattttcttatatgtatgctatgaatatatgtatatatgtgtttataatttactgtttcttaaagattaaagtatatttgccccatttgtatcacaaggaaattcaggcagataggatgaataatttttgtagaactattatataacatagtgaacatacttagtaccatattttacagttcataagaaagcagattttaagtgcttacactaccagttatatgagcaatggagatgttaaattttgtgagtatctttttaagcaatgtattgtacactctagctacatacaagctgtgttttacaacttgtttttgacaacaccaaagaagcgtatgtcatgtacaagaaaagtaaatatgaaaattaaagttaatgaatgtattgttgtcttcaacttaaaacaacatgtttgcacattggtgaggtgggtttggtttgttttgcaaaagtaaggtttgattgaatatttgaccttggaggatagagcatgccaaacaatctttagggttgattgacattgtaaatgtataataggaaattgtaagactgccattcagtaagtatatcatacaaagcagtgttagtgtcaaatttaagtccagacgtctctggcaatgtttattggtgctacagggtattaacaagtatttatgttgtttggtcagtaacaaggttgctgtttcatcaaagaacacagtcaagtgctatcagagtcattacaaattcattacacctttgatttcaaaatattttttagtcattgtgcattcagaatcttttactgttgctaactttttctcttcttctccatgttcaactttgtggccccacatgaagtcacacctatactttaagaagctttggtatagtcaactagctcttgggcaggccggggtagagggatctttcctggctgttactgtcagggaa

SEQ ID NO: 1244 - DNA, 1360 bp, Mus musculus
ggaatgagggaagttttacttcatagttcagtagaaaacttgaaccaggtcaaattggttccttggagagatcctgaactctcattaactgttgcagaagaagatctgtgcattcagatctttagagtcagcttgccttgacatggctggccagggagacactgaagtgaggatcattctggtagggaagactggaaatgggaagagtgctacagccaacaccatcctcgggagacgtcaatttgattctaagatttgtgccaatgctgttaccaagacctgccagagagcatacagggagtggaaggggaaaaaccttgttgtagtcgacactcctgggctctttgacaccaaggagaccatgaaaaccacatgtttcgagatcagccgctgcgttctctactcctgccctgggcctcacgccattattctggttttgcgactggaccgttacactgaagaagagcagaaaacggtcgctctgatcaagggtctttttggggaggcagccctgaagtacatgatcatcttgtttactcacaaagaagaccttgaggatcagagccttgataattttgtaagtgatgcgggtgaaaagctcaataatattatctcccagtgtgggaagcgttacttggcctttaataacaaagcagctctggatgagcaagaaaatcaagtgcagcagctgatagaactgacagagaaaatggtggcccaaaatggcggatcctacttttctgacaagatatataaggacatagatagcaggctgaaccattgtctagaggaactgaaggagacttatgctcagcaactcactagtgaaatcgaaagaatagaaaaggaatatgctgctaaattagaaaaaggaaaggcggcacaaattgtttttgcacagagaaatcatgatgaaaaattaagaaatttgaaggaaaaggctgaagagactgtatttatgtatattttccaaaagataaaagaaattctttcaaaactttgggacgagttgtggtaaattttatttatttatttttattaacgacatttgtttttgacaatttcatacaagcacacatataatgtgttctgaatatattaatgacttgcttggtgctgggagccatggcctcagccattgccttgtggacattttctagcttacataaacaatcctgacagaacattcgtggtcataacaggaagaatgtgggtaaagaggacactgtgaccgttgtttccagaacctcaagattgccacctgaccttcagagcgatcccagactcttcccccatcccctgaagcctcctcttgcttatgctcatattgctactcctgaataaaggttttcagagcttg

SEQ ID NO: 1245 - protein, 309 aa, Mus musculus
LLQKKICAFRSLESACLDMAGQGDTEVRIILVGKTGNGKSATANTILGRRQFDSKICANAVTKTCQRAYREWKGKNLVVVDTPGLFDTKETMKTTCFEISRCVLYSCPGPHAIILVLRLDRYTEEEQKTVALIKGLFGEAALKYMIILFTHKEDLEDQSLDNFVSDAGEKLNNIISQCGKRYLAFNNKAALDEQENQVQQLIELTEKMVAQNGGSYFSDKIYKDIDSRLNHCLEELKETYAQQLTSEIERIEKEYAAKLEKGKAAQIVFAQRNHDEKLRNLKEKAEETVFMYIFQKIKEILSKLWDELW

SEQ ID NO: 1246 - DNA, 26230 bp, Homo sapiens
  misc_feature (1)...(26230): n = A,T,C or G
tcaaatgcaaggcagagttgcacatttctcaccttcaaccaaaagctagaaatgatgaagcttagtggggcaggtatgtgaaaagctgagacaggccaaaagctagacctcttgcaccaaacaattagccaagtttgaatgcaaaggaaaagtaattgaaggaaattaaaagtgctactccagtgaatatatgaatgataagaaagctaaacagccttactgctgatatgaagaaagttttattggtctggatagaagattaagccagccgcaacattcccttaagccacagtctaattcagagcaaggaccccacaattttataaagtctgacagaggtgaggaagctgcaggaaataagtttgaagctagcagatgttggttcatgaggtttaaggaaatgacctgtccccattacataaaagtggaaggcgaagcagcaagtgctgatggagaagctgcagcaagttatccaggggatctaatttagatcactgatgaaggtggctacaataaacaacagattttcaatggagacaaagcagacttttgtaggaagattatacatccaggactttcattgcttgagtggagaagtcaatgcctggctccaaggcttcaaagggcaggctgactctctcattaggggctgatgcagctgatgactttaagttgaagtcaatgctcacttaccattccaaaaaaccttagagcttttaagaattatgttcaatctattcttcctgtgctctataaatggaacaacaaagcctgatgacagcatatctgtttatagcacggcttactgaattttttttttcttttttctttttttattgatcattcttgggtgtttctcgcagagggggatttggcagggtcataggacaatagtggagggaaggtcagcagataaacaagtgaacaaaggtctctggttttcctaagcagaggaccctgcggccttccgcagtgtttgtgtccctgggtacttgagattagggagtggtgatgactcttaaggagcctgctgccttcaagcatctgtttaacaaaccacatctggcaccgcccttaatccatttaaccctgagtggacacagcacatgtttcagagagcacagggttgggggtaaggtcatagatcaacaggatcccaaggcagaagaatttttcttagtacagaacaaaatgaaaagtctcccatgtctacctctttctacacagacacagcaaccatccgatttctcaatcttttccccacctttcccccttttctattccacaaaaccgccattgttatcatggcctgttctcaatgagctgttgggtacaccccagacggggtggtggccgggcagaagggctcctcacttcccagtaggggtggccgggcagaggtgccctcacctcccggacggggcggctggcgggcggggggctgacccccccacctccctcccggacggggcggcgggccgggcggctgacccccccaccgcttactgaatattttaagcccactgttgatacttctgtttagaaaaaaagattcaaaatattactgctcattgacaaagcatttggtcacccaagatctcttatggagatatacaaggagatttcatgcctgctaatacaacatcccttctgcagctcatggatcaaggataattttgacttttgagccttattatttaagaaatatattttataaggctatagttgccataaatagtgattcttctgataaacctgggcaaagtaaattgaaaactttctgggaaggattcaccattctagataccattaacaacattcatgattcatgagaggagataaaaatattaatgttaacaacagtttggaagaagttgattccaaccctcatagatgacttggaggggttcgagacttcattggagggaatcactacagatgtggtggaggtagcaagagaagtagaattagaagtggaggccaggtgtgttggttcatgcctgtaatcctagcactttgggaggccaaggcaggaggatcacttgaaactaggagtttgagaccacactgggcaacacagtgagatcctgtctcaacaaaaaaaaaaataattagtaaggcatggtggtgtgtgcctgtagtcccagctgcttgggaggctgaggtgtgagcatcacttgagcccaggagctcaaggctgcagtgagctatgatcacactactgtactcaagcctgggtgacagagtgagaccctgtctctaacaacaacaaaagaagaatgtaggctgaagatgtgactgaattgctgcaatctcatgataaaacttgaatggatgaggagctgcttcttatggatgagaaaagaaactgatttcttgagatggaaatgacactatgagaatgaaaaggcataagaatgatacaatggactttggggacttggggaaagggtgggagggaggtgaagaataaaagcctacacactgggcacagtgtacactgctcaggtgatggcaccaaaatctcagaaatcaccactacagaacctatccctgtaaccaaacactacccaaccccccaaaacctattgaaataaaaaataaataaaatctccttcttcatctcaaaaaaaaaaaaactacttttggcgaagatgctgtgaacattatgaaatgacaacaaaggatttagaatattaaataaacttgataaacagcagcagggtttgagaaggttgactccaattttgaaacaagttctactatgcttaaaatgcgatcaaacagcatcacacatgctacagagaaacattttgtgagaggaagagtcattctatgtgacaaacctcattgttatcttagtttaggaaattgctacagccaccccagccttcagcaatcaccatcttgatcaatcagcagctatcaatactgaggcaagaccctccaccagcagaaagattatgactcactgaaggctcggaggattgttagcatcttttagcaataaagtatttttaaattaaagcgcatatattgttttctagacataatgctattgcacatgtaatagattacggtgtagtataaacataacttttatatgccctgagaaaccaaaaaattcatgtggctctttttatagttacatttgctttattgcagttgctggcattgaacttgcaatatctctgaggtgtgcctgtagtatctataaaggggtgagaagggtactcagcatacagtaagtgatcagcaagtgtcagctagtagcagtggtgtcagcaatagtaatggtaatggtaatactcttgatgtcagtcccaggatcgtggtttggtctccttaagctcacgtattatacaatttcacatcataggtgtccagatacataaatagaactgaaggccctaaagggagagacagagttggcgggcttggaaagcacttacctcatgttacctatgcactgcagacagcctcagcctccaattccaagaaaggactgtgccttattagcagatatgaaagttctcagatgctgttgattcatggttcagcagctcctcctctgcctgtgtatctgaaaacacttccctcctaagtcttcaaaaaaggcaaaatcataagcctttgctacaaaacataccttccttcaggcagggatcaatgtgggtacagacattgggcctgacccagtttgtcttctatctggaccgtcggatagatgatgggtgatgaaggcacccagggacaccggcactagggccatatctagagtgtgatgtctgagagtggttttcacttaatcaggtacaataaggccactactgaggaatagtgattaacattctatgtgaggctaatgcctccaaaaccctccaaaaccctcccaagaaaattaacatggtagctgtcatctaggctcctcgtctcacaggcagtaagtcagtccactacctgtcacgctgggaacctctgcaaattttggagacctcacaaaaaaggaaaattcacctacatttataagaactgcatgaaaaatctattggaaaaagtgtctttgtcttggttttctacatttgtgatagaaaaacaaataatagaacttttcaagattcattttgaaaatttccaaatagaagttcattctttggcattggtagttatttaatgctgttaggctctggatttcctgagcaagcttaggaaggcctatctggctaattaaaactcttgctgtatatatgtaaataaccaagctgtacataataatggcattgagggatcaagaataattgttggagattatgtatgatcacaaggtagaaaatgacattaaaatgatccaacatgtggaaataagcaaaaggcattattgggtattctttctgtgtgatgcgaggcttgactactgtctaagatactcaactctgttgagaggtaacttgcaattttgcttatagacaagtaaataatttttttgtctggcagaacgtataccccaaaattacattttatggctgatatggtttaggtctgtgtccccgcccaaatctcatgccagattgtaatccccaatattggaggtggggcctggtaggaggtgattgggtcatgggggtggtccttcaggaacagtttggcaccatcccttgatgctgttcttgcgatagtgggtaagttctcatgagatctggttgtttaaaagtgtgtagcactgccgccttccactcttgctcctgctccagccttgtaagatgtgcatgcttccccttttccttccaacatattgaaagtttcctgaggtctcccaagaagccatcatgcttcctgcacagcctgtggaactgtgagccaattacacctcatttctttataaattacccagttgcaggaatttctttataggagtgcaagaacgggctaatacaatgaccatcttaggaacagtcattaaatgggcacaagggaaatcttatccccctacaaattacccaagattctcaaatgtcctttgaactaattataatgtcttactggttttctcgttaatcaataagttaagtaaaatcttttacatgcatgtattttaaatttgcatgaaagtcatgaccttgcttttttttttttttttcctaattttactttaacaggaaacacagagaaataccacaagcaaagcctcagtagtgggactatgagacacagagaagattaaatgacttgaggagggatctgctggggtctgaatgtttgtgtatcctcttccaaattcatgtattgaaacctaatcctgaagtgatggtattaagaggtagggcctttgggaggtacttaggtcatcatggtggagccctcgtgaatggagttagtgcccttataacaggttagagagaggctccccgccccttccaccatgtggggacacagcaagaaggcaccatctatgaatcaggaaacacaccatcaccagataacaaacctgtcaatactttgatcttggatttctcagcctccagaactgtgagaaacaaatttctgttgcttataaattactcattctacagtattttgttatagcagtccacacagactaagacaggatcattaaaagcatttgctgagcacctgtgctatttcagaaactgcctttatacctctgtctccttcagctatgtaaaataggtattaacaggaactgtgattggaattttaggtaagcagagctgcactgaaacattaagttgcctctcaaggagaggaatagaggaagatttggcccagaaagaaagattgaaacactgtaacaatagctgaattccaggctaagcaataaggatgctaaaccttatgcagtaagaacttcccaactaccatgacatggactgtccgcatgggcttcaccaattcattgcaactgggactgcaaaggaagagatctagggtgtttcactctcaaaatgcatacactgtcctttcttatttaaccaccaattttctattcacaatttagaattgtatccactaaaagaaaatgttcaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgtggggcaagctcttctaatccaatgacttttttccttagaaaatgagtgaaatttgaataagcacacaggggagaaaaccgtgtaactctggaggcagagattggaaggatgcatctacaagtcaaagagtagcaaggattgccagaaaccactagaagccagaaagaggcaaggaaggatcctcccctagagtcttcagagagagtgtggccctgttgacaccttgtggcctcaagaactgtgagatgataattttttcttgttttaagctacccagtttgtggtaatttgttacagcagccccggaaactaatacagacttgatattgggaggaacaagtgactgttgctttatatagcagagcagtctttgcagatgtgattaaattaaggctttcacagtgaggagattatcctggattatctaggtgggtttaaatgtaaacacaaagatctttctaagggggaaacaagaaagtcaaagaaggaagacaatgtgaagatggcaggagagattggtgcgatgtggccacaagccaaagaacactagtagcatagagatgctggaagaggccaggaacagattctctcgtggagcctctagaaggtaccctgctaattagcctgattttatccccataacactcattttggacttctgacttccagaactgtaagaggaaaattttatgttgttttaggccactacatttttggtaatttgtcatgatagcaataggaagctgatactccaaggttacataatctgtgtaagagctaggacagtactatacctttcatctcctgttattatttgtgcactatcttaataagttaagctttgcattgatttagcatcatggcggcagaagaaaagccccgagttttgtgcacacacacacatacacatacacacaaaatcaaaaacataatgttctttttttatttttatttttaaacacagtattcttttttaatacatttcaagcgaatcacttaatgtgagtgaggctgagttagatgttaccataagtattaacagaagaaaaagggaaagtaaagacattttccctctaccataaaagggtctgatgcaagataaactagcctgttggtttaacaatagctcattaaaaaggccagacaatctgggagaagaagatgtacttagaagcactatcctttgaaggaccattcccaagaggacagcaaaatattgaaaaaattaactggctcaaaaattatattgagagatcaagacagttagccacagcttagaaaaatttcctgaataaataacactaactagctaggttagtagttctgatgtttccttggagttgtcatagcactctgtgtgaaccaaagggactacaaactgatgcccctttgaacagagtgatttgaatagattctccagtgcaccaactgtattttcaagtataattctggtatttgtacctagcaatacagaagaaaaagcagcaaggagaaagtgtcaagtatataggacataagatgatttgccagccctagctagaattcccaatatgaatctttttcatcaggaaaaccacattctggctcagtccaaggtaacaccggaggcagtgatattgatggcttgttataagcaggaggcaacagtgaaagtaccgaatcctggctttcttctttcatctgtttgaagaaaacatgggacaataaactgcttgctgatggccttttctcaggatcttgttgcaaacacagctgtaccaagctaaagaaggcaggagagaaggtttttgaggatggtgtgtgtaatcggtcactatttactgtgtgagttccactggagacaagcacacttgctccaatcccagagtctacacctgaccgggaatttttcattttggattctgattgagggaaaatactgatatccaatgggctataagggggacctttcagtttctgttaacagcatctgagttctatgcacgtcctggaaaggcacctgcccactggctaattcacatgttgtaatcccaacactgtaaatatctgacttcacattatacccatgtaaatcctgtctcagtagttctggactcagccatggctgcactaatgtgctgaactgtgggaaatcatacacagccctatgcctctgtccatgcttaaccaaactatgcagatgggacaggccagagagggtcactaggccatcaccagaaatgaggatatggctggctttaattctcctgtgaatacagccatattggtagagatagttcaatcctctcactgctccaaagagaatgtttcttattaaagttttactcattccttcaggaaaataggtcctcaagagttgtcttgctgaaccataggccataaatggagaaataacccaaagccagctgccaacagtgaaaactgtccaataagttgtaatattgggatgccggaaaaagtgggatagaatcatggctttctgtaaaactttcaggcgttctttattgccgttttccagatttgtaatttttgtagttaccagcgttcccgtaggagtatgccgtgctagatggacagaagtcaacttgtcaaatcctcttcctatttctacttggagctcgtagtgagaaacgttggcggaacatactacttcactggctctagtggatggaggcgaccaggaaagggttggctcttcgaccaagtattgatggatactggtttcagacttgtttttcatgtttgagtgattcaacttgtgttcttgaactaaagctcacagaaagtgacaaaaatccaaatattccaaagaaggcttttgttttatcttcctttgaagatgcagatatatcctacttagcggcgacgacggccagcgactccctacaggctgccagtggtgcggacctgggcgggtgccggagcccggatcacagaggggcaaggcgagcgctctaggcccactcctggcgtggggcgctggagggtggcaaggccgcgacaggggctgtgggcttggaactctaaacatagtattcttacgtagccaactggaatatctggtcaaccgtgagagctttgggaacctgcctctcacctcaagaaacctccagagcagattggaaccatccactgggtaaattctggaaaatctgtctctgcctgagactggggtaggaggatgtggggtagagaggaaggtggggaagggatgtaggatctattccttgggtgcatctttacttgttaggtcatgcatattttcaaacttggaagaattatacgaaaagcaactagagaaactatgtgttcatgggcagattatttttccaggcgtcaccttcctttttttcccttggttcctaatgatttagactctgcctttgagcctcagtgctgttaacttttgaatgagtaacttgaggccttcctgaaagactataataaaaaacccatattatacaatcactaagaacccccagctctacgcttggaaatggcaaggtatatgcctgtctctcttcttccccaaatcacccctcagcctcccactccaccctgggaagacaatcaggtcctgtgccttgttttctaggcaatatttgggtcatttaataaggctcttttgcatccatcactataacctgaagcgaaaaatgtagctttggaaatggtgtttatagcaggcccatgggcaaaacgtttcaaccgggcaaaactgaagcaatcaccagattatggagccgtatttctgtttctttaaagacaaacatttttgtgtgtgtggctccacccagcctgagcttcctgactgagaggttttggtggcggtacagacacttttaactcacagtaaaagcaaaagcaacagctcaagcagcctccttggagaaaacctgaaaattcaacttgttcaagagaaggtgagcctggctgagaagagggtctggtgctattgggctgcgaagggcagtggggacagggtgtgtggctggagtggactctgcccttaggagggacaaggcactgtgctaagcagcactgcatagaaggtgctgtgggaggggtgagtagaaggggagtgaggagatttgtttgcatggagcccatgcatctcatatgtaacaggacacacatggctgcatagtgcaccctccactcactggctgttgtgatagacacagagtgttgcctgataaccttcataagaaattaagggctcctaagacagatttgtaaaggtgacaggcaatttagagtccacctgtctaagtccctcttcttacagaaaaagaatcagaatcccaatcccagagattttgatgattctccaaggggtacccagatcactcatggcggaggaacactagaattcagtctgctgactttttccagcattaagcagagacaagctgtgtccctaacagtgtaacatgtggggctgctgcgccattcagtacaaaaagagttgccataaaagacctttatagaaatcactctatgaaagcctaaggacaaccctgcaagattggttttattttccttttttatagcagagggaactggatctcaaggagctacgaaattttctagaaccggtgggtctggccacagtttagaactgttcacctctgttgtaaatgcttttgtcatttctcagcctttctcttagctggaggtcctctggatcttccaggaaccacttgagaaagttttaaaacttgagaaagtttaaaacttgagaaagttttaaagtgatatttctgaccatctctctcacgtttggcttctcaatatgagagagatggaaaagtccacgagaaatgcggagccctcctcacggttcccttataacaggctggctcccagctcacctttttgcagaaagcgtggatcatctcctttgccctccactggtctatctctgtgccatgtcaatgaaaatttagaatcatggcctgagagtagccaagaacaggcagtagagtgcacggttaagagtgagcatggtagattcagacagactttgaatcgaatgtcttctctgcccaatacctcttagcacagtgaccaggggcatgtttcccagaatttttgagccacaccagcttcctcatttaaaaaattagaataataaaattagtttcactgtagagtatttttgaagaataaacgagatatacaaaacatgttttatcagggtgttctgatatgcagtctctgctcgatagtggttacactatacatgggttaatttttttatttgtgaaaaatttatacttattcaaaggtaaaaacaatataaggaacttccatgtacctatattaaaatctcacagttatcaatttatgccagtcttgttcaaatatctgctcctattctcaactctatcacagattattttgaagcaaatgtcagacattacatcattttatcagtaaatatttgagtatgtgtctctgaaagataaagaccatttaaaaacatttccacaatttcataaacagccttcaaaaggcaactataaattttaatactaccagttgtattcagatttccctgaagatctcataatttttaaaattgtttgaggtaggatctaagtaaaattcatacattacaattgtttgacatctcttatgtttcacttaatgtgtaggttttcaccttccttgtttctttgtgttaaatttctttgtttaaggaagggaaggtcttttgtccaacagaactgggcagtattcatactgctgattgcatcctaacaatgtcatttaacattcgcttctagctccagtgttttgtgtgaatttatatgaatggggaggttggatcagattaaagtttgactttgtttttttagtgggaatacttcatagatgctatcctaaacttctattagaaggcacatatgtttgaatgcctctctttttgtgatgttagcagatgttaatgattgtctagaatgaatttgtttcattaaaagttaccaaaagatgatattctatcattctttatttatttattagatggaatagtcatacacaaaggaactttcattcagtgattctttcatttttgtgagatatagttaaaagatgagatgtatgaaagacaaaataaatgcttctttccctttagttgtcaatgttcagaatgatgagtcactttcttagcatactccaaagggagcaattaacttctttcaggaagatggtgttgttatcaactactggatttcaatatatttggtatattttaatccattggaataatctttattaatgatgctcaaattattccatctttgtccagttggaacctctttaagctagcttccaagcccttctgataaaactaagtaattttttatagcatccctactttctagtatgaaagatgttgtaggctaaacttgtatgtttactggcccagacctggaatcagtactttttcctagtagtcctaatttcttttgtgggaaataccatttgaagatcacaatctgggcattaagtgcactcactgctacttggctgaccatggtttatgccttttagatggacttcaaaacagtacacacacacacacatacacacacacacacagtgaaattattaatactacattttcaagcctttcaggacaaatctttgtgtggttcatccttgacacaagatacagttaggtttatttgttccgtttcttttaacttttactggtgttttaaaatataatttttattgtataattatgtaaactatttaaatgttctcaagatcaaatttgcaaaaacaaaggatattcaaagaagtctaatgaccattttctgttcctgtcccttgtaccttgtttctctcatcttcatataaataattcttttgtttagttttcaaatggttctgccattgctttttcacatgcacataaaaattatttatatatataaaactaatattccttcttcttatataaatgatagtaaactatacattattttcttcacttggctttttttcacttagcagtatatcacagagatctcttcatactggtatatagatatatttctcattcctttttgcagttggattgtacttttctgtatgaatattccttagtttattcaactggtccccactgatgggcatcattcctttctgtatttttgtcagtgcagctctgggataaatcctaaaatcgggattgataatcaaagagtaaatgcatgtgtaatttttcaaggtattgccaccttctcctctataggtgttaggttgttttccccttcacactagtcatgcaagaaattatctgttttccccatacctttaccaccagattatgctgggaaatggatttttgccatacctatagtagagaaatagtgatctctgagaattttttattttttctatgtttttaattatttttctctattgtgaatgaacttggatatctttttatgtattcaaggataatttatatatttttttctttggccgtgggttcatatcttgcccgattttctatcaagtcattggtcttttgtttctttacttttagctattcttcatacagtaggaaaagtagccctctttgagataaatcggaaaaaatgttttcctagtttgatatttgtgttttaatttgcctatggtgttgtatgccttacataattttttggatttttgtgtaatcaaacttatcagtcttttccttatactattttaaatcttagttattaacatcctccccactcccaggttacaaaaaatttacccgtgtttctcttattatttatatgggatagtttttgcattcaaatttctgatctatttggaatttgtatgatatgaggaattggaggcaattttatctttaaaattgcatccaattatatggtggtatagttatttcagtgttgctaataaaagtgtccatcatctttcccattggtatgaggtgttgcttcacagaatgtaagttaatgtaattgaatggaatataaatgaacataaaatgagcaatggcctatttgtgaattctctgtttctgtttcatggcctgtctctattcactcaccaatatcacactgctttaattatagagattataatatttaattgtctggtagagctagtcttcccctgttcttcttttccttgattgtctaggctaacttgcattttccttcatctgaatgaactttataatcaactattttagttccagaaaaaaagatgacaaaattgaaaaaattatatttgtataaaatcatgttaaagaaatagatattttttctgttctacaaactaccgtaaacatgaatcagtgttaaatttggccaaatatctttcctgcatctagctaattttcttcttaacctattaacgggatgtgttgtaacaatcaacattctcatattgacccaccatagtatttctgaaataaatcacacttaatcacagtctattatttattagtgtctaataatttatttaggatttgtatattagtattcacaaatgagacacatctttagttttctttattgatgaaatatttgtcagcctttggaatcaatatacttgcttcatagaaaaaaaaagtaactttttccttctttttatatggccaggagcagttttaggtagctttgagatcatcagatcttaaaaggtttaatagaattcacctgtgaaaccatctatacctggtactactttgtggggaaactctttaactgctttctctattatttcgtccatattaatcggactatttcatttctgtctttactgtgattaatatggataataggatattacaaattttcaggaagaaagagaaagcagaaaagaaggttgggaatggatctcacttactaaaactggctttttttcccctatcttcccctccttaaggtcttgtacgtgcctaagttctagagcctcctgacgtgagcatggctgagagtgaggaccgctccctgaggatcgttctggtagggaaaactggaagtgggaaaagtgcaacagcgaacaccatccttggagaggaaatctttgattctagaattgctgcccaagctgttaccaagaactgtcaaaaagcatcccgggaatggcaggggagagaccttcttgttgtagacactccagggctctttgacaccaaggagagcctggacaccacctgcaaggaaatcagccgctgcatcatctcctcctgcccagggccccatgctattgtcctagttctgctgctgggccgctacacagaggaggagcagaaaaccgttgcattgatcaaggctgtctttgggaagtcagccatgaagcacatggtcatcttgttcactcgcaaagaagagttggagggccagagcttccatgacttcatagcagatgcggatgtgggcctaaaaagcatcgtcaaggagtgcgggaaccgctgctgtgcctttagcaacagcaagaaaaccagtaaggcagagaaggaaagtcaagtgcaggagttggtggagctgatagagaaaatggtgcagtgcaacgaaggggcttacttttctgatgacatatacaaggacacagaggaaaggctgaaacaacgggaagaggttttgaggaaaatctacactgaccaattaaatgaagaaattaaactagtagaagaggataagcataaatcagaggaagaaaaggagaaagaaattaaattactaaaattaaaatatgatgaaaaaataaaaaatataagggaagaagctgagagaaatatatttaaagatgtttttaataggatttggaagatgctttcagaaatatggcataggtttttgtcgaaatgtaagttttattcttcctaatttactgtgatttgttaatggatgaattgtattttgcaaagatagttagagaaatacctccttccccttagctttattaaggtatcattgataaataaaaataaaatatgtttaatgtatataatgtgatttttaaatatatatatatatatacacacattgtgaaataatgaaataaaggtaattaacacatctagcacctctcggttactattttctttggtgtggtgagaacatttaaggtctactctcttagcaaattgcaaaaatgcaatacagtattattaagtatagtcatcatgctgtatgttagatctccagaggaggttattcatcctgcataactaaagttttgtaccctttgaccaacatttccccatttcccccaacacccagtccctggcaatcaacattctattctttgcttctgtgcattctactttatcaaattccacatgtaagtgagatcaagcagtgcctgtctttctgtgcttagcttactttacttagcatactgtcctctgggttcatcgatattgttgcaaacgacaagatttacttctttttcaaggttgaataatgttcctttattaatggaatgttaataatgcactgcattttctttattcattcatctgtccatggacgcacttgggttatttccatatcttggctattgtgaataatgttgcagtgagcctgggagtgcagatatttctataataatgctcattgcagcattattcacaatggataaaaatatatttcagtggaatatatatatagtcgtttataagccacctagtttatggtatttttatagcagcccaaatggactaatacctaaaggaaatgaaatatatctttatccactggaatatatatatatatatattcagtggaatgtgtatattcaggggtctctcttcagcctcttttatgagggcattaatttcatttctggagcttctgcccccatgacctaatcacttccctagggcctacctccttataccatcacattgggggtgaggatttcaacatatgaattttggggggacataatcatttagaccataacattctgttcctggctccccaaaatgtatgcccttatcacatgcaaaatacattactttcatcccagtagcctcaaaaatcttgttccaacatcaattttaaaatgtaactccaaagtctcatctaattatcatctaaatcagatatgggtgagacttaaggtacaattcattctgaggcaaattgcttaccagttgtgaatcagtgaaatcaagtatattatgagcgtcaaacatacaatggtgggacaagaatcaaatagatgcaataaaaaatgataaaggggatatcaccaccgatcccacagaaatacaaactaccatcagagaatactataaacacctctatgcaaataaactggaaaatctagaagaaatggataaattcctcgacacacacaccctcccaagatcaagatttctttttttttttttttttttttttttgagacggagtcttgctcttttgcccaggtcagagtgcagtggcgcgatctcggctcactgcaagctctgcctcccgggttcacgccattctcctgcctcagcctcccgagtagctgggactacaggcgcccgccactgcgccctgctaattttttgtatttttagtagagacggggtttcaccgtgttggccaggatggtctggatctcctgacctcgtaatccgcccacctcggcctcccaaagtgccgggattacaggcgtgagccactgtgcctggcaagatttcttacccatgtatgatttttataatactatgtatcggggaacctgccccgataatcacgtaggttcttttctatatttcctaagcgtcggctggcttgagaaataaagggacagagtacaaaagagagaaattttaaagctggacatccgggggagacatcacacgttggtaggatccgtgattccccacaagccacaaaaaccagcaagtttttattagggattttcaaaaggggagggagtgtgcaaataggtgggggtgacagacatcaagtacttaacagagtaatagaatatcacaaggcaagcggaggcagggtgagatcacaggaccacaggactgaggcaaaattaaaattgctaatgaagttttgggttccattgtcattgataacatcttatcaggagacagggttttgagatcaactggtctgactaaaatttattaggcgggaatttcctcttcctagtaagcctggcagcgctatgggagactggagtttatttcatctctgcagccttgaccataagagacgaccacgccccctggggagccagttcagagacccactcccaggtgcgcattctctttctcagggatgttccatgctgaggaaaagaattcagtgatatttctcccatttgcttttgaaagaagagaaatatggctctgttccacctggctcaccggcggtcagagtttaaggttatctctcttattccctgaacaattgctgttatcctgttcttttttcaaggtgctcagatttcatattgctcaaacactcctgctgtacaatttgtgtagttaatgcaattattacagggtcctgaggcaacatacatcctcctcggctgacaggattaagagattgcagtaaagacaggcataggaaatcacaagggtattgattggggtagtgataagtgtccatgaaatcttcacaacttacatttagagatggcagtaaagacaggcataagaaattataaaagtattaatttggggaagtaataagtgtccataaaatcttcacaatccatgttcttcagccatggcttcagctggtccctccgtttggggtccctgacttcccgcaacaactacgcattgatcatttggaaatactgactcagttatgcagataatcaaataatgacagatttcattatatacttacagcagctgatacaagctgtctaaaatttttgcttaaaatctaggaactttatcattgaccataaatactaccactattttccctaaagcaaaggctcactgttttcaagaaaatgtctgaaagggaaaaatagaaatgaagaaaggagtgacagttaccaagcaagtccaaaaccctatggctcaagaataatcttttttggcttgatgctctcaaggcccactgatctggaggtccggccttttggaccctttttgatggttgtccagcctccaaagttttgcctgtccccacagctttgctgagctcagcacacaccacaccagagcctgctagagctgcacctaggggagccgagcagcatggcaacagagtgtggggagcagagtccacaatgtgaggtaatgctgagcagcagtggcccctcctttgaaattgttctgatcccctgggccctagcattctgtgatggcagtcagccctactgatttctgaaatgcctttggggtcatttttccattgtcctggacaataggtccttgcttctgtttagatggctcactgccttgatcaatagcacatgacttccattgagacggctgatccatactaattttctttatcaaatgatcaataggccacatcattttctcttctgaaaaagctttcttatctttttccaatatggatagactaagaattttctaaatgtttaagttctacttccctttaattaacaaatccatttttatttctctcttctcacattttactataggcagtgaagagaagccacactgtaccttcaacactttgcttataaatttcctcttccagatatccaattcattactcacaaattctaccttccacaaaacactggaacaagaacacaacacagccaagttctttgccactttataataaggatttctgttctttcattgtccaacaacacattcttcatttctcactggtgagacctcatcagaatggtctttactagccatatttctaccaataacctaagttattggtatatctacttaggtattcactaagaaaattgaggatttctgaacttcagcagaatcatctttaatggtccattcacagcaatgcaggatttttctagcacaaagctctcacttccagcctatacttattacccagttccaaaactgcttgcacatgttaggtatttactacagcagcaccttcagttcttgataccaatattctttcttagtttggagtgctattacaaaatactataagttgcatggcctataagcaacagaaatttatttcctacagttctggaggctgagaagtccaaagcactggcagattcagtgtctagtaaaggcccatttcctcatagacatctatcttttcactataacctcacatggtgaaagggacaagggtcttctcttgagcctcttttatttttgtttttgtttttgttatttgttatctgttttttgttattttgttttttgttatttgtatttgttttgttttgttattttatttttttaaacttcctattgagcctcttatataagggcattaatcacatttatgaggtcactacccccatgagctagttacattccaagtgccccatctcctgttatcatcacactaagcatgaaaatttatcatcacattaaacatatcaattttgtgggaacataaacaatcagaatataacagatatatacccagaagcttgctggattatatggtagttcttatttttaatttttgggggagcttccatcctgttttccataatggctgtaccaatttacattcccaccaacagtgtacaagtgttactttttctccacattcttgccaacacttgatatcttttgtctttttggtaatatacaggtatgagataatatctcattgtggttttgatttgcctttcattgatgattactgatgttgggcatttttttcatattcttgtcataaagatatttgtatgtcttattttgagaaatgtctgttcaggtcctttgcctattttttaattgggttatttgtttaattgctgttgaattgtttaagttccttgtgtattttggatattaaccccttgtgagatgtatgatttacaaatattttctcctattccataggttgtctcttcacactgttgattgtatcttttgctatgcaggatatgttttgtttgagataaccccgtttgtctatttttgcttttgtggcctatgcttttggtgtcataaaaaatcatcacccagatcaagattttccccatgtttcttctagcagtttacagttttaggcctaccatgtaactatttaatccatttcgagttgatttttttaagataatggcccaatttcattcttctgcatgtggatatccagttttcccaacaccattattgaagaaactatccttttgtctttgtacattctatgttcaactgaccataaatgtgtaggcttatttctgggtttattattctgttcattggtctttatgtccgtttttatgctagtagcataatttttgattactatagctttgttttaattataatagtatgttttgattgctatagctttgttttgattaccatattttgaaattaagtagtgcgagggccccagctttgttcttttagttgaagattgctttggctacttagggtcttttgtggttccatatagattttagattctttttcactcttgtgaaaaatggaattagaattttgacagaatttcatcgactatatagattgctttgggtagtaaagacatttaacaatattactttaatccataaacattacacacacaaacacacacacacacacatatagtgtatatatatatatatatatatatatatatagtgggggtggtgtgtgtgagcggcaatgtcttttatcaacattatatagttatcagcatataggtctatcacctctatggagagatatattcctgagtatcttgggggtagctattgtaaatgggattgtttctttaatttcttttttgtagagtgaattgttagtagatagaaacacaactgatttctgtatttttttttcaagtggagtctttggttttctatgtataacatcatgtcatctgtaaacagaggttattttatgtctttctttccaatttggttatcgtttatctctatttcttgcctaattgccctggctagaacttcaagcaccacggtaaaagtggcaagactgagcattcttgtcttgttcctgatcatacaggaaatgctttcagcttttcaacattgagtatggtgttacctgtgggcttgtcacatatggcctttattgtgttgaggtacattctttcttttttttttcaacttttattttaggttcagggatacatacaaaagtttgttatataggtaaactagcatttctaggtaaattaaactagattacttcatcacccaggtattaagcccactacccaatagtgatcttttctgcacctctccctactcccactatccaccctaaagtagaacccagtgtctgctgtttccttctttgcattcataagttcgtatcatttagcttccccttataagtgagaacatgcggtttttggttttctgttcctgcattagtttgctaaggattaacaacctccagctccatccatgttcccggaaaagacaaaaccttattctttttgtggctgcatagtattccatgttgtatatgtatcagattttctttatcaaatctgtcattgatgggcatttacgttgattccatgtctttgctattgtaaatagagctgcagtgaacattcatgtgcatgtgtctttatggtagaatgatttatatgcctctgggcatataagtaatgagattgctgggttgaatggtagttctgcttttagctctatgagaaattgccatactgctttccacaatgattgaacaaatttacactcccaccaacagtgtataagcattcccttttctcagcaacctcaccagcatgttatttttctgactttttaatagtagccatcttgaccagtgtgagataatatcttattgtggttttgatttgcatttctctaatgatcagtgatgttgagctttttttcatatgcttgttggctgcatatatgtcttcttttgaaaagtgtctgttcatgtcctttacccactttttaatggggtagtttatttttcttgtacatttgtttaagttctttatacatgctggatattaaacctttgtcagatgcatagtttgcaaaaatgtctctgattctgtaggttgtctgtgactctgtcgatatctcttttgctgtgcagaaactcttatttagataactgtttgtcaattttgcttttgttgcgatagcttttggtgtcttggccatgaaatctttgcccagtcctatgtcgagaatggtattgcctagttgtcttccagggtgttcatacttttgggttttccatttaagtctttaatccatcttgagttgatttttgtatattgtgtaagcaagaggtccagtttcaacagtttcaatcttctgcacatggctaaccagttatcccagcaccatttgttaaatagggagtgttttctccatttcttgtttttgtcatctttgttgaagatcagatggttgtagatgtgtgaccttatttctgggctctctaatctgttccatttatctatgtacctgtttttgtaccagtactatgctgttttggagattgtacctctgtagtatagtttgaagtgagtaatgtgatgcctccagctttgttctttttgcttaggattgcttttgctattcgggctcctttatggctgtacatcaattttaaaatagctttatttctagttctgtggagaatgttgttggtagtctgatagcaatagcatttaatctgtaaattgctttgggcagtatggccatttaaacaatatttattcttcatgagcatggaatgttttttcatttgtttgtgtcttttctgatatatttgagcagtgttttgtaattctcgttgtagagatcttttatctccctggttagctgtattcctaggtattttattctttttgtggcaattgtgaatgggattacctttctgacttgactctctgtttggatcttgttggtgtataggaatgctagtgacttttgtacattgatttttgtatgctgcagctttgctgaagttgtttatcagctcaaagagattttggcccaagactatggggttttctagacatagaatcatgttgtctgcaaacagacatagtttgacttcctctcttcctatttaaatgttctttatttctttctcttgtcttattgctctggccaggacttcatcctatgttgaatagaagtggcaagagagggcgttcttgtcttgtgcttgtttttaagaggaatgtttccaacttttgccaattcagcaatgttaactgtgggtttgtcatagacggctcttattattttgatgtgtgttcctttaatacctagttgactgaaagtttttaacatgaaggaatgttgcattttgtcaaaagcattttctgtgtctattaatcatgtggtttttgtctttagttcagtttttgtgataaatcacatttattgatttgtgtatgttgaaccaaccttgcgtcccaggaataaagctgaattgaccatggtggattagctttttgatgtcctgctggattcagcttacaggtattttgttgaggatttttgcatcaaagttcataaagtatattggcctgaagttttccttttttgttgtgtctctggcaggttttggtatcaagatgatgctgacctcatacaatgagttggggaggtgtccctcctccttaattttttggaatagtttctgtaggagtggtaccagctattctttgtacatctggtagaatttggctatgaatccatcatgtactgggcttttttttttttttttttttggttggtaggctatttattactgattcaacttcaaagctcattattggtctgttcagggaatcaacttcttcctggctcagtcttgggctggtgtatgtgtccaagagtttatccatctcttctaggctttctagtttgtgtgcacagaggtgtttatcgtagtctctgatggttgtttgaatttctgtggaatcagtagtaacattcccttcatcatttctgattgtgtttatttggatcttctccatttttttccttattagtgtaactagaggcttgtctatcttattatttttttcaaaaagccaactcctagatctgtttgtcttttgaattttgtgtgtgtgtgtgtgtgtgtgtgtgtctcgatttctttcacttcagctctgattttggttatttattgtattctgctagctttggggttgatttcttcttgcttctctagttctttcagttgtgatgttaggtttttaatttgagatctaactttttttttttgagacagagtctcactccgtcacctaggctggagtgcagcagcatgatattggctcactgcaacctccggctcctgggttctagtgattctcctgcctaaactttctgagcagctgggactacaggtgtgtgccaccatgcctggctaatttttgtatttttagtagagacagtgtttcaccgtgttagccaggatggtcttgatctcctgaccttgtaatctgcccatcttggcctcccaaagtgctgaaattacaggcatgaggcacagtgcccagctgagatctaactttttaatgtgggtatttagtgctataaatttcccccttaacattgccttagctgtgccccagagattctggtattttgtatctttgttcccattattttcaaaaaacttgttgatttctgccttaatttcattatttacccaaaagtcatccaagagcatgttgtttaactgcatggatttaagcaattttcttggtcttgacatctattcctattgtgctgtggtccatgagtgtgtttggtatgatttaagctcctttgcatttgttgattgttttatgtccaattacgtggttcattttagagtatgcgccatgtggtgatgagaagagtgtatatatattctgtcgtctttgggtggagacttctgtaaa

SEQ ID NO: 1247 - DNA, 1225 bp, Homo sapiens
cagacacttttaactcacagtaaaagcaaaagcaacagctcaagcagcctccttggagaaaacctgaaaattcaacttgttcaagagaaggtcttgtacgtgcctaagttctagagcctcctgacgtgagcatggctgagagtgaggaccgctccctgaggatcgttctggtagggaaaactggaagtgggaaaagtgcaacagcgaacaccatccttggagaggaaatctttgattctagaattgctgcccaagctgttaccaagaactgtcaaaaagcatcccgggaatggcaggggagagaccttcttgttgtagacactccagggctctttgacaccaaggagagcctggacaccacctgcaaggaaatcagccgctgcatcatctcctcctgcccagggccccatgctattgtcctagttctgctgctgggccgctacacagaggaggagcagaaaaccgttgcattgatcaaggctgtctttgggaagtcagccatgaagcacatggtcatcttgttcactcgcaaagaagagttggagggccagagcttccatgacttcatagcagatgcggatgtgggcctaaaaagcatcgtcaaggagtgcgggaaccgctgctgtgcctttagcaacagcaagaaaaccagtaaggcagagaaggaaagtcaagtgcaggagttggtggagctgatagagaaaatggtgcagtgcaacgaaggggcttacttttctgatgacatatacaaggacacagaggaaaggctgaaacaacgggaagaggttttgaggaaaatctacactgaccaattaaatgaagaaattaaactagtagaagaggataagcataaatcagaggaagaaaaggagaaagaaattaaattactaaaattaaaatatgatgaaaaaataaaaaatataagggaagaagctgagagaaatatatttaaagatgtttttaataggatttggaagatgctttcagaaatatggcataggtttttgtcgaaatgtaagttttattcttcctaatttactgtgatttgttaatggatgaattgtattttgcaaagatagttagagaaatacctccttccccttagctttattaaggtatcattgataaataaaaataaaatatgtttaatgtatataatgtgatttttaaatatatatatatatatacacacattgtgaaataatgaaataaaggtaattaacac

SEQ ID NO: 1248 - protein, 308 aa, Homo sapiens
VLEPPDVSMAESEDRSLRIVLVGKTGSGKSATANTILGEEIFDSRIAAQAVTKNCQKASREWQGRDLLVVDTPGLFDTKESLDTTCKEISRCIISSCPGPHAIVLVLLLGRYTEEEQKTVALIKAVFGKSAMKHMVILFTRKEELEGQSFHDFIADADVGLKSIVKECGNRCCAFSNSKKTSKAEKESQVQELVELIEKMVQCNEGAYFSDDIYKDTEERLKQREEVLRKIYTDQLNEEIKLVEEDKHKSEEEKEKEIKLLKLKYDEKIKNIREEAERNIFKDVFNRIWKMLSEIWHRFLSKCKFYSS

SEQ ID NO: 1249 - DNA, 23640 bp, Mus musculus
  misc_feature (1)...(23640): n = A,T,C or G
gaaatgagcctttaaggcttggtaagggcattcatagcccctcccaagaggttcttgatctacatctgccctccatgaccctctgagacccactcattcttcccagaagcctctaggtctattattgtctgtccataagcctcttgggaatctttcatctgtcctgagcctagggccttaaacctcccttctcaaaatacttaagaggattccccttatctccccaaggagcctaaaaacttcctcccctttatattctctatatccttagctgtcttctcataaagccatatggcttcctttgtcttttgcaggagcgtctatttttttcttaattattatttatttatttaatatacatgagcacactgtagcagtcttcagacacaccagaagagggcatcagatcccattagagatggttgtatgccaccatgtggttgctgggaaccgaattcaggaccactggaagagcagtcagtgctcttaactgctgagccatctctccagccagcccccttgcaggagcctctagttctgcaaccgccttcccatgatgctctggacccacatgcccttctagtcgcctctgggccttacatctgccttcccatgagtctcagcgactcatgttcacacttaggagccattattcccatgtacatagcacacaccttttcagagatgaggtagaggaggccctaagcatagaaggggtcatgcccacctagaccctaaacagcaaagcacagccagtgctagacttcaaagctacatggcatggttccagaatccatgtccaaaatgagtacaggtgggagggaagagggaagtccgggagacacagagtactcactctggaacattccatggtggcccagagctccctgaccagaactggaaaagctcagtggcctagagaggagacacggatgagggtcagacatcccctgtggccattacagccccatccttccatcccagattctccacagcccccaacccaagccacctgagggccagaagggcccagcttggcctggagggaaggggcggagatgagctgtgccgaagacatggtggccatcgtctggaaggccttgtccttggagacttggtcctgaggaatggttgagattcaggttagtggggagttctaattaagttctaattaagatagccagggtgggatgaagacatggggagccgtgatacagggtcagggaggggtcagctccccacccaaaccttctgtctctgctggcctcctctggaagggcagtgtgtgaggtacagatgtgggaagatgggcagggggactcagcacattcagagtctgacccagggtgggggaaggggccaagggaagaaagaaaacaccttaggaactgcaggttctacttcatctccctgagcaccagatgaccaccctgaggcagcgagagactagggctacccatggaacaggtcacacctcagcctcagagaagaaaggtttgcacgcccacaataagacgcttatggttttctaagtcaagaaaagcctggacacagcgtttcctgatgcccagggaacaggaagggagactttccagatgcccccggggacaggaaggggtgtttttattccagacagaacatagaaaagactgagaaaggaaagaaaagatcagaacctaagggtttcaggcctacaaaaaaggaagggaccatttccaaataaaagaacaggaagtctcattcctgaagctaaaaggaaagcaaccccacagagggccagtgacacgggttcaggcttgagggcacagggactcatggtagagaaaagagagtagatgacaatactttctcataggaaagtgcacagccaagggaggcgaggatggagtgggggacaggaaaagatcagcagggacaggggagggaaggatgggagcagagagagcaacctgtttgctacagcagccacatgacctactgcttgatgagcaggccagcacctgcaggcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttccttcactggtgtgtgtgtgtgtgtgtgtgtgtgtgtgtgtgtgtgtgtgtatttcaccaactctctgtctctgtctggccccacttcccatgtatgtgtctttctctctgggttgtgtaccctcctctatcaaaatctctctctctctctctctctggcctccccatctgtctgagtctgtctgtctgtctctgggtctgtccctctttccccatccctccctctaagcatcccactcagcctcccctgccaacgccctcccacctgcctttaccctcaccttcagcttggactgaatttctctcgatttccttcgagccaaaacctgaatatggctggagacctggagggatgagaagcaggtctgagcatccttcatcaactgccctcccttcccccggaggccgcacacgctgctcttccacaggtcacacagcatgaaatcaaaggctgtctaaagtgtaagcctccaggcccaggcccctctttgtaataaacctacagaaatcagaccgacaagacggctcagcagtaagagcacttagcaccaagcctagttccaaaggtccatccctgagacccacatggtggatggagagcaccaactcctgaatgttgtcttctgatttctacatgtatagtatgtctcaaggacacacacatacacacaccacacacacacaccacataattttctttaaaaagtacttaaaattttttgtgatatattttatgtatgtggattaggtgcatcatggtgcacacacagaggtcagagggaaagttgtgggagctgggtctcctaccatgggggccccagaaactagctgagctaaggtaatcaggcttagcaacaagccctttacccactatgccatttcacgggcacaaaatgtaaacattttaccgaaatatccggcatccccacaacttagagaaaaaccacacaacaaggccagaaagacgatggttcagtcagtgaagcttgccctccctgcatgaggactttagttcttcagtccttgtatactcaatcccggcactaggagacacagataggtgcagactggcacttgctggctacccagtctagtcaaatccgccagttccaggccagtgagagagccagtctcaaagaagtgggcagctgctgagatgaaaccggggtctcccactgacctccgcatgctggcgcatgcacacgcatgtagaggggcctcctacactcacatatacatacgaaccacatcatcagccttgaacctgacccagcccacatggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccacccacctgcctctgccacctgccttatttttattattttgagataaggtcttactaggccaggctagcacagagctcagtatgtagctgagaatggccttgaactgttcaggtgtgtgccaccacagttggccagactctggacacttgggttagtgtgacttttctccctggggtcaggacagccaccacaggggactcaccatacatcttgccctcatctgacaggatgatcttgcgacggccacagggagggtagatggccagggcctcctgaaaactctgctcaatgtcggggctccacacaccttctgcatcagggctgccatcacctccaacgccctcgctgcctccggtgccctcttcgctgccttcctcgctacctgtccagcccccgccatcatccaggggggccccagtccggggatcccccatctgggcctgcagagatgaagatcagcagctacatatggtattgcaagaacaggcaggagcactgcctgagagagaaagccaggcctgaacctgaacccctgggtctgagggaaaaagaggaacctaagcctgggacctgggaggctgttcttccagtgaggaatttgcattgggactgcatggggttgaagccacctgaccaactcaggtgcagtgcctgaggctgtgtttggatttagggaagaccagagtctcgttaattggcaggagtgagactctcctgtcccactaagaaagaacaggtgctcagagaagggcagcagctgctggagaagcagaggctaagtccaaaaccaacacccagagagaaggggacagagagatccagggacaaaaatccagatcgacacagcaaaagggggcatagtcagggcccagaccagaaagtaaccacagaatcaggcgggggcggggctgggtgcccatcaaacttcaggccttgggactcagtcgcccagccatctggaggacagaacaaagagcccaggcatcccctcccccagttccccacaacccctgctgtgggcgaggccagcatgcgagcagcggccccgcccctcccccgggctcggttccagcccaagttcccatcgactttccggaggccaagaacagggaaaactttccccatacagtcagatacctcctccctagaggttttatgttatccagaactcccaggaccccaaagttctgagtcccatccctccaattttggactcttgacctggtagagagaggttaggtgaacaaagatctcaagcccagcccagtgtcgcgacgacgttcaggacccccacaggccgaaatcccaacccagcccacccccatgtggccagacaaagagacagacgagccaggcaagacagacggacatctctaatctcctgacccagtcaccaatcctcggaagaccaatggccgaaggtccaaggggccctatggctctcccttggccactcccgctcctgccctgctccgtgtgggggccacatgcccacagggcggatacttgcacgaaggatggcccaggggtcgaactaacagaagacccgtggtcgctccttcgctcccacgtcctgcatccgcagcccccggccaccccgcgcgctcccccagccgcagaccatccccaggcccctaactccggagaaagttccagctccacacttcggctgcttcccccgcgcaaactccggccccggggcagaaaagggctccgggcagttcccacgcgatctcaggaacacgcgcctcacctcatcgcgcggaacttcccaccccaactcacaaaccccaagcaggatcccgattcccgccggcgccttcctacctcccggcctgggcaggggagccgcgggcgggcggggcgagacccagagaaagttgccgggagctttgtttgggaaaagtgggagggaccgggggggggggggcgggcccggcggtaggcttggaatctcacagggacactcgctgcgaggtgcttgctttaggagagatgagtccatctaaggactgggtagggttgctggggtccctaggagagaaggtggttatgggggcctggattcatgactttagaggaggaggctggggtttgtaactctgggtcttaaagaagaatattgggatctggaccctgggtctgaagaagaaggtactgggagttgaagggagtagactcccagatagaagaggagacatgacctgggtcaccctgggtgtttgctgaggatgtgggattgacagatacaaaataatctttaccaaacttatgtgggttttttaaaaaagattttatttattttcttaatgtgagtacattgtagctgtacagatggttgtgagccttcatgtggttgttgggaattgtttttaggactgctgctcactccggtctgctctgttcggccccactcactcagtccctgcttgcttcaccccaaagatttctttattattacacataagtacactgtagctgacttaagacacactagaagagggcgtcagatctcattacaggtggttgtgagccaccatgtggttgctgggatttgaactcaggaccttctgaagagcagtcagtgctattacctgctgagccagcccattttgtgtttttattttactctgttttttaacgtttacattttatctgtatgttttgtctgcatgtatacctacagaggccagaagagggcactgggcactggatcccctggaactggagttacagatggttgtggtcaaccatgtgggtgctgtaagtcaaatccaggtcctctggaagagcaggcagtgctctcaatccctgagccatctccagccatgtatacttgtgtgtgtatagaagtgtgggtgtggggcgtggtagcacatgcctttaatcccagcacttgggaggcagaggcaggaggatttctgagttcgaggccagcctggtctacagagtgagttccaggacagccagggctacacagagaaaccctgtctcgaaaaaccaaaaaaaaaaaaaaaaaaaaaaaaaaagaagaagaagtgtgggtgtgggtgtgtaaaagtggagatgaaggtcagaacccgggacctcacaagggctaggcagaagttccagctcaaagctgtatctggtccaaccagtttctgtgtgataagtaaagtgctggggtgggttggtttgcttctgatgagaacacagcttccttgtgacctggccagagtgaagcctgttgggctggaccccctgcgtttctgaagatccacagaagtgcagactccacaactgcttaggcactagtggctgcaagtggctcctatcccacttagaggcagagcctggctgcctgagggcagagagttggaacccagggttttgttctcttcaaactgaaggtctgggtaagagtgatatcactgagttacagtcccagctcctgtggagttgaagctagccagggtgttctagtttgttttctattactgtgataaacaccatgaccaaaagttggggaggaaagggttaatttaagattgccattgtgatccatcaccaaatcaccaggaaaggaacctggaggcgaggcaggagctgaagcagagaccttggagaagccctcctcaccggctcgctcagccttatagcgcctaggaacactggcccaggggcgaaaccacccacagtcagctggcccctccaacagcaatcattaaatctctgccctcaggcacccaggctctgtttatcctgggacaggggccatttctgtggaccttcagaaacactgggagtccaggtcaataggcttcctgctggccaggtcacaaggccctgcagacttgcctataggccaatctgatagggatattttttcaactgaagttccctcttcccagatgactctggctcttgtcaagttgacaataaaaaaaaaaacaaaaaaccaaaaccaccaccaacaacaaaaactaaccagcacactgaaatacaaacatcctttgagaaaacagacaaaatccccccagccagccagccaggtaatggtggcataggccttaatctcagcactcaggaagcagaggcaggtggaccgttgactctgaggctcctggtctacagagtgagttccgggacagccagggctacacggagaaaccctgtctcaaaaaaagaaaaagaaaggaagcaagcaagcaagaaaatggctatgagctggacagatggctcaaggaaaagaacttactgccaaccctgacaacttgaattcaatgtccagatctctctctctctctctctctctctctctctctctctctctcacacacacacacacacacacacacacaggtcacactgctcagcatagttcaaggccagtctgggatgcataagaccctatttctaaatttaaaaagcaaaaatatgagaaaaagaggaaaaagaagcgctggctgtcttcaaactcaaagccaagagtcgctggcatatgggctctgtgagtctgaaagggaagcttagacttgggatttcttgggaaatataacacagggctgtaattaggggttttttggaggtagctgggttttttaaatgaaatcatccggaaaacgagaaacatctacagtaatgctcggagagtcaataaatgagggtaaaccagatggcggagtgctgaaggcacttgcagccaagcttgagttcgatccaggggacctacacggtggcaggtaagcagcaactcctgacagttgttcactaccaggcatggtggcgcacgcctttaatcccagcacttgagaggcagaggcaggtggatttctgggttcaaggccagcctggtctacagagtgagttccaggacagccagggctacacagagaaaccctgtatcaaaaaaccaaaaaaaaaaaaaaaaaaaaaaaaaggttgttcactgacctccacatctgcgccatggcagttctgtgtgccaacactccgaataaataaaattaaatgaatgatcttagacccagatatgggtgaacagggatccaaggagttctggaatacagaggcgtgacctgggtggagcattgctctagtttaaagggcgtggccatctgtgatggatggttgactcccttgggagagttaggatcagagaacagtagacagagaacagtagggttccggagctgaggccaatgataagtccaggtaatagaggctggaggataagatcatcaagtggaagcgtggttatagaataggagcgtaatcaggagaggacctagtggtcagacttaagggaagtaggtagtgaagaatggaggtcatgaagaagcatgcgcacgggaggaaggtttatccctgggcacatcaactccgggcaaaggcagggagacaggtggctgtggcttaaagcacaagcttgtgccttccagagagatccggggagaatttaggtaggtcagtgggcggaggcgtggtcaggaaaaagagggcgtgtccctttgatgagtcatagccaaagaggaaaatctttcttaaaagacgttgttgccgaaaagaagggtggctctcaggcaccaggtaaaataaatgcctgttttatgagtaaggtcaccaggtgtagacgtggccatccacgaggagtatggcttaagaggtgtggtcagtcaacaatacagatgtggatatgccagagacccgatggtggagtagtgaggatcctaggcgaccgtgtgtggagggcgtggtgagacaattagggcgtggccagtctcgcggagccctgacacccaacgaacgctccagtaatttgcccaggctcgagaccagaactggatattaactgtccgtatccggcggtgtccggagccgggtgaccgggtgtccagcagaaggcgcgaatgaaggcaaaggtaaggtactggatctgagtgaggctaaacccggataaggggcgcctgaaatggagagaacgcctacagaatccagggggatgcagggcaggtgggcggggcggagcgggtccctcacctagggtcggagcctggaaagagccgacaaggggtgattgtgggatctgaaactgcccttgtcacagcctcccacccacctgcaatgtgtcgactgagggtcttgctgctgctgctccccttggccttcgtgtcctcctctgctctccccatccatgatgtcgactctcagcagaacacctccgggttcctgggccttcagaggcttctccaaagctttagtcgactgttcctaaaagtgagtgatgggacagagacatgaaccaggcagaaggcagataagaaaaggagcaaacagaacagagagagttggagataagtcttagatgggcgagtggttgtctagcatgtacgaagccctgggcctgacgtcctgcaacaattacaccagcactcaggaggtgcaggccggaggaacaggagtgggaagccaccttcccctacacaggaagtttgaggtcagccaggaatacgcgagattttgtgtcgcagaaaagcaggtgttgggttgaacagatagttgggggacatgacaacacaaaataggaagagaagccggacctgtgattgaaagcctgtcatcccagctagcaggtcccagatgtggctaaggctcccatgaaatcccaacatgagaaagaaaaaaaaaaaaaaaagaaagaaaagaaaaacaagttcaaggtcagcctaggcagctttcatcaaaccctgttggaaaacataaaaagaggcaggcctggcaacccatgcacttgggaggtaagagacagggcaatgtctggatttgaggccagcttgccctgcatatcgagttccgggtcagccagagctacatacatagtaagacccagtcagaataaatcaataaaaagaggggttatagtggctgagggtgtgactcagaggtagagcccccaagccgggaggctgagggtgtggttagagggtacggggcttacctagcatgtgtgggtgagagggagagagaaggggaaggagaggtggacgccaggacaggtgaggaacaggagcagcaaagcaatgggacaaaaagatggatggggtttagtggctagaggctctggggatcggtggaccgaatgggactgatttggagggcaccctggaaggacagcgggtgtgcacaccatttccctctggccctagaatgacctgctacgagacctggacaacttcttctcctcccccatggacttccgagaccttcctaggaacttccatcaggaagagaaccaggagcacagaatgggcaaccataccctctccagccacctacagatagacaaggtgcctccctccgcagggcagcccttcctgcgctctccccaccacccatcaggctgctttccctgacaggaggggcaggtgagggaggaaagcaggtttgttctgactctcttgtgcaaccctcacaggtgactgacaaccagacaggggaggtgctcatctcggagaaagtcgaggcctccattgagccagaacggaacccggaaggggactggaaggtaaggaccttccttgccccgaggtgtccaggaatcagcatttttctatagccattcaccctgtgccatactgttccagtttcctctctgctgctgtaatgaagtattttagcccaaaacatacaaggaaggaaagggtttatctggtttgcatcccatcacttagggaaactcatggcatcgtttctactctcaagagcaaacagagagaaaacatatttgcttgctttctcctgtcttaggtggttcaggatccattacttaggaaatggttccacccacaatgggctgggtcgtcctacatcataaccatcttgatctagttaataccccattcagactctcttctctgctgattctaagctgtgacaagattggcatttaagattagccagtatacactccatacatggaatatccttgagatttctggagctcagtgtaacgtgtcaaaagggagaggacaataggcatggttaaacaaacacagatgatccagtacttgaaaagctgagacaggagggttgccacgactttaggcaaaaggcagaaaggatctctgtgagttgaagaccagcctggtttacaaagcaagtcccagcccagtgggggctacatatcaggaccctgtgtcaaagcaaatataaatgtcagaaagcgttttggtcgttccagaaagttttaggctttcccaacagctttataaatcttagcattcaaaaactccaccaatcccagaaatctggcaggccagtaagcccccaggatcctccagcctggacctcgtgagtgtagccattacaagcatgacctgcagctccctgtcactctgtgaatgctggagtccagactcaagctctcagatttgggcacaagtaccttttgacagtcccctttctgagacagggtctcactatgtagccttgactggctctgaattgtcaatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattttggtgctggaaagatggctcatcagttaagagcactgactgctcttccaaaggatccaggttcaattcccagcatcaaagtggcagctcacaactgtctctacctccagttccagggatctggcaccccctcacagacacacatgcaggcaaaacacccatgcacatgaaaataaataaatcttaaataataaatttaatacacaagaatgcagcaggccagacagaaaacagaactgtctgcctaaaaagggttttttaagcagcaagtgagctgtaatggaggttgagatggcccagtggagaccaaacatcttggatgcgctgtgcggcatctgaggagctccccgtgcctcattcccaggttcccaaagtagaagcaaaagagcccccggtgcctgtgcagaaggtcaccgacagcttgcacccagagccccggcaggtggctttctggatcatgaagatgccaaggcggaggacccagcccgatgtccaggatggaggccgctggctcatagaaaagcgacatcgcatgcaggccatccgggatgggctccgtggaggcgcccgtgaggacagcctggaggatggggtccatatcccccaacacgccaagctgcctgtcagaaagacacactttctctacatcctcaggccatcccaacagctgtaagtggggaccagatgtcccacaccctaccccaacaccatatggaaataaaggttttcttacatctagctcaatctccttttggtatctcttcccaaacaggccagaataacgactccatcctacacatacactcagtgctgacaatggctgtgccagctcttccttacatctcattcagaacatggcctcttggttgggcagctggatctcctgtagcaccatgatacacctggttccgaaaccattgatccaccctgtctgccatcccaagtctttaaagcacattgctgagccaccccagccaccaaaatatatattttttagattttacaaaattactcaagatctcacaaaagggaaagcaaatattgaaaaattaatattatgggggctggagagatggcttagcagttaagagcactggctgcccttccagaggtcctgagttcaattcccagaaaccacatggtagctcaccaccatctgtaatggtatctaatgccctcttctggtgtgtctgaagatagcaacaaggtattcatagacataaaataattcttttttaaaaagttattattttaaatttatatgtataaaaattttgttggcatgtgtgtctgtgcaccatatttgtgcctggagaccagaaaagggaatcagatctgctgggggtggagttatagaccctgtgagctgccacatgcgtggggcataaaaccatgccaggaaattcagttaggcatagcaagttcagacccagagactctgtgcacacctgaggcttaggcgactccctgctcccccaccccacccacagactcctgacttggaacacatgccatgcttcgcacataaatgtgtcaagctgggcatggtggcgcatgccattaatcccagcactcgggaggcaaaggcaggcggatttctgagtttgaggtatgattttacacatccattttccgccatgacaataaactgtttagaatcatagactgtctcttttcatcaagatctgctgtgggagccatgaagaaggccttcaccttcagagccacaacccactcccccatagaaggcttctctgcgctcccagtcacaacctccttcccttaccaagataaggacaataatccctgtgagactagctggagttccccttctcccccaacccctgccccaggctccaggctagatgctgtccccagacctcaggcccctgctcttccaggactcccagccgtgccaggatttccaagagtctgagaaccccacaaccctggccttgtcacaggcctgggaccccagaaggagctctggctttcccaccctgggagcaatgtcacttccttacagcccagcatccaccccagaggcagtatgggataagcccagtcaaactccctgcttctgtgtcctgagtggcctgcaatgtggatgctgggaatccatctcaggtgttctggaaaaacatccattgctcttaaacagtggtctatgtttccagccccaggaatggatgttgataatagggacaaagctaacagggtccagaatgcaccacaagttgtcctgaaaacacccggcagacctttcatctagaccaggcgtcctagtttgctttctactgctgcggtgcgtgagcaccacgatcaaaaacaacttggggtgagcaccatgatcaaaaacaacttggggagtctatttcatcttgtgatagatcacagtccatcacagagaagaggcagggtaggggctcgaaggaggaactgaagcttgctcagggttttgttttgttttttttcatacaacccagaagcaccttcccaggggtggtcttgcccacagtgggctgccatccacatcactcattaaccaagaaaatatccccacaggcttgcctactgacagggtaacttttcagttgaggttttcagatgactctggcttttgtcaaggcaacaaaaaactaaacagcacacacagggtctgatggtcagtaaggtgagaaagaccttgcactttttgcctctacctcccgagtactggtacactaccctgcccaattcactaggccctagggattgaatgagggcaccctcagtcaaacaccgtacccctgagctacatgcccagtccttatcattacatgcatgtgtttttaaacagcaaggggtaggaaagtgaacatgatagggtctgcatgtggaattcaggggccctccttgcaccatgtgggtcctggggattcttctcagatcgatcaccgggatgggtggcaagtgtctttactcttttttggtttggtttttttttttttttttttttggctttttcgagacagggtttctctgtgtagccctggctgacctggcactcactttgtagaccaggctggcctcgaactcagaaatctgcctgcctctgcctcccaagtgctgggattaaaggcgtgcaccaccacgcccggctgttggacccttaataataaaaaagttcgaatagtccacaggcatggactgaggcagggtgattgcttcaagtccgaagccatcctgggctacatagctaagcagtaagtagaaactataatagtttgggaaaacagcttgggtacctattaatgcggggggcgggggggggggagggaatggagcggaagtgaggctggaccagactgcgcatcattgtgacagtggcgggcgagccagacccaaaagaaagaacttggttcaaagactgacaagaagaaaaggatgaacagggagtccttcggttgaactctctcctgcttggccctattttgtcaagcagaaggaaaggatttttgtaccgcagaagaaagctgccgataatatcgcgccatcaccgctagccccactagtgcgcatgcactcgatcctcaggtccagcctatcctcccgagaagctctacgcatgcgccagctcaagggtcttcgtaaggagagacccgggcgccatccactcggagtgcgcttgcgtgagtacaagagcctgagagggcgggacttgcaggaggccggctcatttgcatttctggcgggaaaaggcgcgtgtgaacacgcctcttccgtgacattcgcaaccgccgttcgtcgctggtgtccctcaactgagtcccgactccaggtacgccctgcctgtggcgactttcatggcaggttccccggtaacatcacctgccagctccttcaaaaacgccccaagttttgagacaaggtttctctgtgtagccctggctgacctggaactcactctgtagaccaggctggcctcgaactccgaaatcctcctgcctctgcctcccgagcgctgggattaaaggcgtgcgccaccgtgaccggcttcctcaggaaaattctagtggcaacttcggcaatcctgtcagactcttgaaacttccggttgctttttgttgcttgttttctatttttgtttgagacagaccctccaagtgctgcccaggctggccacgacctcatgatcctcattccccagttttaggattacagctctcccagatgtgcccaactgcaatcttctagaacttttgaaacctaacacttaatctattttgtttttgtgggtagggtaggtgtttttgttttgagacagggtttctttgtgtagcattgactgtcctggaactctctctgtagaccaggctggcctgtgtgcttctggttcccacgtgctgggattaaaggtgtgcaccaccactgcctggcttttgtttgggtgtttttggtttttgttgttgttggggttttttgtttgtttgtttgtttttgagtattttgccggcatgtttgtatgtgtgtcaggtatgtgcctgtggagaccaggtggttttgtatccctctgaactaaaattgcagatgaggaggagttcacatgtgtgtagtgggattccaacccatatctatctggaagagtaaactgttagtcctcttaacgactaagctaccctccagggactctctagggcttcagtaaattgcccagactctactcaaaaccttggatcctgctgcctcagcctcctgagtgctggtatcacaggtgtagcccaccacgccagccgctaggatcttctagatatcccatcagagtctccctcaaaaacctgtcagagacttttcctctgaaatcttggtggagatttggtgttcaagtcctatctgatactttagaaatctgtagttgccctacaagttccgccggggactctgaaatctagtgacaccccagaaatgcagcccttgaattctagtccagggatcccctccagacttcctccatgtttaaaacccacaagacactcactggccacctgatatcccttgttcctcaagattttgtccgagtttccccttgaaagagtctcagaaagcctcttctttccctggtgccttctaaaagcctctgagatggacagcaggaggatccccactagctgaagaccagcctgctttacacagcttcagaaggcccactacagctaaagctacataatatatatttactaagtccctgtctccaaaagccagataataatgtctccagaaaacattcggctgccggaatacaggcaaggcagagtgatggctgcattccctgaggaaagggagagaggctgcttctctccccttcggtgacaaagatataggctggatcactccagattcaaaatagattaaggcgggcttacgaggaggcatcaacctccacccacctcacacgtggagatcagtgaagtcacacatccaggctaagcttagcaaaggtgttttataaagcttagacggggagtgataacgtgccagctaggggctgggattatgtccttacatggtcaaaagctgagaccccgggggcggggggggggttggcacttatgggtggatagctggaaagtggagaggagaggtgttagccccaagttttgtccttgtgggcagagttgaggggagaagagcaaaggaggtttcttagcttttgcaggggatgagcaggggttccaaacaaacaaaggggagccaagcaggaggaaacccaggctctctctacccttggccccagtccctagagggactactgacagtgcctccttttctcctgaaagtgactggccagtcgggcgtggtggccagcactagggaggcagaggcaggcagattggatttctgagttcgaggccagcctggtctacaaagtgagttccaggacagccagggctatacagagaaaccctgtctcagggaagaaaaaaaaaaagtgactggccaggctgtaatagaggcaggacagcactgtcagggtgcagaggagggagtccctgtgaccacagaagcctgtgagagtcaagcccactcataaatataggccttgggagtgtctgtaaagatgtctcagtggtaaagagcactgagttcaattcccagcaaccacatggtggctcacaaccatctgtaatgggatctgatgccttcttctgtcatgcaggcatgcatgcaaatagagcactcatataaataaataaacaaacaaacaaataaataaattttatttttaaaaagggggagcagcatggagatggctggtggaggagaaaaacaacagagttgattttcaacagagaagagcctagagagaaggcccggtggttaagagaacttgctgtgtgtcagcgtgagggcacatgcctttagtcccagcaccctgaagcaggtggatctcttgagttcaaggctggtattcctggcaagtgttaggccagccggatctccagagagagactctttgtttggaaaagaaaagaataagaagccactgagacacttactacttttgcaaatgaccaagttttgattctcagatggcacatgccagctcacaaccttctctctccagttccaggtgctctgatgccctcttctgacctccaccacatcacaaaacacatttaaaaaaaaaaaaaaaaaagggtgagaagcaggcctggtgatggccatgcacattctttttttgtttgtttgttttgttttttggggttgttttgttttgttttgttttgttttgttttttcgagacagggtttctctgtgtagccctggctgtcctggaactcactctgtagaccaggctggcctcgaactcagaaatccgcctgcctctgcctcctgagtgctgggattaaaggcgtgcactaccaccgcccggcggccatgcacattcttgccaaggcaaagagatcacaaattcaaggccagcctggccatcttagggtggctttgtttccaaatacaaagagagccagagtgtgtagcttaacagtagaacacaggtattaatcattagtaagcagctgccctgggatttgatagtagagcacttgcctagaatctaccagtgaaagattgaaggtgactcagtgataaaagtgactggaagtagggaagagcactaggaggccagcagtctacagaggaccccatggtctgcctacaggcagggagggagcctgctgggctatagtcagctccagatagagtgaaatgttccagagaacaagaggcaggaaggcaagagtcccaagcagagacatagtaggagcagcaggccactttaccaaatggcatgcaggttagatgactgctagacgatatagcatgatttggggagagaaagctgctggcccaggccacactgtgcctctgttgctagacccaagcaggctcggactcaaagaagccacagccacacaggtcaaatctgcagcctgtgggaatggactggaacctggcaggaagctaggacatgggccacagagaacaaggtgagcccgaggtcggactgtgaagagacccagaagagagcaagatggaatctctaggacaggaatggtgacttgttgggttatggggaagagaggtggcctcaagccctaggggcaacagttgaccccaccctcttgcctccccctttgatcttgctgctgcctgctctcttcagtcctcaggttgccatcccacacctcaaagccataaaaacaggttggagttgggatggggatggcaaacaggttctgagaaccctgagggcctcgggcagtgatggagcagtttagtcagccgagagtgtggccagtctgaggaagccatcactctgcttgtccttgtaggagctatctggacatcctttcttttccccaaccctcctcacagtggagggaagctgagagcttcgacagcagctgtagaggagcatcaggagtggtccatggacctgccggagggccaggctggtggtccaactgcacagagtaagtatctgcctgcaggaggaagagggagctgcgggtcaggctgggagcaggagagatgctagggtgggcagaggcaaaggatgctaggataagtgtcaattgtgtgcctgtcacatgtctgccctatctcctctctggagggctattgaggacagaaggctccacacactataacacccacacttcgcacctcttactttgggtaaaacaggtaccctgtcacctctatccctcctactgcacttgccttcccaacactggtgtctgtctagcacctgcttagtctaagactctccccggagcatggctgtacagaccctgctccactcgtgtgtgtgtgtgtgtgtgtgtgtgtgtgtgtgtgtgtgtgtttgtgtgtgtgtgtgcgcgcacgcacgcacccacacagtgcagaagagcagaagatggaatccaaggttttatgtgtgctaggcaaccagtcacttctgagttgtgatcccatctcccagtgttgtttttgttttatgagacaggatctggatttgaactctcactgatcctagctcagcctctcaagtgctgagatgacattcgtgtaccaccatgctcagctctcatatttaatttttaattttttaaaagagaaaagctgggtggcggtggtggtacgcacctttaatcccagcactcaaggaggcagaggcaggcagatctctgggtttgaggccaggctggtctataaagcctggtctataattctaggacagccagggctacatagagaaaccctatcttgagagagagagagaaagaatgcatagctggcagaggggtcacacctatagaactgaagggtctgagaaaataagaaagttggaggccaagtcaagcaggtggtgtaaatggtatgttaactgattttatgtaacttggttcatataccgactgtttgctgtgttaagcctcatggaaacatgccaagttattcctgtgttcacagacatccttgagaactaggatgtgccttacactaacagaacgctccgttccagcttggcctgcttacgtgcaggagaagaagcacgtgcagcgggcctctgcacactggtgctgctgccccagatcaatgcctgttttgctgtgggcagatgcagacaagtgggcgtgggagccagcgcgcatcagctttcggaggaaggtgctggctcactgactcctgtgggccagcctctatctctatgtccctaactcctgttttcttccccgccgatctgtctctgccctatctcagcaactcttttccccaagaatcaccctcctggtttctctgtctccatctcctgaggctgtgctaacagggaggccagcctgatggggtaggaagctccagcgtctatataggcagttccgactaatgcaggaacacctgtcttttaggctcctgggagtcgacaagtacgcctgcagctttgctcaaggctgagatctgcaccccaacctcaggggtagcctctgcaaataggaggggtttacaggcaagacaccagcatgctaataaggctggctagcttgggagatgactggcatctaaaccttgcctgcaccagcagagggcgagcagccaccaggaattaggaccatggccaggtcagcttctgagattgcagactgaaaaggaagaacacacccacaggggaaagccgaggctgaaagacagggatggcaaagaagagagaaggcgcttgggacagagtatcaagattaagatagagtacagggtggggggagaaaagggactgaaggacacaggacagaggctgaacatgtgagagaggttggggaaaaatgagaacaatggtccagaaagagcagggtggtggtcatgcacgcctttaaccacagcacatagaggcagaggcaggtgaatctctaaattcaaggccagcctggtctacggggtgagttccaggacagccaggatgccaggactacacggagaaaccctgtcttgaaaatcccccccccaaaaaaaaaaaaaaaaaaagagagagagaaaggggggggggggacggaacagtgtcttccttcaggacctcaggaagggactatgcaccattggcctttctgggccacagcacagagtcctcctctgtaacacgggacggtggagagcagtaggccagctgaagtcttctacctccccaaactaacctgccctactgccctcccatgggagccagaagagtccaggtcaaactggggtacagcatcctggaagtgtcagggtgagagaagagactctgtgctggaaggtgcctgtgaccgcttgtgctgcccgtctgcctcagactcctcgtgtagggataggagctgctgcggtgctgacgctccatgagtgcctgtagttacagaccacgcagaggcccacccacatgcatccatttcttccccaaaagggaggggggctttctcagaggatactgctgacactcagagggggtggggggcaggacaggggtctctagtgccagctcagactctaaccctgcagccatgtgcaatgggcactcatctcagcaggccaggctgtcagaggtatgaaagccacctccagcttggagaagctctgtttattgagtgcctgctgtattcatgtgatgtgaatatagctagctgcaggccaacagaccctggaaaacaggaacataggcaggcacacagtgggtctgagccaggtg

SEQ ID NO: 1250 - DNA, 775 bp, Mus musculus
cctcccacccacctgcaatgtgtcgactgagggtcttgctgctgctgctccccttggccttcgtgtcctcctctgctctccccatccatgatgtcgactctcagcagaacacctccgggttcctgggccttcagaggcttctccaaagctttagtcgactgttcctaaaaaatgacctgctacgagacctggacaacttcttctcctcccccatggacttccgagaccttcctaggaacttccatcaggaagagaaccaggagcacagaatgggcaaccataccctctccagccacctacagatagacaaggtgactgacaaccagacaggggaggtgctcatctcggagaaagtcgaggcctccattgagccagaacggaacccggaaggggactggaaggttcccaaagtagaagcaaaagagcccccggtgcctgtgcagaaggtcaccgacagcttgcacccagagccccggcaggtggctttctggatcatgaagatgccaaggcggaggacccagcccgatgtccaggatggaggccgctggctcatagaaaagcgacatcgcatgcaggccatccgggatgggctccgtggaggcgcccgtgaggacagcctggaggatggggtccatatcccccaacacgccaagctgcctgtcagaaagacacactttctctacatcctcaggccatcccaacagctgtaagtggggaccagatgtcccacaccctaccccaacaccatatggaaataaaggttttcttacatcta

SEQ ID NO: 1251 - protein, 235 aa, Mus musculus
SHPPAMCRLRVLLLLLPLAFVSSSALPIHDVDSQQNTSGFLGLQRLLQSFSRLFLKNDLLRDLDNFFSSPMDFRDLPRNFHQEENQEHRMGNHTLSSHLQIDKVTDNQTGEVLISEKVEASIEPERNPEGDWKVPKVEAKEPPVPVQKVTDSLHPEPRQVAFWIMKMPRRRTQPDVQDGGRWLIEKRHRMQAIRDGLRGGAREDSLEDGVHIPQHAKLPVRKTHFLYILRPSQQL

SEQ ID NO: 1252 - DNA, 31516 bp, Homo sapiens
tgaaagcggaaaccccagcgtcagggcagtgcctgcccagccccctaccttccagctaagcaacccccctgcaaaaccctcagcccccaggtacttgatctgatgcttcccgtatccccattcagcagcagctccccagtgaccttccttctcttccagtctagatcccacacagcctgtcactgcactcttttttttttttttgagctggagtctcgctctattgcccaggctggagtacagtggcacaatcttggctcaatgcaacctctgcctcctgggttcaagtgattctcctgcctcaccctcctgagtagctgggactacaggtgcctgccaccacgcccagctaattgttttttgtttttttttttttggtgtttttagtagagacggggtttcaccatgttggccagaatggtctcgatctcctgacctcgtgatccacccgcctcagcctcccaaagtgctgggattacaggcgtgagccaccacactcggccctcactacactctttctctgacaataccgtcaacactcctgcctcaccgtcctgcagccacactacccaaccaatgcctagcctggatccatcagttcctctctgggctgagaaatacacccctagcccgccacggtggctcacgcctgtaatcccagcactttgggaggtccaggcagggggatcacttgagcccaggagttcaagaccaacctgggcaacatagcaagacccccgtctctacaaaaatcaaaaaattagccaggtgtggtggcacatgcctgtagtctcagctactcaggaggctgaggcaagaagattgcttgaacccaggaggctgaggctgcagtgagccatgattgtgccaccgcaccccagcttaggcaacagaagaatatcctgtataaaaaaagaaaaaaaaaaaaaagcacttcccatcatcttctggggcccatttctattcttgtaggctacaaacatatcccgtcacctcaaggctctctcagaactgaaaaggacactcccacttacctctgggaaacattttcttccttctgaacctaagagaagattaattataacctctgttctaccctcaggtccaagaaccacctaatagaggctgggcacggtggctcacgcctgtaatcctagcatttggggaggctgaggcgggtggatcacgaggtcaggagttcaagaccagcctggccaacgtggtgaaaacccatctctactaaaaatacaaaaattagccgtgcatagaggcaggcgcctatagtcccagctactcgggaggctgaggcaggagaactgcttgaactcaggaagcggaggttgcagtgagccgagatcgcaccactgtactccatccagcctgggcaacggagcaagactccatgtcaataaatacatacatacatgcatacatacatacatacatacatacataaatggggggacacaggagctagaaggtggagtgagaaaggtctctgtgggagtgtgagggtggggggcaggtgctgagccaggacacatagtactcactctggaacattccaggggggcccagatcctccagaccaaaactggaaaagctcagaggcctggataggacacaaagaaaaatggttggtcagtcccctgtggacagctgcagccccatccatccccctttgcccccacgtcccacaatccccaacctggaccacctgaggaccagtgggacccagtttggcctgcagagaaggcgcggagatgagctgggcagaggacatggttgccattgtctggaaagccttgtccttggaaacctggtcctggaggaggaggcggaagttcatgtgagaggggcatctcagtcaacatggcaagagggggatggtgccagggtggggtgaagacggggaggtgcagaggtggggagtcaaggcaaagggttagtggccgggcatggtggctcacgcctgtaatcccagcactctgggagccggaggcgggcagatcacttgaggtcaggagttcagtatcagcctggccaatatggtgaaaccctgtctctactaaaaatacaaaaactagccaggtgtggtggtgcacacgcataatcccagctactagggaagctagggcacaacaatcactggaacccaggaggcagaggttgcagtgagtggagatcgtgcccctgcatccagcttaggcgacagagcaagaccctgtctccaaaaagaaaaaaaaaggcaaaggcttgggttgggggagggttgaacctctccccacagccctctgcccctcctcagggacagggcactagtttggagtgagcgtgggtgggaggatgggcagaggaacttaccacgttcagagcctgcccgtgggggtgggggagggtgccaaaggaggaaagaaaacatgacttaggaagtacggcccggactcccccacctccctgccctacccgcccgcacagccccgccaccctgagctgagcagtgccaagggatggatgcgcaacaggaagtggaggtggccagccctggaggggaaaaggggctccctgcccagaaagacagtgatgggggtttctagaacaaggaaacccagaaggttcccagatgtccaggagacaggaaatgagaatttcagagccagcgggaagacaaggtaaatgtttcctaatccagacagaacagacagggaacacagaaggtcgagaacagaccggaagggaagggtttcagacctagagagaaagaaagggaaagctgctggatacaaaaaaaaaaaaaaaaaaaaaaaccagaagcgaccgtccccaagtccagaaaaagagacagaaaaacccccacacacccagaagggggagaaaatgagggtctccggccaacaggaaccaggaaatccaaaggatgaggagaaggaaatgaatgaggaatctccaccaggaaatgaagatttctgggcacaaagagtaggcaggtcatgcaaaggtcaggaaatgggaaaacaaaccagcggagatgaagaggaggccttcacagcacaagagggggaagatatgagaccgccaggaagagggaaaggagggacaggagcagagggaagggagggggacaggaacagtggtcaagggaggggaccgacggcccatccttcctgctgtcctgagcaaaaccttcagcctcctccatgccatcgctccctgcccagggtctcagcaaccgcaccaccatccctatgcatctccctttgtgggccactgactccccaccctggatgactgcaccccccgccctgaccacagaggtccctcacctgaggtctctgtccccctctgtctctgggtctctgtctccctctgtctctgggtctctgtccccctctgtctatgggtctctgtccctctctctctgggtctctgtcctcctctctttctgggtctctgtccctctctctctgggtcttggtcccctcccccaagtctctgtccccctctccctgggtctctgtccctttctctctgggtctcagtcctccccgctctaagtctctgtccccctctccctgggtctctgtccctctctttctgggtctcggtcccccacccccagtctctgtccccctctcaggatgtctgcattggtccctaccttcaacttggactggatttcccttgatttccttcgggccaaaacctggatgtgactagaaacctggaaggatcaacggagaagcagattcaggccacagccaccgcccctgtgttcactaccccttctctccctccaggtgcctcactgagctgctggaccatgaaaggtgaaaaacacactgaagatgagagccatctcgggagcacccgaacacagatgtccataaaggagctcgtgaacaccacggaccctcccgggacccatcccatccaggcctccttcccctccaccatgctctctctgtggctactctgggtctaacacaaccactagaaaaactatccccaaacaggcacagtgagagcacacgaacagacatgctgatacagttcggacattcgtcccttccaaatttcatattgaaatgccatctccagtgttggaggtgaggcctggtgggaggtattggatcatggaggtgaacccctcatgaatggctttgcaccatctccttgatgatgagtgacttctcactcagttcacacaagatctggttgtttaggccaggtgtggtggctcacgcctgtaatcccaacactttgggaggcctagatgggcagatcactggaggtcaggagttcaagaccagcctggccaacatggtgaaaccctgtctctactaaaaacacaaaaattagggctgggctcagtggctcagctgtaatcccagcactttgggaggccgaggcgggtggatcacctgaggtcaggagttcgagaccagcctgcccagcatggcgataccctacttctactaaacatacaaaaaattagccaggtgtggtggtgcgcgcctgtagtcccagctactcaggaggctgaagcaagagaatcgcttgaacccgggaggcggggcttccagtgagccaagatcacgccactgcactccagcctgggcaacagagcgagactccgtctcaaaaaaatatttaaaaaatgaaaaaataaaaatttgccagatgtggaggcgcatgcttgtaatcccagatacttggaaggctgaggcagcagaatcgcttgaacccggaaggcggaggctgcagtgagctgagatcacggcactgcactccagcttgggagacacagtgacttttctctcaaaaacaacaacaacaaaaagatctgggtgtttaaaaagagtctgggacctctgtctttcttctgttgctcccactttccatgtgccaggcctgctcccactaccccctccgccatgattggaggcttcctgaggcctcaccaggagcagatgccagctccatgcttcctggacagcctgcagaactgtgagccaaaataaagctcttttctttctttctttctttttttttttttttgaggtggagtctggctctgtcaccaggctggagtgcagtagcacgatcttggctcactgcaacctccgcctcccgggttcaagcgattttcgtgcctcagcctcccgagtagctgggattatgggcacacactgccactcccagctaatttttgtatttttagtagagacggggtttcaccatgttggtcaggatggtctcgatctcctgacctcctgatccgctcacctaaagtgctgggataacaggcatgagccactggcccagcctaaagctctttatcaattatccagccttgccaggcacagtagctcacgcctgtaatcccagcaatcccagcactttggggggctgaggtgagtggatcacctgaggtcaggagttcgagaccagcctggacaacatggtgaaaccccatctctactaaaaatacaaaattacccaggcatggtagtgcatgtctgtaatccctgctactcgggaggctgagacaggagaattgcttgaacccgggaggcagaggttgcagtgagccaagatcgcgccactgcactccggcctgggcaacagagctagactccatttcaaaaaataaacaaatacataaataacccagcctcgggtaattctttatagcaatacaaacggactaacacacatgccgagaagacagatgaacgcacaggaagcagcttcttccttgaacctgaacctgcccatgcgaggatgaccctaagaagaccggcccatcccagacagaagcccacaagtccattccgagacctgttttcgagttcgggtcttccccgttctcagcttgatgtagcgggcgatcagttcattccgacctgaagattcaaagacggaacagagttagttagactttcaacagaacttccccacagcatggacaccagggaagaagaaagcagcatgggtccccaaaggtctgcagcaagtgggctgccggtcccctcagctacgtggaagccagactgcttgggttcaaatcccagctccatcacgcactggctctgtgcgaccataagcaaatcacttaacctagctgtgcctcagtttcctcatctgtgcaaatggtgatgctagctcctacttcagagtgctccataaaccttggttactgtcattattcatcagtgggggccagggcaaaagacagaagtagactcaccatacatcttgccttcatcagacaaaattattttccggcggccgcagggtggatagatggccagggcctcctggaagctctgctcaatgtctgggctccacaccccctctgcatccgggcccccgtcacccccagccccctcactgccgccggtaccctcctcactgccttcctcactgcccgtccagccgctgccatcgtccagggcggccccagcccggggttcccccatctgggcctggaggaacacagaactcagcaagcttcccccaaaccccaccctcaagggacttgaagctgagagggctgggactctggaccactgggtctgagggaggaggggctggggacctggactcctgggtctgagggaagaggagctggggggtattcctgggtctgagggaggaggatctggggcctgaactcctgagtctgagggaggaggggctggggcccggactcctaggactgagggaggaggatctggggcctggactcctgggtctgagggagcgggggctggaggcctggactcctgggtgtgagggagaaggggctggggtctggactcctgagtctgagggaggagaaggagctggatttcttggaaagctgaggatgggagtgttctcagagtttccagaggaactcaattgtgatgaagtcacaatgattaccctagagtaatgccgagggccatgaaggctaaaggttcgggtatgaattacgggttttaaagaagacaggaggcaaaagttagtggtggggaaggaaggtgtgggtgaaacttcccctgtcccaccccaagaacaggtggtaagatgtgagcagcagctgccagaaaagaagaggggccaagcaagactgaggggaggtctagagagagggggacagagacccagagagggagggggacagagacccagagaggggatggggacagagaccagcaagggggggggacagagacccagagagagaaggggacagagaccagagagagagggggacagagaccagtgaggtggggatagagacccagagacagagggggacagagaccagagagagaaggggacagagacccagtgaagggggggacagagaccagtgacggaggggacagagacccagagagagagggggacagagaccagagggagggggggacagagaccagagggagggggggacagagaccagagagggggacagagacccagagagagggacagagacccaaaaagagagggagacagagacccagggagagggggagacagagaccagaaagagggggacagagaccgggggggggggacagggaccagagagaggggtccagaggcccagagagggagacagagacccagagagagagggtgacagagacccagagagagggggacagagacccagagagagagggacagagacccagagagagaggggaccagagacccagagagagggggacacagactcagagagagggggacagaggctcagagagagggcaacagagacccagagaaagggagacggagacctagaaagggcagggacagagactcagggcagcagctgaggccgagaccaggagagacccacagaaccacaagctgggggacaggggcgccctgccatcagaagagccagaacaaagggcccaggcgtcccctcccccagcttcccacaacccccatcaggggaggggcttgcctgtcagggcgactcccctccggcaccgggccccgcccctcccctcccccgtgcgccgtgggctctgatccaactcaagttcccagtgactttccggaggccgggaacagggaaaactttttccaatacagtcagatcccgcctccccggaggctccatgtcctccacagctttcccaggaccccagagtccaggcccctattcccctcctcccgccgaccatagcagacaaagaccccagccaagcccagtggcgctgcggcgttcaggacccccgtaggccaaaatcccagcccagcccttccccatgtggccagacaaagggacggtggagccgggtaagaaaggtccccctaatttcccgccccagaccctaaacctccaaagaggcaagacttaagatccagaaagccccgtaacctcccctcggccaccccagaggccctcccttctccgtaagaaggaccaaatgccccccagattacacaaggggtccttctcactccaaagtgacaccgccgcagacgcacgccccacaccccgccagcgcccttggcccgcacccgctcctgcgcgcacgcccaaactcagacccagccgcaggcaccctaactccggccagagttcccactcctcactgaggctcggtcacgggagcaaattcgggcccccgggcaaaaagagggctgcgaaccattcagagacggtcccgcaaacgcacgcctcacctcctaagaagcaactccccaccccaactcacacaccccaaagcaggatccccgactcccgccggcgccttcctacctcccggcctggggctggggagccgcgggcgggcggggcgctgcgagggagaaagttgccgggagctttgtttgggaaaagtgggagggaccggaggggggggcgggcccggccggcggacagcgggaagggggatccgacggtgacagtttggggaaggatttttgctttgggagagattagtctatctcggggctggtaggaactcaggatttgggtgcttgggaaaggagggggattgggggttcggactccaagtcggagggaaaaggctgataggagccagaaacccctgatctgagggaggagaggctgggggctgggactcctgggtctgggggctgggactcctgggtctgggagaggaagcggctggagagagatatgggctcctaggtctgagaggggacggggctaggcgcctggaatcccggctaccctcgtgtttgtgtattgggggtgcggaagtgatacgaatacaaagagtctttactgttaagccctgaggttttttttctttttttctgtttggtttttggtttttttgttttttgttttttttgtttttttttttttttgaggattggggtctggggatgggttttgactgattcctatgacgacctggtttccttgtgacctcaccacagttaagagtcgtgggcaggaccaccgggagtttattggaggcccacgtaggtgcagattcctcatctacaggcgctagtggactggagacggctggcggctgtcccgggacggggaagagagctttggtgcctgagggaagatggcttagggcccggtcccttaagggtgaaaggctgcgtgttcaaaattacgggactagagggggctggagtccggacctgaggtcctcagggaaaaggaagtctgattctgggttccttggaagatgaaatataagactggatttagggtttccggagacaacgggactttttagtggagcgggagcgggaaaaccagaagggacacggagaaaaggttccgaaacagatacacaattagagtgagagctaaaagggatgcttgtactccggtgtctccagtaggaggagcctaggactggaacttggggtgatgagggcaagatctgggacgcaggggcgtggtccagtgcaggggcgtggcccagtgcaggggcgtggctttcagccaaggggcgtggccattgcgattgggcgggactccgaaacgagggccgcaatcagagaacaccgccaggacttccaggacttggtctccaggactgaggtcaactgacgggggcgtggtctgactgtgtgggcgtggccagggaatgaactcacggctctggcttaaggggtgtggtgaacgaaggatggggcgtggctctgtcacgaagggcgtggtcatggagtagaggcccgggctcctgggtgaggccggcaagtttggagcgtggtcagacaataggggcgtggctacggctcgcggagcgcaaccaacgctctagaccagacctgggctcgagaccataactgtttggctttaacagtacgtgggcggccggaatccgggagtccggtgacccgggctgtggtctagcataaaggcggagcccagaagaaggggcggggtatgggagaaggtgaggattgagatctggtggtgaacgtgggcgaaagtgaggaaaagaccattggatgaggccgggtgctgtggcttacgcctgcaatcccaacactttgggaggcccaggtgggcggatcgcttgagatcaggagttcgagaccagcctgggcaatatgtcgaaaccctgtctctacaaaaaatacaaaaattagccgggcgtggaggcgcgcgcctgtggtcccagctacttcggggggctgaggtgggagaatcacctgagcccggggaggtcgaggctgcagtgagccgtgattgtgccactgtactccagcctggactacagagtctcggtctcaaaaaaaaaaaaaaaaaagcatatgagacagaacccagaagagccagacctgggagaagacggggcctggcaaggtggagggtgtgggagtagaagaaagaagcagtgggggaaatgagcgcggtgtgggagttgcctgaactggggaggcgacctgggcaaggtgctggagaggggcgtcttgggtgggggcgtggccactgtgcggggctctgaccccgacccttgccacagcctccccacctgcccccgcaaggcggcatctgctggtcctgctgctgctcctctctaccctggtgatcccctccgctgcagctcctatccatgatgctgacgcccaagagagctccttgggtctcacaggcctccagagcctactccaaggcttcagccgacttttcctgaaagtaagcgatggcggggggatgggggaagaagtactgagaagaggttcagggacacagagtgggagatggttcagggccaggcagggggacagacaggatgagagggcaacagggagaccaagagataggaagagggaagggactgggcccaggctataatcacagcactttgggaggctgaggcagaaggatcattggagcccagtacttggagaccagcctgggtaacatagtgagaccctcatctgtacaaaaaaatataaaaaatagttgcaggtacatgcgcctataatcccagctgcttgggaggctgaggcagaaggatcccttgagcccaggaggtcgaggctgcagtaagccatgatagcaccactgcactccagcctggatgacagaacaaggagaccctgtctctaaacaaataaatatatacgtgcataaataagagaggaaaggtaacaggcaaagagagaggagatgggacagagacaagagactggggaaagagacaggaggagagggggatggggacagaagaggaacagggatagtaaggcaatgggactgagaatagagagagaattcatgggggatggaggccggaggttaggccctaagtatcagagggcagaaagtaaaggggatgggagggacttggggcaaggcctcgggagcatcctagcagggctgcagaaggggctgtactgaggagatgtgaggtccagcagctcaccagtccctcctccggccccagggtaacctgcttcggggcatagacagcttattctctgcccccatggacttccggggcctccctgggaactaccacaaagaggagaaccaggagcaccagctggggaacaacaccctctccagccacctccagatcgacaaggtgcctatgcagggaagcccttcctgaagtccccttgggatccctccatcccgccatccctcgtgctgcagtatctgttgggagggaaggagggcggaggaggaaagcaggtttgctctcactctctcatcggatcctcacagaggaccgacaacaagacaggagaggtgctgatctccgagaatgtggtggcatccattcaaccagcggaggggagcttcgagggtgatttgaaggttaggacgtgccccgccgtcaaagtgtccaggcccaaacattttctttttttcttttttaaagaagagtctcactctgtcacccaggctggagtgcagtggcacgatcttggctcactgcaacctccgcctccgaagttcaggcaattctcctgtctcaagctccttggtagctgggattacaggcacccgccaccacgcccggctaattttttgtatttttttagtagagacagggtttctccatgttggtcaggctggtcttgaactcctgacctcaagtgatctgcccatcttggccttccaaagtgctgggattacaggcatgagccaccatgcctggtgaggccctaacattttctgtagtttaggaggacaagaagaggaactgaccctcctactcctctgtgtggaacttcctccttctgagcctcagttttgccatctctcaagtggggcaatccaactgtcagaaatgagatttttgacctcagaatacatctgcaagggtttagtagaccctagagggttttgtatcaaagtggttttctttttttttttaactacataatagtcaatcaaagtgtttctatgagcaccaaaatgttttataaaccaagaagggtttttaattctaagtgcttggaaagcttcaccctcataaaccccaaattgtgtttttgtctcaaagtaagtgctctgcaaacttcagagtatttttcaatctatcccaaagtggttggtaaacctctccattataaactccaaaatgtttttgttgttattgtggttttgatttttggggttttttttgtttgtttttttggtttttttttttgagaatggagtcttgctctgttatccaggctggagtacagtggcacaatctcagctcactgcaacctccaactcccagactcaaatgatcctcccacctcagcctccggaatagctggaactacaggcgcggaccaccacacccagctaatttttctatttttagtagagacggggtttcgccatgtttcccaggctggtctcgaactcctgagctcaggcaatccgcccgcctctgcctcccaaagtactaggattatagacatgagccaccacacctggcccaaaatgtgattttcttcttctttttttgttttttttgagatggagtttcgctctgttgcccaggctagagtgcaatggcacaatctcagctcactgcaacctccgccactgaggttcaagtgattctccagccctagcctcccaagtagatgggactacaagtacgtgccaccacgtccagctaatttttgaatttttagtgtagacagggtttcgccatgttggccatgttggccaggctggtctcgaactcctgacctcagctgatccacctgcctcggcctcccaaagtgctgggattataggcatgagctactgcgcctggcccaaaatgtgatttttaataccaaagagctgtatgaatgctaaatgcgttgtgtatttcacctttggtaaacttttttttttttttttttggagacgaagtctcgctcgtcccccaggctggagtgcaatggtgcgatctcagctcactgcaacctccatctcccaggttcaagtgattctcctgcctcagcctcctgtgtagctgggattacaggtgactgccaccacacctgactaatttttctatttttagagagacaaggtttcatcatgttggccagactgctcttgaactcctgacctcaggtgatccaactgccttggcctcccaaggtgctgggattataggcgtgagccaccatgcctggccaggccacctttggtaaacttctacaagtgattctaattatgaagtgctttgcaaaatcagggtatttttaatcctgaaaagttttaagaaacccaaagagcttgatacatccatatgatacccacgtacacccatgcaatatcttcattttaaaaatgtttatttaaaattttattttaaaaatttcaggacaggcacagtggcttacacctataatcctagcaatttgggaggctgaggcaggaggatgacttgagcccacgagtttgagatcaccctgggcaatagagggagtcttcatctctacaaaaaaatttaaaaagtaggccaggcatgctggcttacgcctgtaatcctagcaatttgggaggccaaggcaggcagattgcctgagctcaggagttcgagaccagcctgggcaacacggtgaaaccctgtctctactaaaatacgaaaaattagccgggcatggcagcctgcacctgtagtcccagctactctggaggctgaggtaaaagaattgtttgaacccgggaggcagaggttgcagtgagccaagatcatgtcactgcactccagcctgggggacagagtgagactctgtctccaaaaaaaaaaaaaaaatcaaaaaagtagccaggtgtggtggtgtgtgctgtggttccagctacccagaagcctgaggtgggaggattgtttgagacgaggaggttgagtctaaagtgggcccagatcatgccactgcactctagcctgggcaacagagtgagactctgtctcaaaaaataaataaataaataaataaataaaatttcaagactacagaaaagttttttttaaaaaacatactttattattttggaaatggagtctccctctgtcacccagactggagtgtagtggtgccatcttggctcacagcaacctccaccttctaggttgtggaaagtaaaaaagtttctctttaaagtttttattaaataataaatcacaagtgttagaaataatatttttaattaactttttttaagcctctttgctttgtgttagtaactcttttttaaaccatatcttatgtagttgttagatataaggaaataagtaccttctgtgtccttgtacgttaaccaagatatttggtctcgacgtgctcaagcatgtcccagctcacagcttatgccctttccttatttggaaatgttattacttctccaagtcttttggcaagcaacttcctcttttcctttgttctccattgcctttacctatttaagaaagttttttaagttgttagccaattgggtttagcttagactgtgaggtccagctccaaccaatggagacaggacacagcagtaaggacccaatgcataagggataaatattcctgcctttctttgttcattgtgctctcctggcaggattgctgatgggcagcaccctttctacagaaagtaaaattgccttgctgagaaaactttttgtctgaatgctaatttttccttgcgacaccaagaaacaagcattttgattctaacacaggttcaagtgattctcctgcctcagcctcccaaagagcagggataacaggcacgcactacaatatccagctaatttttttttgtttgttttttgttttttgtatttttagtagcgatgaggttttgctatgttggccaggctggtcttgaattcctgactttgggtgatccacccacctcggcctcccaaagtgctgggattacaggcaagagaagtttttcttaaaatagtacaacagattttaggctcttctgtatctgcccaccgagctactctgttcctggcttagagaaccaggagaaggggaaggggaatcacctgccacatgctggaggttggagcctgtggcaccatggcttgcctcactgcagttggtggtggcaacagaggctgcagtgtggccagagtggcttttctggctttgcccgcccagccactctgagaaaggctggaggagaaagtgaaggaggagtcacctgtggtgaggtggagtttggagcttgcagatggcacggctctgtggctcacctcctacagttgtggcggtgacagcgagggagacttcagcctgactggagtagaagggtgctcgtgaaggctagagtattgcctccaagatgcagcagtggatactcaggtttcaggagactccactgtccatggcgaatccatggtctgccagcgcagttttagagagagaatgtgccaccgcaggtgtcatcctcatgtgcaccctggcaggtagccatctgaagatttcaaggacaacctggcaggggagcagaccagcgacacttcctctgaacaggttcttgctgttcacttgacagactcagcaactcaggcaagtgttcacatggaagatatcctggaaggataccaagccagtgaaagctcagatgaaaatgccccatggctttggaaggccaatgaatgtgccaaggaaaaaggtgccatggaggatcctctggaagacctcgccaatgaaatttcagattaggacaccccactggatttgaaggccaaagaacgtgccaaggaaaaagttcccatggaggataccctggtggaagaccttggaaacgaaagctcagataaggatgcctcactggacttgaaggttgacaaacgcatgaaagaaaaagttcccacagaggataccctggtgaaagaccttgccaatgaaagctcagatgaggacgctctactggattgaaggctgatgaattcaccaaggaaaagttcccacggaggataccctggtggaagaccttgccaacaaaagctcagatggggatgttttgctaaatttaaaggctgacaaatgagccaaggaaaaagttcccatggaggataccctggtggaagacctcaccaacgaaagctcacatgaggatgctccactggatctgaatgccgacaaatgtgccaaggaaaaagttcccatagataatccagtgaaagaatttgccaacaacatcaaggaaaaggaggccccatgtaatgtgaaggcaccctagggagtccaggtaaatgatttcaaggatgacctggcggggatggtgatcagtgaaaagtccccagaagcagccctatctcttcacagggcaaaatgagatgccaagaaaaaagattgcttcgccattcttgtagcagagcttcctgaagagatgtcctcagggcaagtgctggccgttgtcaccgtgaaaggcatcaagaaaaatggtggctctgaggacagcttttctaaaaccagtaatgacaaagactcttcctgtagtggagacactcaagcttctggagcagatatggaagagtccaatcatgcagatgaccatcagcatatgccaacaagtactctcccagcacctgcagaaaaaacaatagagacaaagcctgaaaaggcagaagaaatgtaacccagtgagttcaaggaggatgaggatgctgaagagcctgacctgacctgttgtgacctttgttttttatgctagaagtccctacagattttttgaacacctggaagggccgggtcacaagacctcaccctggcccagcaaccatctggaccgtgagagttttggggattttgctactctctctggacttttacattctcttaattttttaaaaaatattctttctttaacctgttttaagatgcaagctgtcattgcgtcatcatagttacattttattactcaaataatttttcaattgttttactagttttttttggatctttgtccactggttttagagtttttgtaattttgataaatgatcttttatgctttgtatcattttcttaatgacttaccttagtttttaacaaatccatggtacagtaagttatattaagacatagtatttttatgtttttttaaattatactttgggttctggggtacatgtgcagacatgcagttttgttgcataggtgcatgtaccatggtggtttgctgtacccatcagcccgtcacctgcattgggtgtttctcctgatgctatccctcccctgaccccccaccccccaccgacaggtcctggtgtgtgatgtttcccttcctgtgtccatgtgttctcattgttcagctcccacttgagtgataacatgcagtattttgttttctactcttgtgttggtttgctgagaatgatggtttccagcttcatccatgtccctgcaaaggacattaactcatccttttctgtggccgaatagtattccatggtgtatatgtgccatgttttctttatctagtctatcactgatggacaattgggttggttccaattctttgctattgtgaatagtgccataataaacatgcatgtgcctgtgtctttatggtaaaaaaaaatagtataataaatatccctatagtctcttttccataaaccaaaatttcttaaggttggcatcattggcatgtggggctggataatctttattgtgggagctgccctgtgcactgtaggatatttgataacatccctgggctctatccactagagagaagttgcctcctgccaggcacagtggctcatacccgtagtcccagcactttgggaggcagagacgggcggatcatgaggtcaggagttcgagaccagcctggctaacgtagcgaaaccccgtctactaaaaatacaaaatatggggccaggcacagtggctcacacctgtaatcccagcactttgggagaccgaggcaggcagatcatgagatcaggatatcaagaccatcctggctaatgcggtgaaatcccgtctctagtaaaaatacaaaaaaattagccaggcatggtggcaggcgcctgtagtcccagctactcagaaggctgaggcaggagaatggcgtgaacccgggaggtggagcttgcagtgagccgagatcgtgccactgcactccagcctgggcgacagagcgagactccgtctcaaaaaaaaaaaaaaaatacaaagtatggccaggagtggtggcttacacctataatcccagcactttgggaggccgaggcgggcagatcacctgaggtcaggagttcgagaccaccctgaccaacatggagaaaccccgtctctactaaaaatacaaaattagccgggcatggtggcacatgtctgtaatcccagctactcaggaggctgaagcaggaaaatcgtttgaacccagaaggtggaggtcgcggtgagcgaagatagcaccattgcactacagcctgggcaacaagagcgaaactccatctcaaaaaataaataaataaataggctgggcatggtggctcacgcctgtaatcccagcactttgggaggccaaggcaggtggatcacctgaggtcaggaggttgagaccaacctggccaacatggtgaaaccccgtctctactaaaaatgcaaaaattagctggcatggtgccatgcccctgtaatcccagctactctggaggctgtggtgggagaatcgcttgaacccaggaggcagaggctgcagtgagccgagattgtgccactgcactccagcctgggctacagagtgagactccatctcaaaaaaaaaaaaaaaagaacacagtcatgttggattagggcccaacctaatgacctcatcttcaccaattatatcttcaatgaccctagttccaaataaggccacattctgaggtattacaggttagaatttcaaaatatgaatttggggaggaaacaatatggttgtttgttcgtttgttttttaagcctgggtcttgctctgttgcccaggctagagtgcaatggcacaatcttgactcactgcagcctctgcctcccaggttcaagtgattctcctgccttagcctcccaagtagctgggattacatgagcgcgccagcacgcccagctaattttcatatttttagtagagacaggattttgtcatgctgtccaggatggtctcaaactcctgacctcaagtgatctgcccacctcagcctcgcaaagtgctggattacacacatgagccaccgcgtccagccaggaggaaacaatttaacacataacaatctcctgcgcggcttctcagacctcatcttactaaaaggcagactgattcagcaggtctgagtggggtgggacctattaatttgcatacctaacaacagcagcccaccctttgaattgcaaggaccaaacagacactcagtccatattcaaactttctccctcaactcaaagctgtccttgaaagctttattttttttttttcccttgagatggagtctcgctctgtcacccaggctggagtgcagtggtgcgatctcggctcactgcaagctccgcctcctgggttcatgccaatctcctgcctcagcctcccgagtagctgggactacaggcgcccgcaaccatgcccggctaaatttttttgtatttttagtagagacagggtttcaccgtgttagccaggatggtctcgatctcctgacctcgtgatccgccagcctcggcctcccacagtgctgggattacaggcatgagccactgcacctggccccttgaaagcttttgattcaggatcaatgaaggatcacacattgcatttatggtcatgagtcttcggtaaacccaagagcttttagtcctaaagtgctttgtacatttcaaactgctatcctctaaacctcagagaggatttaatcctaaagtgctctagaatcccaacaggcattataatccctgaagtgctctattacctcccttttgaaagcccccaaacaaattttccaatcccaaagcattctgtaaacctcagagtatttttaatccttaagtgtaaacccaagtgctttgtaaacctcaaacagggcttttgaacccacaaagcatcctgtcatctgcaaagtgggctgaataggtcagtggggactgaccatcctggggtgctgtttggagtatgagagggtctccttgttcttcctccccaggtacccaggatggaggagaaggaggccctggtacccatccagaaggccacggacagcttccacacagaactccatccccgggtggccttctggatcattaagctgccacggcggaggtcccaccaggatgccctggagggcggccactggctcagcgagaagcgacaccgcctgcaggccatccgggatggactccgcaaggggacccacaaggacgtcctagaagaggggaccgagagctcctcccactccaggctgtccccccgaaagacccacttactgtacatcctcaggccctctcggcagctgtaggggtggggaccggggagcacctgcctgtagcccccatcagaccctgccccaagcaccatatggaaataaagttctttcttacatctaacaacaccatctcctttcactatttatccccaaccgcctgccaaccaggccatggcaaaggcccccagtcccagctctgagcatgagagctggctgtgctagctcttgcctaagtctcccaggcttggttttctcattcaggcattgtctgtgctgtagccccatctgtccactcagcacccaaccctgtcacctccagccctgtctgcactcccaactctcagctatttttttttgctttttttttttttttgagaacagggtcccactctgttacccaggctggagtgcagtggcacaatcacagctcactgcagccttgacctcccaggctcaggtgatcctctcacctcagcctccccagtagctgggaccacaggtgtgcgccaccacgcccagctaattgttgtattatttaacatagggatctccctgtgttgctcagggtggtcttgaactcctgggctcaagcgatcctcccacctcagcctctcaaagtgctgggattacaggcttgagccactgtgcccggcccccaactctttcactccagtcctctctacttggcccccgtactgttactgccataaaaatgggcacaaacttggcaacttaaaacaacacaaatgcattatttcacatatcatcctggtcagaaatccaggatggctccgctggccctcagctctgggtttcacagggtgtcagccacccgagctctcattgggaggctctgggaagaagctgctttcaagctcattcagattttaagcagaatcgagttcctgggcttgtgggactgaggtccccacgttcttgctggctgtcagctgggggccacccatgcttccacgcttagctccaagaggcctctctccagttactgcaggtggacctgacatcccagagccacagcccagtatcatggcgggactctgacttccccttgtgtcccatctctggtatgccttcctcttctggcagagacagtcctctgctttgaagggctcatgtgattggactggacctaccgggacaacatatttacagttttcaggaattatggggtgatcatctttgggggaccactatccagccccactcaggtccttcccatgtcatctccagcctcgactctgtggtgtccacacccacctatccttgtcttcatcttctcattctctcactaccccctgacggagagactccatctccaacttgctatttctctctctttgtccctctatctgaccctccctgctcaccacctcaaactccctcacttccaggcctgatgccacgtccaaacttggaagctcacagagcttgcctgtggtggtctgtccactttgtccttcctcagagcatttcctgtcccctctgagaatcctccgtcatgacccatcaaggagaaagctgatctgatcctccccagtgctgagtcccatctaggacccggacacggcatgtactctctcccttgaagcccaagctgagcgctggatcaccccatagactcacacactcaggaacccaacagtgagtacaatgaatacaagtcaacttttttttttttttttgagaccgtctcgctctgtcgtccaggctggagtgcagtggcatgatctcagctcactgcagtctctgccaccacccaagttcaagtgattctcatgcctcagcctcccaagtagctgggactacaggtgctcaccaccacgcccagctaatttttgtatttttaatagagatggggttttaccattttggccaggctagtttcaaactcccaacctcgggtgatctgcccgcctcagcctctcaaagtgctgggattacaggcatgagccaccacgcccggccaagtttggctgcttctaaggcctctctccttggcttgaggatggctgctttctcactgtatcctcacattgtgtctttttgttttttttgtttttgagacagagtctcacactctgtcgcccaggctggatggagtgcagtggcgtgatctccaccttccaagttcaagagattcttctgtctcagcctcccaagtagctgggactacatgcacgcgctgtcatgcctggctaatttttgtattttttagtagcgacagggtttcaccatattggccaggctggtcttgaactcctaacctcgtgatccacccacctcggcctcccaaagtgctgggatgacaggcgtgagccactgcacccggcccacattggcttttatttgcaattctagaatagggcagtacctcattctataaagtaaaatgagtgttcccatgagccgagcagagaagggttgtttacgatctcggctcactgcaatctctacctcccgggttcaagcgattctcctgcctcagcctcccgagtagctgggattaaaggctcctgctgccacacccagctaatttttgtattttttgtagagacggggtttcaccatgttggccaggtggtcttgaactactgacctcaagtgatccgcctacctcagcctcccaaagttctgggattacaggcgtgagccaccgcacccagctaatttttgtatttttagtagtgacagggtttcatcatgttgggcaggctggtctcaaactcctgacctcaagtgatgcacccacctcagcctcccaaagtgctgggattacaggcgtgagctactgtgcccggccagggattacatttctttttttttttttttaattttttattacagaacaattattatctgtcatcaaactatcctttcagattcattttgaatacctcctttcttttttatttttctttgagatgggagtctcgctccgtcgcccaggttggagtgcagtggcgccacctcggctcactgcaatctttgcctcccgggttcaagtgattctcctgcctcagcctcctgactcactgggactacaggtgcctgccaccatgcccggctaattttttgtatttttagtagagacaaggtttcaccatgttagccaggatggtctccatctcctgatctcgtgatccgcccacctcggcctcccaaagtgctgggattacaggcatgaaccactgtgcccggcctcaattggtcatttcaaagttactttacttgtggccaggtgtggtggctcacgcctgtaccccagcactttagaaggctgacgcaggtggatcacctgaggtcaggtgttcaagactagcctggccaacacagtgaaaccacgtctctactaaaaatataaaaaattagccgggcatggcggtgggtgcctgtaatcccagctactcgggaggctgaggcagaagaattgcttgaacccaggaggcgaaggttgcagtgagccgagatcacaccactgcactccagcctgggcgacagagcaagactccgtctctaaaaacaaacaaaaaaacaaacaaagttactttacttgtaaaggttaaaacagaggggacttcctcatcatgctagctagaagatgtggctattatctctctctcctgtctcccctaaattctcagaggtcatataacttagtttcagcttgctgacatggaactgtaacatgagtgactccactggtctcttgggcctagtgcaggagctcggtccaaaccaatggcttcctgtaaaatttatttaacaaggcaaatctacagagacagaaagcagattcatggttatgtggggcttcacggaaaggaaggttgagttaggaataatggctaagagatgtagggctttgttttggagtgatgaaaatgttctaaaattaattgtgatgattgtagaactctgtgagtacactgaaaaccactgaattatacactttaaatgggtaaattatgtggtgtgtggatgataactcaataaagctgttaaaacaattagttaattaataattctattaaacagtttaccctgaacaactcagggcttaggggactaaccccctgtgaggtaaaaaatctgaagatcaattttgactccccaaaaacttaatgactaatagcatgctattgaccagaagctttacataaacagtagatgaacacatatattttatgatatatgtttttggggattttttttttttttgatacaggatcttgccctgtcacccagggtggagtgcagtggcacaatcatagctcactccaggctcgacccccctggttcaagcgatcccccctcctcagcctcccaggtaggcaggaccacagataaggctctcacaaccacacctggctaatttttgtatttttagtagagatgagggtttcaccatgttacccaggggtgtctccaattcctaggctcaagcgatcagcccaccttggcctcccaaagttctgggtttacaggcgtgagccaccatgcctggctgtgttatatgtattatatactatattcaaacaataaagtgagctagagaaaagaaaatgttattaaggaaatcagaggaagttaggagagggttaaaaaaaataaaatcgccgggcacggtggctcatgcctgtaaccccagcacttttagaggctgaggcgggaggaccacctgaggtcaggactttgagaccagcctgaccaacatagtgaaaccccatctccactaaaaatacaaaagttagctgggcatggtggtgcatgcctgtaatcccagctacgtgggattgttcaaggatgaactgtataagtcacaatggatctgcttctctgagcaaaccctaaaggataaagcattattcagcttgttgcagtctgccaatctaaaaagggtagtttcctgttgctttaattggaatgtttctggttactgatcttttgagctccttatcacatatttgttagttttttggatttccccttctgtaaattgcctgcttttctgtaaattcttggtcatttttttctgttgggttgttatctttttctttttgatttgtaggagttccttcaatcacctaccttttaatcccttgtcaattttatttttttattttatttattaattttttttgagacggagtctcactctgtcgcccaggctggagtgtagtggtgcgatctcagctcaccacaacctccacctcccagattcaagctattctcctgcctcagcatcccaagtagttgggattataggcatgctccatcacatctggctaatttttgtatttttagtacaaaaatacaaaatctcttggccaggccggtctcaaactcctgacctcaggtgatctgcctgccttggcctcccaaagtgctgggattacaggcatgagccaccacgcccagcccctggtcaattttagacaatgcaaatatcttccgctcgtccatcatctcatctctcatgatcttggcccttgggatccttgatgaatagaaacccttaatactgatgtaatcaaattaatttttttgacttatgattcatccttttgagatccctaaaagaagtcattaatactttcctacattttcttttattaactttatagttttaccttttgcatttagtgctttactagcagctggtctccactttacattattatgttatagaggaggaggggcctgaaagcctctcagtgctcaagatctttgaagacttaactgggcattagctcaattagagaggaagaaagcagtagaggatggggatggaccactatctcctgggcctcgcttcccccaagaaaatccatggacccacccacaaccactacatctcagactatttcagcatcttcctcccagtggcttcacacacctgggtgagacccccaacatctactcagttaccaggtctggtattccctgatatcatcctgattttttgactggaaaaaaagtgttaattcataagactttgggtttttttgggggggcaggggcaggcgatggagtctcactttgtcacccaggctggagtgtagtggtgtgatctcagctcactgcaacctctgcctcctgggctcaggtgatcctcccacctcagcctcctgagtagctgggaccacaagcatatgccaccatgcccggttaatttttataaattttttttgtagaaaggtggtttctccatgttacccaggctgatcttgagctcctgggctcaagcgatctgcctgcctcagcttcccaaagtcctgggattacaggcatgaaccaatgtgcccagacccccaacactattctaagcagtggggattaagcagtgaataaacaatgccccagcatcatgggatttggtgggggagagaaacaataaatatgtatcaagcaatggcaaatgctgtgaagaataaagcaacatgaggcagaaaggaaactctgaggggaccgagctcatcttagatagggtagtctctctgatatatacacagagggaggcactctgatatatacacagagactgaactggggtaatggagcaaatccggtccatggtaaatctggagaaagagactttcaggctgagggaatagcaagtgcaaaggtcctgaggttggaaatggcttggcttgatcaaaaacaaggaggccaaggtggacagagcagttattgatggagataaataggggataagatcacaaaagtagacgtagggtacaggagagcagaccatgcagggtctttggagcgtagtgaggagtttttatgttattctatttaaaatgggaagtgagctaagtgttacaattaaagaagtaacatatatgtatttactgatcaaaaagattatccggacttttgcttgtcactatgatggagtagctagtagctgactaactccccaccaaaaactataaaagctgaatacaagctaggcatgatggttcacacctgtaatcccaacactttggaaggctgaggcaggtggatcacctgaggtcaggagttcaagaccagtctggccaatatggtgaaaccttgtctctactaaaaatacaaaaattagttgggcatggtggcaggcacctgtaatcccagctactcgggagactgaggcataagagtcatttgaacacgggagatggggtttcaccatattagcaaggctgatcttgaactcctgaccttgtaatccacccgtcttggcctcccaaagtgctgggattacaggcatgagccatcgcgcccagccaaggaaattaaattctttccgagggaagataataccatccagtttttatattttaatttaaaaattaccagtcttgccaggaaacaagaccaaatgacagaaaaccaagagaaaaaacatacactagaagtatgtacccaaaggtgatccaggtattacagttctcagatacaggctttcaaataactataattaatatgttccccaaaaatagatgaaaagatggataatttcatcagagaactggaatctaaggaggagggagaatccaatataaattctagagctgaaaaataaattaattgaaataaaaattcagtagattagtcccacatcaggttagacacactggaaaacagatcaatagaaaatatctagattaaattacacagaaatagggtagaaaatacattaaaaacatatgagacatataggtcatggttaaaaggtctaatacatacatactggagtcctagaagagaggaaaaagacaatgaggaggaagcaatactaaagaactcctgggcaagaattttaaaaaactgatgaaagacatcaactcacagatccaaggtgggaggatcgcttgagcctgggaggtggaggttgcagtcagtcaagaatgtgccactgtactccagcctgcgtaacagagtgagaccctgtttccaaaaataaggcagaacgttgataattgctaaagctatgtgttaggtatatacgggttcgttatgtttactttatgtatgtttgagatttttttaatactgtataaagatatttttaagtaactgacactaaatactccaaataaaaggcacagattttctgatctacaactacatgcaacatggttgaatcttatatgacatttaacaaaagaaccagaaacaaaaatgtttctgtatggttttatttattctgaataaaaaaacaaataaagcttatctatgccattagaaattggggtaggccgggcacagtggctcatgcgtgtaatcccagcactttttgggaggctgaggtgggcagatcacctgaggtcaggagttcgagagcagcctggccaacatggtgaaacctcatctctactaaaaatacaaaaattagccagatacggtggcacatggctgtaatcccagctactcagaggctgaggcacgagaatcacttgaacccaggaggcggagtttgcagtaagacaagattgcgccactgcactccagcctgggccacagaaggagactttgtctcaaaaaaaaaaaaaaaaaaagaaagaaaaagaaaagaaattagggtaaaagttacccctaggagagtagggactggaaggagccatgaggaagaatcttggaggcaggtagtatgttgtatcttgatctcggtttagataacacagatgtgttcaatttctgaaaattcataaagcttatcacttatgatctatggactgttctatataaatattacacttcactaagagttttggtaaagtcaaaaatcagcagtcagcataaaacaaaacccaactatatgctgttacaagagacatgccttaaatataagcacacaaaaagatggaaagttacaggatgaaaaagataccctatataaacactaaccaaagaaagctggagaaatctctacatcaaagtagccattaaggcaaaaagcattgctagaagtaaaaaatgacatttcaaggtaataaaggggtcaagtcaccaggaggatataaccattctaaatctgtatgcatttaataatacagcttcaacatatataaagcaaaaatgacagaactgagagatggaaaaatccacagtcattcagtacaagaagcaaacagtgaagatattaaagatttgaacagcatgattgacaaacttgacctgacatagctgacctgcaggatacacactctgttcttttcttttttttttcttttttttttttttttgaaacagagtttcactcttgttgcccatgctggagtccagtggcacaatctcggctcattgcaacctctgcctcccaggttcaagcaattctcctgcctcagcctcctgagtagctgggaagacaggcgtgtaccaccatgcctgactaatttttttttatttttagtagagatggggtttcaccatgttggccaggaatggtctcaaactcccaacctcaggtgatccgcctgcctcagcctcccaaagtgctgggattacaggcgtgagccaccacacctggccttttttttttctttttttttttttgagatgaagtctcgctctgtctggcccaggctgtagtgcagtggcgcgatctcagctcactgtaccctccacctcctgggttcaagcaattctcctgcctcagcctcctgagtagctgggattacaggcacatgccaccacatctggctaattttgtatttttagtataaacgggctttcaccatgttggccaggctggtcttgaactcctgacctcaggtgatccacccaacttggccttccaaagtgctgggattacaggtatgagccaccacgccaagctactcttttcaaatacacatgaagcatttgctaaaatagatgaaatcgtggactataaagcaaatctcaacaaatgtcaaagaaatgaaatcatatagagtatgtttgtatgttttctgactacagtgaattaagtaggaagcaataataaaaagatagcagggggccgggcgcagtggctcacgcctgtaatctcagcactttgggaggctgaggcagaggaatcacaaggtcaagagatcgagatcatcctggccaacatggtgaaaccc

SEQ ID NO: 1253 - DNA, 1216 bp, Homo sapiens
agggccgcaatcagagaacaccgccaggacttccaggacttggtctccaggactgaggtcaactgacgggggcgtggtctgactgtgtgggcgtggccagggaatgaactcacggctctggcttaaggggtgtggtgaacgaaggatggggcgtggctctgtcacgaagggcgtggtcatggagtagaggcccgggctcctgggtgaggccggcaagtttggagcgtggtcagacaataggggcgtggctacggctcgcggagcgcaaccaacgctctagaccagacctgggctcgagaccataactgtttggctttaacagtacgtgggcggccggaatccgggagtccggtgacccgggctgtggtctagcataaaggcggagcccagaagaaggggcggggtatgggagaagcctccccacctgcccccgcaaggcggcatctgctggtcctgctgctgctcctctctaccctggtgatcccctccgctgcagctcctatccatgatgctgacgcccaagagagctccttgggtctcacaggcctccagagcctactccaaggcttcagccgacttttcctgaaaggtaacctgcttcggggcatagacagcttattctctgcccccatggacttccggggcctccctgggaactaccacaaagaggagaaccaggagcaccagctggggaacaacaccctctccagccacctccagatcgacaagaggaccgacaacaagacaggagaggtgctgatctccgagaatgtggtggcatccattcaaccagcggaggggagcttcgagggtgatttgaaggtacccaggatggaggagaaggaggccctggtacccatccagaaggccacggacagcttccacacagaactccatccccgggtggccttctggatcattaagctgccacggcggaggtcccaccaggatgccctggagggcggccactggctcagcgagaagcgacaccgcctgcaggccatccgggatggactccgcaaggggacccacaaggacgtcctagaagaggggaccgagagctcctcccactccaggctgtccccccgaaagacccacttactgtacatcctcaggccctctcggcagctgtaggggtggggaccggggagcacctgcctgtagcccccatcagaccctgccccaagcaccatatggaaataaagttctttcttac

SEQ ID NO: 1254 - protein, 242 aa, Homo sapiens [sequence omitted]

SEQ ID NO: 1255 - DNA, 46675 bp, Mus musculus
  misc_feature (1)...(46675): n = A,T,C or G
gtgctgctgggcccgtagttcaaggcccgagaacatttgcacagcagctcctaagtgcagggtcatttgatgagcccataccaatccctccagaaactgtagagaactggaaagactatgagttatcccaactcgttgttcctggcattataatctcgtttctttaatgaaaagacaatggtaaattttttgtttgctcggttttgttcttttggttttccaagacaggtttctctgtgtagccctggctgtcctgtagtccaggctggtcttgaactcagagatttacctgcctctgaaggccccaagtgctagaacaaaaggcaagggccactactgcccagtacagatggtagtcttttggctaatcatctgtttcttagagtttggggtgggggatgggttttggtgacttggttagttttgatttttttaattttaattattttttaaagtcttactatgtagcctggctggcttagaactcacaaatatcctctgcctcttctgtgttaggattaagtctttagccaccatgcccgacacaaaacttagtgtattcacatgttaaaataagttggcaatcatacggtagtccataatttacaatgagagagagagagagagagagagagagagatctgggaatcactgttaatgttcttctgtggatgggcatcttcagggagcagcttctctgagaccgtcttttatgttattctattccattctttgtagcactaggttcagtgcactaccactgagatacacctcctgccctcaagtgtccttctagaaggtattacttgtcctttttgtggggacaagtgcttactctgaacaagtcaggccttttatgactgcttctgtatcattatatatttgtattactggctatcaaacctgcagccgcgccctctaagaggctgcttgcagaaagaggacgctctgtctctcatcaaagcaggcggctgctgtcttggtttgtgggtaactatttggctgaatctacagttcaggctcaacccattatctatcacttctccttgtgcaagtttctccacccatgcttgcagaatgccaggccaccaaggacatgaagtcagtgctgtcattatacaaatccatttaagtcaatgggctgtgacccgggtactattctatttgtatcaagaaatgagggcaaaggcttggtaagtgcagagatttgcatattctgataggaattgataatggcagcattgtcctgacttaggacggggaagaacatattgacggcagatgagttgcccgccccagaataaagagtaaggattcaaaccaggaactcccagatttagccattactgtagctttgctagtgtcttccaaagtgaactgttagaggtgtaaggaaagatagacagctaataccaaatatactattactatacggatgctagccttattgatgatgtgattctgatttaagaaccaagctggaagatgggcgtggtagcacacgcctttaatcccagcacttggaggcagaggcaggtgaatctgaatttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcaaaaacccaagctggaggccagctgtggaagtccacacttgtaattctagcactccagaggtaaggaatgaaagatcacaagtgcaaggccagaatgggctgcatagtgtattcaaagccagtctggatacatagcaaatgtgagaccctggactacagaatgagaccctgtctcagaaaaataaaggcaaaaaccaaggtgggtcccaattaattgccttgtgtacactggtattgtgcatagtgtctgcacaaattcccacctgaaggctgggcaaggcaactcagcaggagaaaaagagtcccaagagccggcaagagagtcagagacaccccactcccactgtcagaagtcccataaaatattaagccaggaggagagtatgggggacttttgggatagcatttgaaatgtaaataaagaaaatacataataaaaaattttaaaaacattaagccagcaaaccataacatatatccagaggacctagtatagacacatgcagactccacaattgccacgtccgtctctgtgagtctctgtgaaccctgctacgttggtctgtgcccctttgcctcccacaattccccctcccctcttcaggaccgtttaggggaggaacctgatggacacatccaatctgggctcgatctctgcctaatgttcggctgtgctttctgcctcggctcctatcagatggcttcccatttttaaggatccattccacaattagtggctcccgtttctttgagcctgtggtaaaacagtacattatagaaagaataagtatcagagcgaaaccattgactcatgagccaggaaggaaggggaaaaaaatgaaaacaggcaaggccagaatcccacaacgctctttaaggacatgccgtcaaaggccaaaagaactgccataaagccccacctctcaaagattccagcacctcccgatggtatcgccttggagatcaaacctctgttatcagtctttcggagacttccaacacacaggcactgacatcctgttttgagagctgtattggatgatatgatcatctaggttctggatagtaatcattactgagtccactttaagtccttccgcagcactggaccacactctgcttcctaccgtcacagtgtgtttagttatgttacaggtacaggaaaagcatctataattacacctgtgttcatgagcattccccacagaaactccagctagcacgagatggtgtttattatgagagtcatggtaacagagggtgggaatgcccatgacagactatctgcaaggtgaagaccgaggtaagctcagggttgagtctgaaggcctaagaaggtggttttgattcgcagcaacgggaagggtgtgctggctgcagaaaagagatgaatctcacctttcctttgaatttatatttgcccggggaccacggtgtctgcaatggtggccaccccatgtgaggtaagggtaaatttcccttccttattgcactgattcaaataccaatcttcccaggaacattggtgcctaatcatgataaccctggttcttaggagaacggcaggtttcaggtcagcctgagctctatagagagatcaggcccagggtgtgctacacacaaagggctgcttatgctatgtgtgagccaggctcttcctcatgcacacacctggaaataatgctttcccagctttctggatattccttaatcaggtcaagttgacatcaaaagttgactatcacaggaactgaccaataaaacatattcaataaatactagcacatatgctgattggcatatcacctaccaaagtatgatctgtgggacagaagtcctggagagtttgtttgcaccgtctcatgaaatgagataccatagtcatatttttggctttaaatgagtgagttcattaagaataaaacaaaccaacaaacagatattcaaaatagtgggcagaaatcatggggaagccagttaaagcagcctgggggagttcccaatagagagagacccaggcagagctgagtccccttgggtgagcctcccaagaacaaatagcaacccccccccccaataatacatcatcaagtccgctcacagaatctagcagaacacgcctggaaagctgaggtagtcggagttgtggtttgagctttctctgtgtagccgagcttctcaggactgaactcccagcctctccttcccattgggagattttcttttagatcatgggagacacaatagtacctctgttggaagagtcttgccttccagctcttttcaaggacagagttgtcgctctcgggctgttctgatgttctcttccttccctgtcacagagttgggaggcaacccatcccaagactagggatcaagaaggacattttgagacacatgtagttgattctgaaatgcggggtacgggggcaagcctacgtctagacccagcttctcggtgagttcctgtagactgtgtccgacaacaatgtgcccactcttcacctctccatcagtgtcagacacaaagcagtcactgtctgcatttttatgggatgggttgctaccttatgtaattatgaggaggtgtgtgttattccaggcatgtctagtgaagattgtgtttgttccaagtttggtcatgttgcctatggtttggcttttctagttgttctcccgtctcctcctccaatccatgactggtctccagacagattgaatacctcagtttgtaggatgttgaagctgaacaatgtgatgggtgatctcagtggtcaaaatgatgagacgtgggatcagttagaggtctcctggagcacgcctatgaagggttatcctaacttaactggggtgggaagactcgcccattgtgggtggtatcattcccaatgctgggatgctggacaatatataaaggagaccctaaaccgagtgcaagcagccactgctgagattaaaggtgtgtgtcaccatgcccagccctgcctttctttttcaaccttcctaaaacaaaccaaaccaaacaaaaacaaacaaacaaacaaaaatccctctcaagtgcaggccaaagggacttgtacccagagagcagaagatcagggagatgcgacagtggtaaatgacaggcagtctggagcgcctgcctccatcctggcacctgcatcccaatcaccaagtcattcataccagcgtctttcctccctctctgatgaggtactcttactccttctgggtgaagacaccctctgcagccctgtaaacattaaagaggacatcttgaagagccccaaacacactctcagtcagttgttcattttaagcctatttataaagactttatatgacaagcccccctgtcgctggtgctagttcttgctatacaggaaagaagagtgtgccagcactgcatgtgtgtacatgcatacgtgtgtgtgcgtgtgtgtgtgtgtgtatacatgcctctctgtgtgtacatgcctctgtgtatgcatgtgtacaggcctgtatgtgcattcatacatgcctctcactgtgtgttacatacatgagtgtgtccccaaccatgcactcacatgtggaggccagagcagaaccttagtgacttgagacagatgcctcactgaaccagacagtccccacttctagttagactgtctgtctagcaagcttttggggtccaccatctcctcccctgatgctgcggttacaagaacacgcagccatgcccatgactgccagcagcttccttagtcctcctccagttgtcctggatatactgtgtcctcagcttccttccctgttctctgtcatatacagacggtaacagtggaattctccattcagtcccgagacagttccatgatgccaggactagttctgctggtgatggtttagtagaccagtaacaatttgataattagagaaaatattaaatccccaccaatggttgatgttacagttaaatgagtactgacattgaataaagaaaaaggagaaggagggctggagagatggctcagcggctaagagcaccaactgctcttctgaaggtcgtgagttcaaatcccagcaaccacatgatggctcataaccagctggagagttggctcagcagataagagcactgactgttcttctagaggccctgagttcaaatcccagaaaccacatggtggctcatgtaaccatctgtaatgagatcagatgccctcttctggtgtgtctgaaaacagctacagtgtactcacatataataaatacatctttggggaaaaaaaggaggaggaagacaagggggagaaggaggggccaaaggaagagaaataatgtgactgttgttcctactaaggtgctggggatgtagcccaatgatagagtacatgtctagcatacacagagtcctatgtttgatgtccagaacaaaaagaaaaagaaatgaaaaaaagaaagagaaaaagaaagaatgaatgaatgaaataaagggaggaaggaagaaggaaagaaaggtcattgttggaagtttagattcagtgagctgtggcagtctagagtataatttagcaagcattcctgtgtaactagtcttcaatccaaactttaagaatgcctactttagggctgatgagatggctcagtggtccgactgctcttctggaggtcatgagttcaaattccagcaaccacctgtaatgagaaataaacaacctttggcccggaatgagtggggccggataaagagggagaagggaagggggggggcggggagaataaagaatgcttactttagggttggagagatggttcagtggttaagagcactgtctgctcttccagaagtcctgagttcaaatcccaccaaccatatggtggcgcccaaccatctgtaatgagatctgacaccctcttctgttgtgtctgaagtcagctacagtgtacttatatataataaataaatttttaaaaaaagaatgcttactttatatctgttgagtggagccacaggaaatgatgacccacccaaccaagggagaagattcaaatactggaaagatccagatggtgagagtcatactccaatttcactgtttctccaaataagacaataacacaatttacttgacctttgagtttgaacatctccatttccttagaataaacctggcttaaagaccaaatgatctgagaaactactgtatatacatactagaaattccaggactctggtgtttattaaactctttaattggggggggggtgctgtgtggtttaaaaagtttgtgtttatcaggaaaagaaatggagaactgcagtttaggaaaagtgtttgtggttgaaccatcacagggattgtccttaatttctggttagcttgcaaaatgctggccagagcacctcttcccacattctgagtgacctgttttcatgcttcatcaactctgtaactaatgtgtggttatgagcaggttcctggttcaaagcagtcattttgactttaggacaaattaataaatggctcaagaagatttcatttcctctctctctctctctctctctctctctctctctctctctctctctctctctctcgtgtgtgtgtgtgtgtgtgtgtgtgtgtgtgagagagagagagagagagagagagagaggagtttgtaactccaaacaggcccagaagggaggttttgaagtgccaggccattctgtgtccttgcatgactgcgggaagcccaccattaactagcccagctccgggtgactctcctccttgtttagacgacagctacccagaggacgagagtttgtgaagagaggaactgctatgactactttttcattccttttatctgacagttgctgcctgaaaataaattttttatctactttccatgggcttccttcttctcaagaataagactatcccaattagtaatttccattgtttcttctacaaaatactcatcgctagttaatttttaagttagacgtgctgttcacattacaatagacttgaacttttctcagaacacttaacctccaaaataaagtgttggtttgaacagctgcatcaaacaggtccagggcaggacacggtccgaacaggctctctctgacagcctctctggattgtagcttctaggtacatagcacgacacaaacctgtcatttttaagtttctagaaactacctttaaaacatgaaatcagggctggggtgatggtttagacattgaagtgtttgccacgaaaagcgcgaggacctgagttccggtcccagcatccaccttaaaagcctgagttccggtcccagcatccaccttaaaagccaggtgttggtggcaggagagagccccgcagtcaagaagcctgtgggtcctaggaccgtcatggtggctctcagttgtctgtaactcccactctagggaatccactgccctcttccgagcttcacacgcttctgtattcaaatggcacacatgaacacacataagcatacacatacacacaaaaactgtgaaaaattatttccaaagtttggtatgtcagtgaacacctgcaatagcactgggaaggaaattttaaaaaaaacgaaacaaacaaacaaacaaaaaaagtggatcccttaggaattactggcctgccagtctagcaagctccaggttctttgaaagtcactgtttcaaaaaggagggtggacattgaacttttgtatacacacataagcacacatgtcctcccttgcacaaacaggagtgttcgaggtcacagttatgtctacacatacacatatacatgcacaccaagaaataaaaattttactattaacccaagataatgtaatcattttgaccaaagtcaatatgaatattatgaacatgtgttttacacttaaaggacatttcaatttgtgtaagctactgacagctctatcagtagctgtcatagctgggtaggacggtcggttccagtctggactcctccctttggaagctgagggtaaacaacctctcactttgaactttgatttctattggatatttgaactcccacatacattcttcacttatcctttggtcaacaacggtgtgccttacaatgccctagtcattatgccacaaattggaaattcaaaagtgctgtaataacaaggtgttgtttgccctaaagctccatctgtaggagggagagacacataaagggacaattatataaaaatggaaagaactgtgagcctctgaaagaagtacataaacttggctttagaagtggcacctcgcgaatctctaggctgtgtagtgctttacctcggtgatacaatggggaaagagccttctagggacagattcaccgaaggtggaaggtggcgctataaaggatggcagaatggagtgcccgagtccgtgtccggacaaaggtggaaggggggggggggggaaggaaagacacgtgaagcagacaaggccctgggaggtttgaaaaatcttcagagcttcctcctgttcagggaaagtgcaaataccaccggactcaagcttctggcgaggtcagaggttgttccgcagcctggcctggttgctccgcaaggccggggccatgtgctgggttcttactcttaatctagggctgccatgccgccttgaagctctttcttcctgtctccaagcctccatccactttgggttcagcatggaagaatgccatcaacgcctctgtgctttttaaaattactcgacaggtggaattcaccatcgcgtattttaaaatgggggtcccagctacccacggcccagaactgctaaggggggtagttcaaatgcatttatggtaaacgccctgaaaattgaaaggattccccctcctggccatgtgcctacagagtgtcatgacctgccccggtcaaggccagaggctctcctgccagggttgcagggtggttgtctggagcgcctcccaccctggggaggtaacccaatgcacaactgcttgacgtgtgtccacgggaggcaccacccaaggaggagatcaagggtggtcccgctgcctccagagcgagagccctaaaccccgccaagcccgccgcttgccgaccctaccagcgcccccagcccaggtcagcccctcctcgcacgccgactagaagagggtggagcatcccggttcccgcagccaatgaacgcagcggctccctggtccgatccccggcgcggctcaccattggtcgccgcctgggtctcggcccaccgaaccttggcgacccaagccaatcgcgaggcggcgggcccgacttacaggctcccggggcggtggcggcaggcgctgagccggcggagcgcggagcgggcgaaggagacgggcggcgcgagcccgcacccttccgcgcggtgcgccgcgacaccatggagcccgccgtgtcgctggccgtgtgcgcgctgctctttctgctctgggtgcgagtgaaggggttggagttcgttctcatccaccagcgctgggtgttcgtgtgcctcttcttgctgccgctctcgctcatcttcgatatctactactacgtgcgcgcctgggtggtgttcaagctgagcagtgcgccgcgcctgcacgagcagcgcgtgcgggacatccagaaacaggtgagcggcgcggggcgcggctgtgcgccggggtagcggttctctgggcgacgggggcgtgtggggccggaggaatgggcgtgggagtggggatcgcaaaggacctggcgtgtgatgggggaagggactgtccaaggatgaaacggaagcagcaaaagcaccggggcaacaaacagaaccctaaccctaggtttataaagtgtctgctaggtgcagggcatgcgcagtgcctagaaaacgagggaccctaaaccctcgggaagtgcgcaacagtcaggtaactcaggccccccacattccaaaggaggaatggcctctggaaggtggttctgggaaatggggaggggggagatccaagtggagagattggctgagcagaagtaggaagctgaggagcacagtcatgagaggaaaaaggttagaaagtcagtttggagaggagccttatgcaggaaagaggtgaaagtttgttttgcggtccgaggtgcttcggatccttttacaatggaggtttaaagagagattaaaaggcaggatcagcccccaattccgtgtaatgtgcagcagattctgcatccagatgtagtcgtcccagtaagtagatgaggagttcatataggccagccggcaccaaggctaagacttctcttcacagtgaagcgtcttccccctcatccagggttagcatgggctccctttgccctccttatattcctctctaacttgcatcaggcttcagagagcgtctgcttcctgccgctgcccgcatggcaaccaccctcttgttctatttacttcttgctgtatgctgcagactgagcaccacaggcttagcctgcaggtgccaggcagagtgacctccagaccagaagaccttacccagggagaggagatgcagagggtgcatcgatcagaatcactttgcacctccacccccacctgcaccattttccttgggtctgtctgcaggttctatttgccatttatttacctgctggatgtcctgtgagcaccagaagacaggactgttacctgacggctccccttggggcaagagtgtattagtgagaggttgttaacctaaactaaatggaaggatgcgcaaggaacaatggggccctacacgccatacctgtgccactcgtgtgtgcagtttacagtccacggcctcctggtgtctagtaccagttttactaaaatgaggttcaaagtgtgagtcatgtgcccaagacagcacaaccgataaataaggcaggcagtcaacattggcttcggtaagagcctgaactctcaaccccctcagccttgtgtctccatcccatctctgattttgttgcctcatgcctagtttcttaccatagcttcccaaatagttacctactttctggaccctttctgtctctcttgaggatttgacaaagaactttttaacccccaaatcccatcaatgtcccaagcttgatagtttctgcctgtgtgatccagcagcaaccgctaatccactccctcacactctgtttacataaagtctcccactgcagggtcaggcagagctgggtggtcttggaattcaccctttgtcttcccaccggggactcatagtcctgcatttctgccagactgaatcagaggaaagcccctccccatcctgagccctctgacagacagctccagggcagcccactgacccttgaccagactcttgcaaaacttagttgaagctggtttgagtaaaaaggacactagcttgtgtcctgaacagcatctacctgctggatgccctgtgagttctagaagacagtgactgttatctgacagctgcccttggggtcagagtatgtttgcgaatgcctgttagatcagtacagctggctgaggcataactgaacccaggaccccctcccccatttatcttcatcctgcctgccatgtcattcttggctcttccttcccttgagttggctccgttctagtggggtgctgttttcctgtggaatccccaacactttccggcttagatccagccagtgttgccaccacctcagtaaagagagagtgccctcctggaaccagacccagaaggggtttgcctactgggctcacagtcctgttcctaaaactgtcactgtggccagcagggcacagtcagcctgggtggggggagaggaatcactagaagcagaggaagaggaaccggttggtgcttgggtgccctgaccacagcaatgcatcacgcctgccttgtccgtccgcagggacaggacagcttcctctattcctcattagtgcatcaccctctgcaccttcttgctccagtgtggaagttttgccaaagtctttcctcccactgactggctgctccttccctgtcccctctgtcaaattggtacatgagttagcgtatgtggatgctgacagcaggcatctacttggcactggatacgctcttcttccatggactaagcccctctgtctccctcccagctctctgtctttcgggctcggcttgttcagtcctggttatgaattcgggtctttccagtcatggggtgtacaacctcatacaaactatcttgcctgggtttcctcatctgcaaagggggggtgtgtcacccagcctcctgagatgaagagatctaaccagacaatgaacagtaggtgcctcactgggtgattgtacgatggagatgataatcatgtttatgactgctctgctactgctagaaagccttccctgggctttccacttactgtctttggaggactctgttctctagggctttcttgcattcgtcctcgtgcagtaacaacacattggctgttctgttgacgtcctgagctagggagactgcacaggggaaagccctcagcgtcaccatcctctccaatggggcctgggtaaaggcattttttcccagctccctcatcctgaaagaagggctgtgtgtccatccccctgggactcccagatggagccagctgagtcgtatcctgtggttacaggtccgggaatggaaggaacagggcagtaagaccttcatgtgcacggggcgcccaggctggctcactgtctcgctgcgagtcggaaagtacaagaagacccataagaacatcatgatcaacctgatggacatcctggaggtggacaccaagaaacaggtgagggggctggggtcgtagctcagtggtggagcgtttacatttacctagcactgtgcaaggccccgggttcaatcccaggtactgcccccctccttcccccaaaaaagtgacaaaacggagtgagcacatgctgtccttggctctggggtcgggtcagcactgccccgggtatgagtgactcttgggaaatgagttcagttcacccagagtggacaggtccgaggccatcgggcaagtctctacctcccattgttggcctccgagcgctgtagccactaggaggaaagtctgcccatagtcagccaggcaagctgagaactccagggaatcttttgattgtcttagttctgttagggaaaaaaaaatagggatggagaaatcccaggcaaaaatgagagacaaaaggaccctgtttatctatccatcctggtaagaaagtatgctggtaggctacaaaggtagctggcgaggggaatttggtataggcttgttggttggctagcccaaaagtacacactctttgccactgctgccctctgcaccccccacctccaccccctaactccccccacatactaattttacttcttaatgcttctgggccttttagctaagataacgtgtagatattcttcttctcaacacgtaacttaaggaaagggggactcggcttacatgtcatcagaggtctccagcgcggagatttggattgcactttcattttaatagaaagttgcaatatccagggacaggagtggttttgactgcggtgtgttcacctggtgatatttcatcactgtgagaccccggccgaagtactggtatcactgtgccttctctgagacagctttgttggtattgcctggcacaatgaaccgtacatgtttaaagtacgcagttgggtaataaattttgacatgagttttgacatgactgcaccagtgaaaccattatcaaaatacacaaaatacagaacactcacccccgccattacacacacacacacacacacacacacacacacagacacacacacacacacacagacacacacagacagacttgtaattctctccccaaacccctccctgcccgttccacccacagcctctggttagcagtgttctctttctgctgttataaataagtgttagactttggatactattgaaagaaatcattcagtgtatactctttgggtctgggttctctaatgagtattttaagatgcatccatattgatgtccctggtacaaagggttttactgctacatagtatcttttgcatggccagtctgcttagtcattgacctgctggtgggcatccctgctttttccactttgaagctgttacaaaataagtggtcagtaacaaacaggctttctataaacatgcaaggtatttcttttggactggagagctggctcagctctttcagaggacctgagttcagttcccatgtcaggcagctcacaatgtttacgactccagctcaggggggttccaccatgcgtatacacatagtttaaacacataaaaataaaatagaggccagagagatgactcaccagttaaagcatgtgtactgtgcgtggagaggacccaagtttggttcctggcacctccatcagggggtcactgccacctgtaactccagctctggatagaaagattctggcttctcaggacacctgcacacgtgcccacgcacacagacacatagattaaaataagaactctaaaaataaataaataaataaaagtaagtctttaaaagtctttccttgggcaaatgcctaggagtagaatggctgagtcccctgacaggcagctgtctacttacgtttaaggaaaacggtcaggttgttttcctaaggagaagtttcactttacagtgccgtgggtattgtgtgcctgctgctggccgcatactgctgaacctgttgtagcgggtctcagttttacccattctcagggtgtgttggggtggcgtctccttgtggtggctgaagacccaggtcatccttccatatacataaccagcctccagcatgttgtctttggtgaggcccattcatattttttgctaatttttttaaaatctgaaatcatgccatattgtctcctagcaccatggcttgtcttctgaaaaccagaactttaccactcattcagggagtgtggaggtcagaagacggcttcgggaatgaataagttgtcaccttccatcttacaggatcaggacttgactattgagccatgtcactcacccccccaaaaaaataatttctgatttcccttttgctatgtgttttgacgggttattacaagaatgtttagttttcaagtatttagcaagatctttctatcttggacttctgatttaatttagctgttgccagaaaattgagtgctttcaactttttaagggaaaaaaaaagttaagagtgtgtgtgtgtgtgtgtgtgtgtgtgtgtgtacgtacactcacgtgaatgaactgtttgggagtgacaaatgtcatcgagatcccattgctcattggcttgcccaaatctatctctacagctctatcacttacttctctactaggcagaagcaaacatgtttctttattttttctgatgtccttttgattaactcctttttttttttaattatgaaaagatgtatcacccttctacctgctgcctcctctcagatgctgggaggatgggtgtgaccactgcacctggcggagattacctctttaaaaagccttagttatggtctttgttctgaaatctactcagtccgatagtgatgacactagtcgctaatctcgttaaactagcatggcatgatgtgtaattttgtaatatttacggttgacctaacagagtgtgtttctcttatgggcaacacccagttgggtcttgctgtttttttatttagcctttgttttaatttacttatgttatgtatgctagtatactgtagctgtcatcagacacacaccagaagacagcatcagatcccattacatgtggttgtgagccaccatgtggttgctgggaattgaactcaggacccctggaagagcagtcagtgttcttaaccgctgagccatctctgcagcccctctctctgtcttctaattgaggttgtaagaccgttggtcctactgcccttccttgacgtggcggctggagtatgtcacgtgttgtctatttatgtgcatttgttcctttttctcccgtcttctcatctcagtctgtgagagcgtcctctctggcgtccttccgtagctctgcctgggggtttccaatctacattttcttcacagcagtgatgttacctcacttcacacaccgtggaaagaccttacgacgtcatacttacattgccttcctcccaccctttctactactgtgtacgtttttcttagctccacactgtattatatcaatattttaatgaccagttgcctgttaaaggaatttaaatataagaacatctgtttgtctatagagttactgtcttttcagtctattctagagatttatgtctgccactgttttccttttgctcaaaggacccctttgagttcggggccaacctggtctacagagagagtttcaggacagccagggctacacagagaaaccctgtcttgaaaaaccaaaaaacaaacaaacaaaggacctctttacatttcttatatacatcacagtatatataaatatgcattcttttcaaggtattttttgtttacgtgtctgtgtgtgcacacatgtgtgtgagtctccaaagaggccagaagagggcatcagatcctggagttacaggtggttgtaagtcgcccagcatggatgctggaaattaaactcagagctgggcttagtggcttagtggttgaggtaaaggccagcctggtctatagaatgagttccaggacagccagagctacacaggcataaccaggaaaggactatataggggaaatgaggagaaagaagataggagggagggagggagggagggagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagataggctttccctcctctccagcggttaatgtattttaatcactgggtttgataaattttattatgaaagtttttggtgtggttttcttcataattcttgggttcaaattttgtaaggttttcactggttgtagaaactttgagggcttttttttccctgcctcctttttttctccttctttggagactgctattacaggtgtatttggcctcttcaacttgttcaagttatttcttcagtctcactttagatgatctctattactatacatataaatccactgcattttttttttctgtgttacccagtttgcggttagcccagtccactatatctttcatttcagacactgggtcttgctaatatttttgtacatgtatgtatgtattgtattgtattgtattgtattgtattgtattgtattgtattgtattgtatgtgtgtgcacatggatatgctatggctggcacacatgtggaggtcaagagaatcattttcaaaagtctcaatttctagagattgacctcaggtcttcaggcttgccaggcaagttcttttacttgctgagccctctcgctggccctgaagtttaactacttgaataaggagaatccagttgatgtccctgattgctaattctattgtctgtcagtcctaggtctgtcttgcttgatggatttttctcatcagtatgggctgtgttttcctacctctttgcatgcctgtaacttttaactggactgttgggacactctgcccttttcctagtgggtggcaggcattgcatttccacaagtctcaaggttatatttccaggaggcggctaaatcccttggaaacaatttgatccttgttgggtcttgattttcttgaaatggaccagagtaccatttaatctgagctaattgttccctaccactgaggcaagccattctcaggacctgccctagaccccatgaatccgttttcccaggctagcttataggaacaggtaactgtgtcctgctctggctgacctcctggtgtctttacctgtaatcttccctctgggctgtgttgcctggcctcagcctcaggcagtagctgaattcgtatataccagtccatacctggatgaagacgctgaggtgccctttgcagttcttccagctatcctctttgggcctgggcagaactgtattctcatccactgtgcagtcagctcctttctgattggtccactgtgctgtcagctcctttctgattggtccactgtgctgtcagctcctttctgattggtcctctggagcgctggtcctctaaatcatgatacaggctccacaaaggttcctctcactctgggcagatgagggtcttctcagaactcctagtttgtcccgtctctcaggtatggtaaactgttgtggcctgtgtctaccttcttgaaaactcctgttccatgtatttcactctgcttttttcttttttccccggggcagtattctggtccctggtgctgtgtctcagcatgtagatagtcacgtgattgctcactggcgtgtccatgaaaaatcagttttataaaaagccttaatgataaaagatgatgttcatagtttaatgctaatttctgtttatttttattttatgtgtgtgaacgttataacttcatgtatgtttgtgtgctgtgcccaaagagaccagagggcagtgttaggttccctggaactggatggctttgagcctccatgtgggtgctgggaaccaaactcaggtcctctgagggaaacatgtgttcttaactgctggaccatctcaccagccccttgtgctaaattttttaagatctgtttgtgtggtttgcatgtgtgtgtgcctatttgcatctatgttgacgtacatacatgtgctgatgtgtgtgcatatttgtggaggtcagaggttaagttggatgctttctttaattgttctcaatcatatagattgaggcaaggattctcacttgagtccagagcttgtcggtttgacaggtctggctagccaacttgctctgaggatcccctgtccctgcctctcatgccccgggcaggttgtcacacccaggcatctgcatgggtgctgggagtctgaacttctgtcctagtacctgtggtatccactgagtggtcccccagtctttaatgctaataatttcttttcatatatctgggtgttttgcctacgtacgcgtctgtgtatcccttgtatgcttggtgcctgcagaggccagaagagagcatctcgccctttgaactgggttgtgagctgccatgtggattctgggatcaaacccaggtcttttggatcagtatccagccctcttaactgctgagccgtctctccaacacccccccccatgctaaatattaatatgtgtatgtgtgggtttgtacgtgtgtgtatgggtgttgtatcaaagcatacgaaagagcagcacagacatatggagagagaggcagatctgcttcgtggttgtcgctgggaagtgaagagctaagctggatgatagatgccttcttccttgtctctgctgtcaatgccaaattaatatttctcctagaatctaggaagatgaactgaacatttgttgtgtggtggtattacacgtgtgtgtaaccacacacagctgtagtgtgtgtaaccacacccagctgttaggagatcttcaagaggatggctttcaacactagtggactcagaaccagagatcatattctctgtaattaaaggcaggacagtgacccagcctctcccctgtctacagattgttcgagtggagcccttggtgtctatgggtcaggtgacagctttgctgaactccattggctggaccctgcctgtgttgcctgagcttgatgacctcacagtgggtgagtctccatgttcacggcaggatcgcagcagaggaacacgggtccccttccgtaccgcagatcttcttcattgctggctactctcccgtttgggccagaaatagccttgctccatttctgagtggttcagatattctcatcccatctgcttcctcgtgactgtccatcactccagttataccagtctcaaacacagaatgagtttggtgcctctccctgtagggtctgtggccaccaaagctcttatccaaggctatgatcttcccataggtcatagctcctgccacctagtaacctctcttcattagacttcctcttagagtgactttacacactggtttttgttgttgttgttgttgttgttgttattgttgttgttttgagacagggtttctctgtatagccctggctgtcctggaactccctctgtaaaccaagctgaccttaaactcacagagatccccctgcctcaaactcctgagtgctgggattaaaggtgtcagccactactgcccggccacacacagatttttttttttaatcctctaagtctggtcagagatgagggtggtgaccatcctggagacctctcactcctgcccctcaaactgatggatggggaatgtcctatcttagcagccccgtttccgccagccccacccagcactctatagctttccctgctgacagacatgtctctgcagggggcctgatcatgggcacaggcatcgagtcatcgtcccacaagtatggcctgttccaacacatttgcactgcctacgagctgatcctggcagacggcagctttgtgcgctgcacaccggtaagttcagaggtggggtcattgcggctgaccagcgagtcagggaggaagctctcctcgcactgcttcattgtcagggcacctcttgggctgtccttagatgggcgtagacgctgttaagaacacgttgtacacattacggtgtttatgttcttcacaacctatgaggtgactactaagattacccagagccagctaggaagctaaagctcagagaggttaataacctgcccagggtcacacagatagtaaatcctacaccgctaagacttaaacctccgtaattgggttcaaggtgggtacatcacagccaccagaagagagccggatgaaggataactagctcaggagttcaggtctgggatcaaaagatcccagtcagccaagcactaaaatcacattggctcagcccatcttccacagactcatctgagccctgtctgtccgttttcaagagaagaaaggaagacaggcttctctgaggccggtttctcctctgacagctgtgtgaactggatggagaacatgctggggtctctgggggaatcctgccatagagcctgggtgcagtttctgcagttcgtgctgctgtgctggggacagtgagatgagcgagtagcccagggactggatttggtgacagccctgctgtgccagaggcttctgccgccttcctcagagcgtccttgtctagtcctctatttcaccgttccccatcctgcctgccaccatggtacatttgttacactggcacacaagtagcctatgcgtaaaccagcccaaggctggattcttgggggggggggggctcatttagatataaagaatctaaccaacagccactgcttcagagttgggagagcctacctgggcccagctggagtagccgactttccagggagccttgactgagacaggtcaagtcgtgctcctatcagatgtgggcagtgttctgccagactcttaagtgtagggtaaagtgggccaggaaaggtattgttacttttagtgccagccagctcaggaggggaatttgcattttcatgtctcctggctaccctgactctagtagggacccagctcatgttccctgcactctgcccctctctgcccccttagtcctcccactggggttttcaggcagttctagttatgaccttgctgggtgcttcagggcctaggcctcagcagcaggaagtggatgctgtttacctgagcatctctgaaacagggagcagtaggaggttaaagtcacgtgaagcagaaattgcagagggaaattgaatacaggtgaaagcaacaggcgggaatccagtccaggccctgcgccccctcgctgccctatcaggtcaagctctcagcctatgccaattctctctcccagtctgaaaactcagacctgttctatgccgtgccctggtcctgtgggaccctgggcttcctggtggctgccgagatccggatcatcccggccaagaagtatgtcaagctgcggtttgagcctgttcggggcctggaggccatctgtgaaaaattcacccgcgagtcccagcggctggagaaccacttcgtggaagggttgctgtactccctggatgaggctgtcatcatgacaggggtcatgacggacgacgtagagcccagcaaggtaggccaggggaagaaaggtgggcaggcactgggcctatttagactgcttcatgtggcatggtccaccaggatgcaggtaacaggcttcctcagaaatgtgaggggccataagaggcctatctcctccactgctgccacccgccagtcacgtgcttcccttatagacagaacctgttgtctaatgacagcccatgtcatagatgaagaaaccgatgctccaagggctaatttagatttctacaaggtggcagagccaagatggagtaattgccttgatacttcctccagatcaaatgggcacacctcagctttcaccatacaacgtttagtgttttattaacatttgacacataacaagtgagtaatgtgtaacttattgttacacataacaagcaagtaatgttttagtctttattttcagacaaggttacctacctactagctcaggctgacctggagcgcactgggtagtccaggctaacctccaacttagggctatgatctgagtaagttctggaaatataggtgtgaatcactatgtaatattttggagtttgtttgtttgtttgtttgtttttgttttagacggggtctcactgtttagtcctggctagtctagatcttactatgtaaacctggctgtcctcaaactcagagaactacctgcctctgccttccaagggctggcattataagcatgtgccactataacccagcaaccaagtaattttcaatagcaggtttctttttccctccatccagacaggatgcgcgcctatggtaagagacctggaagtctaaacaaataaaagactcactcacatacgtgacccaaaatggtcccgcatttgtttcccccttacgcgtgtagaaaacctttttaaaataagaactagggtgtcggtgttgctcatgtaaggaagttaaggtgcctcccatcaccccctggggtgatcacgtccacagttttctctccattgatcagtgtctgtggctgtgcgtgccctggttttctatacagtcacttggttgtgtgtcagagtacttggcctgataagcacttcctttcgctgaaaatctaagactctcttctcctttcctaccaacatgtacgaatgaaatggagtcctaagcccaggtgtgagcacctgaaacgtgagggagggaggccacacgggcctcagtcgggcagctgcgtgcgtgcctgtgtccggcagcaggtggctgcatcccttgccagctgcagagagagagagagaatcacactttgatttttgccaatctgataaggttaaaaatagtccctctttgttttgtagctctcttgttacttttgagggtgaacatatctttacagggttttctagcttggctgcccttacctgtgactgtctcttcaaatttgccttgttcaagtggataagcattgtcccgccttagtcagtgtaatgccttcagaacaggtcattgagcaaatgccctccctctctgtccttaggtggcaatgtaacttgcttccagttttgtttttaattaattttaaagcagtgagaaaaaatttgctcttcatcaaagtattggcatgtcttaaggcatttggtctatacctatatacttaaaatgttttaaaatcggggccctcaagatggctctgtagctacttcgcaccaaggctgacacctaaatttgatccctgggacctatgtgacagaaggagagaactaactcccacaagttatcctctcttacacacaaacacagacacacacactaaaatttgtttttgtttcattgaaacggagggctagaggtttagcccagtggctgcatgcttacctaatatgtgtgaggctctggcttcagtaaaatatatttcgaaaaagactcaaaagtcacggggaactgtcccttcttcatattaggaaatgagacccagtgagaggtagagactcctagagatgcccaacaaacaaagcaggtttacattcttgtctccgccctccgagtcacatgggtccctgagtggaaactcctagaatttagcagtgaccacagcattgattccaggcaggaaatgtgtcaggaagagggcgtccaggagcattagcaacagtagccgtagagttgaagtgttctggctctctctagcctcaagcctagtcattgtgagccccccacccgtaatcgcctgtggggtatctggtgtagaggtgttgcagcttctctagggcatttccttagaggctgtccacggtgtcaagctgagggagggggatgtcaagagaagccacccatcactaccaaaatagcttcagtgtggtccgagagtcggtaccatcagcatgagtccttagaaggattcgctcagctcctgacgggtttagacccctgaacttcctgaggagagagcaaaggtcccgagaccctttcaggagctctttcaagtcaagtggtaggaaagaccaggggccagagtctcttgccatttgtcccagcagataagaccaggacaccaagtgcaaacggagtcgggacaggaggagtagatgctgtcacatgggccagccaagtaccatgaggggccctcaggtggcaccacccagggtgaggctctcatcctgtgagactgtaacccacttcagagccaagctgggggtcgctctctgtggatgcgttaaagtcagcttgagcttctgcagtcgcctaggcttcccagctgctccgtgtcctgagtgatgcttagcaggtttagttaccatttctgagcttctctggcacagcgtttcctgaagatcttggacccagacaccccaagtttcgacttaattacacagtagatgcctctgccaggcaagtagcctggcccccactgccttagatcaagttgctctgtttgctgtcggtttcggcccccttctgttacctctgtctacagggaagccagcttgggcaaacaaactcttgtgcaaaactgtggctccccctctcctccccgcagagtgcctaccagcaaaggaggctccaaagagggtggtacgcagagaagtcgcaggtgctggctgcagaaggaaaggccatcgggaggccaaggaacagatgttgtaggccacgcccatgctagatgtgccctgtgttatacgtttaacctacacagccattccagtcagcagtgtctccatcttgccatatagaaagtgagacacacaggctaaaagatcagcctcgtggcttgtacgtgggaaaagcagaccagcagagatagaacagtatagtgtatacagtatggtcttagtttgggctttaatggtttggtttggtttggtttgggggggggcggggggcggggatgcaattgaaagccctgaaaaaaaaaatgaatgtatattttattgttaattcacattcatagaaaacagggttagggagtagcctgcaccacttcacacaactagagaatggctaggccatgcttggctctcttcccaagagaacctgcccagaattcagttcagaggagttgggcccaaggtctgagcagctcggtcatcttggcatccagcagatcatgcctgaccctctgagggctgtaaggcactactagttcagtgtgccaggtaggattcaaggatacagagcccacagccaggacattagccacctaggacaatccctccaagagaaggaaaatactgggaaagtgctgagcccagaggcctggtgccagccccgggaaaacagggaagtgtgtcacggttggctggagcaggggccgtggattgcagtaagggtgatccacactggcttagcaaggacagcggggaactaacctgtgcagagccctgcgttatcactgacaccgtgaacattgactctgttctaatgaggacaagagnnnnnnnnnnnnnnnnnnnncatgagctggctgcatggccctgtgcataaccctgaggttcactgagtgtgtgctttttgcaggagagtccctgctgtgcccaacctgcctggctttgaagactctcccaggccacaattgacttatcagagctttgcaaaggccaaacgcattagacagcggctggatcgctcttgctccctggtggctccccggtggctcctgtgtggcctgatcacaatgccctcttgtcatttcagctgaatagcattggcagttactacaagccctggttcttcaagcatgtggagaactacctgaagacaaaccgggagggcctcgaatacattcccctgagacactactaccaccgacacacgcgcagcatcttctgggagctccaggtgaggcttggctctctcaggccctggctcttaggacagcggccattcatattgcggccacagttctctgtctctctctggtgaaggaaatggtctcgcccgtgtggtccagcagagcagttgctgtgatttggcctggggacagccggctgcagggaagagtttgcttttcaccattcacactgagtgtgttagcctcactttgggaaaaggtagacctttatcttcctggaagtgttaccattgccgagcagaggggctctagctctgtgtggggccaaagcaagagggggaagtcaagttgagcctggaggtgaacataagtctgtcactatgttgtagggatgagtgggaaccttaggagatggtgcatgctgtggcccctggacaggccacacagaacctccaggggagtctctgggcagaggaccagccagaggcaggccatgagaattaactagtgtctggtgcatagttcagagagctcagtacacacatgaagctgtttagcttcaccttcataggaccacagatgttttctttgtaccgttaacctcgtgcccactgagcaaggacgcattttgcacactctctaggggacacacaaacacaggaagtggagttgctggagaatgggaatcgtgtgtctaactggtagaggtcctgccacggtgtctcccacagtaattatgaaattatgatgcttacatctcatctggcagcgtcccagtcttcctgtcctggccaagacttactttctgatttgtaagctattgtgattacaatcatcctcagatgtgccgtggtgccccagagatatctgactgtagctccttattgatcccttcatgttgagcgtctgtcgagtgcctgtgggccatttgtggggtctttggctggtttttatttttagtccgttcattcatttttggtgtgtgtgtgtgtgtgtgtgtaacatgatgtacatgtggaggtcagaggacaacttataaaaatcagttctctcctccaccttgtgggtcccaggaattaaactcgagttgtcgggcttggtggcaagcgcctttatccacggagccatctcatgagcgcctttgttcaattttcctggtctgtttgtgttttgttgttgatgtgtgtgcatttttcacatacttacacatcttcacacaagatgctgagccatcagcagatacatgatctacaaatatttcttccatcctgcacgctgctcttcatagttttggcagtgcgtgatgacgcacatgcttttcatgtagatgaatcccggcttatctattgtctcagtcatgcttaggaatgtattaacaaatgcaagataacagaaatcctctctatatctcccaatctattgcctccctggcactccgaggttgtaactcttgcgttgggttgaacatttggcacatactgttcgaagcaagagccagctgcagtctcctacaacagtctgtcctctggtccctgcaagctgtatatgtctgagacacagcaaggttgcttagctagagcagagatgcagaacgaggtcacacggtagcctgaggctaggtctcatggctccttgtaggtcaagtgagaaccttacactttattataggtgcgataggaagtcagtgggggcttggggcaggaaggtgatgtgtcctagtttttatttttaaagactatcttagccgggcgatggtggcacatgcctttaatcccagcactcgggaggcaggggcaggtggatttctgagtttgaggccagcatggtctacagagtgagctccaggacagccagggctacacagagaaaccctgtctcaaaaaacaaacaaacaaacaaacacacaaacaggaaggaagaaagaaaagtaaatctttggtagctggatggagaattgattggtagctggatggagaattgagtaggttggggactgagtgatcatggaagaagagatgaaagatttctgttgtctgggaggcaatggggacgaaaagcagcctgaggcccaggaaggactgactgttgagccagcctacaggattgccagacagattggcatgagatcaaggctggagacccaagaactggtgaaagaggtcccctaactgtgacaggaagctgggggtgggtggaggtggcacatgatggacacgggaaattctgccctgagcatatcttttgaaggtagattcactgggaatgcaggttgggccctgaattggtagccagtcaactgtgtgtttgagaatcagagggtctcagcagagataaaggccatgtgtttaaatatgggccagtggcagagaaatgtttttgaatttgtaggggaaatgtttgtgtttggttgtgttgtgtttgagataaggtcttgtagcccatcatggtctttatgtagctgatcttcctgcatccacacccccacttcctccagatgctgagctcaaccacacctggccttttcttctttctagcaaatgatatttaaagccaagatagtaggcgcataaaaacgcccagcctgggtgccctacagccctggggaggagcagccagcgaaagagaaggtgcccttaaccatagccaagtagagaccttcaggaaagcattgagtcctaagtgagatgaagggatagagtcagctttgaatagcaggtggaagactgggctggtggaaaccaatctcagaggctacttctaacaggacaaacagacccaggcaggggacaggagccagacgaagctgaggatggcgctaagaaagatgcttgcttctgtgattgttttcaggagagatgccaacatggttatgtgtcctggggctgatgagaggaatgacggtgttgggtgggggctctggaatggagccttgggtggcctcttggtggcatgtgtagtgaggaacaggctcctggagttgggcacagcttggtcccttcttctggttgcctgtaatttcccagtgaaatcagaagtaggaattccagccagggcgtggccacagcttgagaagggtgacatgaaacttgccccttagacaatagaaagttcattgtctgggaatgaccacggaattcagcctcctgtgactggtgactgtgcgctcagggcaaggccagtgtgtggctgtgggttttcacgctgtgaaagtgacaccgggtgggtagagcgggccacctctaggggaggttggatgataggaactgtggagtagacaaatatagacactggtcgtctgaggctccggaacattcttaaaggaccaactagctgatattttaagctcttctactccagtaatcgagctctgctgccgaggtaatcccatgtggtaccactggctctgggaaaagatatcctgggactggtttggctctgaggttggatcaccatggtgacagtgctgcctgagataggacttaagagcagtaactcagctcagtaaagataagaatgctggaagataaaggcaaaacgagccggggagctgagggtaccgaagtgtggatagatcatatctgtgagaattaaaatcaccaagtacgagtgcaaatgaaggcagcggtggtcccagacttggaaaggcagagctgcagcgtgccagggggctgtgagggggatacggtggcccacgcctcagtgacgatagccacgaatgtgaggtaagcggtagccgtgagtgtgggtgagcggatggtgccatgaagtagggcaggcggattgcagtgcttcaggctcaagtgaggggtccgtgagagcgagggatgggagggtgatggatgaaggaagctcttgctcctcgggctccttgagcctcatcacagcaaagtgacacctcgcccatgacagatcaccagagagagactgcagatgctgcagtgtgcctaccacatcatggtttccggccccccctccataccccacatgttagcatcatgtgtcatttagttgaacccactccagctgaggggcactgagcccccatctcatgagatagacttttaaaccacttcagtctgtgctcaaaatgagacttgccatatctttggtgctgttaagcgaacactgtcctaagccgccttcatttacaggaaggaacaggagtgttgacagctgtgtgtgctcacctggagtttacactggggacttaggaatgccgggcggcagggaaacagggccgggtatcaggagaagctatgctgttggtcacaaggaaagtatcagctggcccacaggaggtccgagtgggggtggccttcagaagagtgtgccctttgagatccgtggactttgcccacacttctgcccctagatcaggcctttcttccctcctccttgcctgatgaagcaactaactcccttctgccatgggtggcttcctgaggaagggacccagttctgaatgtccctggggaagtgggtggaacacccagctaggcggagttatagaccttacccggaagctgagacctttctgataagggacacatgtacacaattttcagaatgcaggctttccctcctagacaccaccctttcattggccgccttcttcaccttgctcccagtagaaaagagctttgaaagaacccagtgaacctgcatgctgggtgataagccagcccatccctcttctcagcctgacttgcccagacacctcccagcttcccaacttgcatcactgagcaacaccaaagtccagggccagctaggtaagctgtggggcccacacacaaagcaggcctatagtgccactgagcgagcgtactaaaacgtaacgccttttcctttgtcctgtcctgatgcttgcatagtaaatacaaaattaattctacgttatcagtgggcattttgccattcatcttttaaatatcaatctgagagtatttaactcttcctacttgtgtattttttgttcctaagaatgcagcactaggccgggcagtggctcacgcctttaatcccagcactcaggaggcagaggtagagagttctctgaattcagggctagccttgtctcagagtgagttccattgttagctagtatgtgggattatcatagataagaaaggagatcggggatccttgctcatccctgggactctgcagccagcccatcagaacagaggtggccaatagcaggccagatgcaagccacaattgagttgttaagagcccgagggaattacttcccttgtagggaatgagtgacttctgcgtattggcaggacccaggacaggagtaaagccagggccaaaggatgtgtcaggaggtggcaaaaagaagagcagtgtttaaacactgactttctgtggctgacagtttcatctgatacaaaccaatggacctgagaatcaggaacaggcaggcatctcatggtgtctctctgttcaccttggaaacatcagagacctgggatagcacattgctgtcaagtgtgtagggagcagtgttcacctctagtttcagagtacaagatggtgcaaggatctaaagtagggtcccttaaagctacccacaatatttaatctagagttgtctgtgtccaggaacttaacatcagaagtacatgttgatgggcaaagacatgtgccaaggatctttactgataatctctcaatgatctaagtgttcataaatacagagctgcttaaataagtggttctacagctctgtggccttactggttgcattgctgtgttctgatgctcaacgcacaacagtgggagccaagctggtggttaaactctgcctgctgtgtgggtcaagcagatggacagtggttgggcgctctcataggagagccctgactccagggatgcctgaggggtgctactgggcttttagcagttggcattcattgcagctttgggctcccattcttggggaatcttcgggagctccctctgactctgtcccagctccactgctgtctagagtcctgtaccctacactccggagagagtgtgtcttagttagggcttccatctctatgaagagacaccataaccaaggcaactcttttaaaggacaacatttatttaattggggctggcttacaggctcagaggttcagtccatcatcatcaagatggacacagcagcatccaagcaggcatggtgcaggaggaactgagagttctacatatttatccaagaaagccaggagcagactgtccccacgtggctaggaggagggtctcaaagtgccctaccctcaccccccagtgacacacttcctccaaaaagtccacacctattccagcaaggccacacctcctaatagtgccactctctggacctagcatattcaagccaccatagtgagcgtcacagaacagcaaccatgccatgaatgtctttgtttctgacacccacctttggtgtcaaggctccggaggctgtggtaccctctgcacgttggtgacttaggaaggtagccaggcctagagctgggaggaattttgtgagctagggagctaagggtgtggctgaggaagcagctggcattagagacatctgcctgtcaggatctccagggagaccaggggaagcaggagaatgtgaatggctggctgtgtgcaaactaaatggaaggctcgatgtggagctagattccatttacctggtgagagttgtccttgctgcagaccttagaaaaattgcaggagtttgtaaccccataggaagaaaaacaatatcaaccaaccaggacccccagaactcccagggactaagccatcaacaaaggagtacacatggctccagctgcatatgtagcagaggatgaccttgtcatgcatcaatgggaagaggggtccttgatcctaagaaggctcaatagatgccccagtgtaggggaatcgagggtggggagaggaacaccctcatagaagcaggggaagggaggatgtggtagggtgttccccgggagggagggaagcagggaaagggataatatttgaaatgtaaataaagagaatatccaattaaaaagaaagaaagaaaaattgttcaagctctcttaagaattgtctcttctctgtatagccctggctgtcctggaactcactttgtagaccaggctggcctcgaactcagaaatccgcctgcctctgcctcccaagtgctgggattaaaggcgtgcgccaccacgcccggctcgactcactcttgaaagctggaatggtagtcaccttactgtgttactggtcacagtatctgtttgtctctcctgtcagagacaaaggagctgagctcagagaagctaagtaactagaccaaggccattatagttggtaaacctgcgagatgggaatcaagccctagctctcctcctataaagaggggcgtgcaccctggagttacctgtccctagtggcttgaggagctgcccctgcctcctcctcctcctccccatcgccatctctgtcttttaggacatcatccctttcggcaacaaccccatcttccgctacctcttcggctggatggtgcctcccaagatctccctcctgaagctgacccagggcgagacgctacgcaagctgtacgagcagcaccacgtggtgcaggacatgctggtgcccatgaagtgcatgtcacaggccctgcataccttccaaaatgacatccacgtaagctgggtgaccaggcgggcgtggtcccatggaacccaggtcttctccctagctctgtgtcgcccacccatctgtgtatctgccctctgggccttggtttctccaactatacaattaggatcttagcccacccaggaactgtagtaccctgataagctgctttagagtggccccgtaatatggaagtatttggcagggctggagggagaactgaagctggaagcaagcacctgggaccctctagtgggttacaaagtcaaagttcccgtttgcaaggatgtgggtgagctagtcccgggtctgctacctgctgggaaaagacagaccaagctgtttctctgacctctcactcaggtctaccccatctggctgtgcccattcatcctgcccagccagccaggactagtgcatcccaagggagatgaagcagagctctacgtggacatcggggcatacggggagccacgtgtgaagcacttcgaggccaggtcctgcatgaggcagctgggagaagtttgtgcggagtgtgcacgggtaagtgacccggggtctgggggacacaggggcctcacacccaccttgtccatcctcaccgccgccgcactccttccctcccatgcaggttccaaatgttatacgccgattgctatatgaaccgcgaggaattctgggagatgttcgatggctccttgtaccacaagctgcgcaagcagctgggctgccaggacgccttccctgaggtgtacgacaagatctgcaaggcggcaaggcactgagcagggcacctggggagccagctgcatggacctgctctccctcgctcgctccggcttctctgctttcccaggtctcagaaaagaaacccctccacatccccgaggcagcccgatggcttccagggtggctcgggcaagtggaagcacgtggagtcagacagacctaagtcccaggcccagattagccactcgttagctgtgtgactgactctgggctagtcacctggcccctgtgtgccccgtgttcatctgtgaaaggaggtaaaaaaaaaaaaatatctacctgctggatgtcaccccacactaagggcttccaccactgcttccatgcaacctcacgcctggctcctgctttggatctaacagctgagtccagacaggctccccacaggtcacccttgcacgggtttggccaacaccatgaaggagttgccttggagtttcacctgcatagcttgcatcagccccgagagggcaaaggagggtcagccttccacttggcctcgggggtggggcagggggcatctgattggcaggcaggcccaggatgtgctgtgccaaagccaggtctactccaaagtcctctctgccatcttcggaccatcctggccctacttctgtgtgctcgagctgccccagccatcactgagcccactcaggactgctcctggaagacatctcaaggtgggaagcctggctttcctgggctttgctttcttaactcccaccatccaggcctcctctagagtccactgagtcacaatgggggcacatgctcatgactgtgtcacttaggggcggtccccacactgagtgagaaaggggcatctgccctgttgctactgtgaggaccctccctggggttagaaagaaagcatccagggtcactcatctccccctagagctttgaaggcaaaaagagaaatctgggccaggagggaatccaggctctgccacagaccccaggaactgaacccaggttctctgtaagagcagcaagtgctcttcccagccgagccacctctccatccttcacctgtcattaaggaacactaacacgtttagtgtagaaaagcacttctcccctttctggccaaggtgctcagccttattttacacatattgaaccaagatcagagagggaaacaaggagataggttgacaggagtcatacggctggcaagaagcagagcaaagactagaagccagtcctttctcttctaggtctgtgactgtgctcccatggcaggcccttgggaggatttaggatcgtnnnnnnnnnnnnnnnnnnnnctggaaacccagatctgagggggaatcaggttctggaaggcaagccagaactccagagctgagctggtcacagtcactcctcccccaccacccctgcccctccagaggctgcagttttctcgcctgtcacttggaacattagagctcctgaagcctgtctgtcttaagacgttgggaaagcctcgtgttgaaagccgggggagcttaaatgatccaggtggtagctagggaccgtccatcagtggtccttccctccaccgccacgccagctcctgggtcgttttcatttatctggcagagcccaggacccttagaatcatattttagctgaaggatgctcactgatgcggccgagggcttgggatactgcacagtgctactgtgtcctgtgaaggctggtgcactcagggctgtgggaaggcagaatcacctcatccatttggcctgtgaaggaagtaacctcactttgctgtctgagcagcatgtattcctggcatgggctctcctagtggtccatgtgcatccttgcgcatgtgcactcgctcgcagactgatgaccctgcttgctgcagatgaatggtcaacgcgagctaggttagttagtgtgatgtataaggcgccatcattcctcaagtcaagcctccatcccaaagcacctggagctgtggcaatgatgccagcaacctgtgtcacccaaaatagtcaaaatccagccctccacagacactccccaggacctggggagggaagggattttgagtcacattagcctcaggttagtgtttggctccagtaatatcttgcccgaaaagtggtcgtcttccaagcatggtgttctgggtcccagccttgtcttatcgcctgtcctgtcagtgtccaaccacacggtggcttggtggggtcactcagctgctatgggacagcacatgtgggaagtcaacgcaagcctctcccctccgtggctctggtttcttggctgcatggttctctgtaaattcagttgtagccactgtctttggctagaaagctgaattggctgttgctgaaaggaaggaggggatgggtgtggcgatgtgtgctgtgtgatttgttgtttttttttttttaatttggtcatggggaccaaggagaaggcatgaatccctgtatttggctcttgcagcctcaggcactgtgcctactctccaggtcatgtccctgtggttctggggccaccacttgtgtaaaataaagtacagcctggacgctagtcttttgtcatttattcagaggaccagtgtagagtcggacaaggacgcagccaccgccactggtgccattcagctccaatgtcctgtctgaacacaagcacccacagatgagggctaaaaacatgggggaagcgggtagcaaatggatttctgtcattccagtgaagaaatgctggcacctcaggagggatgggctctgtcctcaggcaccaggtacacttgtcaggtctggctggtgttctggcttcatcaatcggttgtgacaaaccagttttgacaagctcattgttcctgtgtcgatgtcctcatccaaaagccgaaggcacaacgacccttccagcagaacacagtgccttcctctgcacactaccagccttcctgtcagccagatgtgtccacagggattaagtggttagctttgcagtcactagagacccagataagcttctgttaggattgaaccacatggacttgtattttttaatagttggctcaccccaggactttgatgcccagagccgggagaatcaagttttaacttggtacactttgcacaggtgtgtatgtgatgggaattttactagaacctgtgattttcattccgaaactggcttcaagcaaccttttgggaagtcccttctctgatttcataagttgtatcttaaatctgtaatatcccctctgctggccagcgttctttctgtaacaaagtacctgagatgttgatcaagaggagagctttatttcagctctaagttctagaggttccaatccatgatcccttggtcctgaggtgagacagtgtatagtaatgggtgggtgtggcagaggaaatggtcagaaaccagggagaaaagagaatagaaaatggagttggtagtccttcagtaccatttacaggcatgttcccagggatccaaagacctcctactgagcctttcccaacagaaccagcccttgacaccaggcctttggagacatcccaagcccaaactaccattaaaatagctttcgctcttcagtcctagacataaccttacattgagatgagtcttcaccacagggtgtctccaaatctcagtcttgtaagcaagaaacggaagtgggcatctgctgactggccatgacccacccacccacataaagtacgcagtttgtcaatctcacatgccaagtgaccgggttaggcacattccagtgcctggctaccacgtgacacagacaagttgacacagaacgttaactaccacagctgcaacatcctgctttgctctgagagccagcttaaccatctcctgacacgctgtgcttccggacacacccctgaatgcaaggtcagcgtgaaaagtggccccacatcccagacccgggacagtcacctcccaggggtctgctctgcacccaacaacccatctaccctcagtttggttagatcccctttctctggctgagtctgggggtggggtgtctagagagtggatcagcagggcctgagatacaggttactggaagaggaagtcccagaagcaggctgtatacagcacctgcagaatgaaggaccacgccagggccagagtaagagcccggccagcttaggtgtgggcggttattaagtagctcaccatgatgagaaaaccaaagatccaaactccaaatgaggaatgaaaggggctctaggcagggtgcatgctgatggtcctggctactccggatgctgaagagaacagtcatgatttcatttctttcacaaccacgacttggacccacgtgagaaaacaactggtagaaccggctctgaaaacatgtctgaaatcgctttattatgtaagttctgtggctgagtctgtcaggtctcctcatcctcttctccaggggacaactggctccccccaccactgtcattgatgtaaacagtgagggggaacgtcacaggatgttgtcactcacccccgaggacccacctctaaccacactggtggcccacaatgctaaagtggggtacagcgcttcaatggctgaacactggaagtcagcagtctcctcccagcacgaggctctgttgagtgtccagagcaccctagcatggagatggggttttcctacaggtcccagactgctacgtaacaaatgctcctctccccgcctcattctgggacaacggtgagttaggtacccacgctctagcttcacagtgcaaggggttccaggaagtcacccacgaccccctcttccatccacctgctctctggctcccaaattcacgtcaccagctgactggaatgcttaggacaatggatctcttgtaacaaaagatacctggtccccctgctgtcccagtagacactgtgacttttgaccgcagggctacagcaaagatgaccctcctgccttctcccctcacccaggcattctccaagatccctgcttcctttcccatctcaagatttctcttctggccttgggctctctggttgcatcaggctgttcttcccgagtggctttaaggagtaggatctgaattgtagtccacagttggacggcacttgcccttcgtaataggtgtaatccgtttcctgtaaaaaggagaaagaagaaaacaggcacaatcccttgcaaggaagtgagttccacatccatgacctccagaccttttacaacacagagtcctttctaagggagagttctctattttatacccatttatcatagccagaatgtcttataatagctcccagggaaaaccacaagaaggctagtgagactagccagaatcggtgaggtctagcttcagcaagagaccctgcctcaaatgaataaagcagaaagtgatccagagagacagcgtacataaacttgaggcttctacacacatataaacacatgtgctgggcatccacacaagtgtgcgctcacacatacacacactcacaactacattttatacacatgaaaaacaaacacatagaaaaaagaaaaagaaaacaacagagcaagctggcatgctcttggttactgcctgttctcgccaactgtggcagggtctccaagaagtcagagctacggttgtttcatgcctttgcctgtatccttcagtctgtccagtcaaaggacagagggtaggagagaaggctcaccagagtgaggggcctctcctgccatcaggcggatctgtgtcatgtctctgttctccccctggagcctcatcttccatctagacttggagtcagaatcttttgtcttggtccttcccaaccccatcttcccacctaaacaccatagcgcagcttctaaagggaacgccagaggtacttccttttaaaaccctctgagcaccttggagtaaatatttacttatatttgtaaatacaatgtctagaaaatgacttatgctaataacactggaagcattctcaaaaggtgggggctagagaaatggctacgtgtccgagtgcagaggacccacatgccacttcacagcagtcacattgggaggctcacaaccacctataaccccagcgccagagagatctgaagcctccagcctctgcagacatctgcactcacgtgcacacacccacagacacagacatacacacataaggaaaaactaagaataaaagacaaaggtaatataagaatatgagcaacctgctctttaagataaataaaaagctttgaaaatacttcagcaaagaagtgaaaaagaatggtcaacatagggaggtgctaattcaaaccatagtgaaacacaattagaacaaaaattcaaacacaaatctctcacataacaatgatgttgtgaggctgggatgtagctcaggggcagagtgtttgtctagcatatacaagacataggttctatcccaacaaccaacaacacagtatggaaacaaacccagcacgtggagcaagtacagcctcactcgggtgcaaatacaagcggctcagcgtcaccaaatgcactgagtatttcttagaccactgtatgtccattttaccaaatgacttaaatatcctatcctgggttagttaccagaaagaagtgaaagctggctatctagagagatctacactaaagatctttagctttactaaagactgagatataaacaaaggcagcccacgcactcactgataacatttcagcatcaaaggaacaagctatctctgcaaaatgggcggcctcgggaacactgggaacgatgtgtctgtgcatggttgattccgtttgggaatggcagacatgtttgtcaccagcatgggcagtgcattgatgcattgatgcactgatgcactgatgcaggcagcatgaagaaactttcttgtagtttcatgactatgcatttgccaaactcgggagctggggagacggcttagtgtgcaaacatgataacttgggtttgctctccagggcccacgtgaaaaggtaggcacgtagcatgtgctgtactcccagcactggggaggtggagacaagtagatctgggcttgcctagcctagtgggtgagctccagaccaatggcagatcccgtcacccaaataagatggacagcattcctgagacacgcctcagcttgtcctctagcttccacaggcatgaatacattgaaatgtttagggcctagaggatggcttggtggttgaaagcacgaggtgcctgaagaggacgcaagttcagtttccagcacccacatcgcacagcaaatacctttaactccagcaccatggatcaaacgccctcttctggcccctatgggcactgcagttatacacacaaacactcataattgaacatttaaaataaataagtttaaacctcataaattgcatgcctgagaaagaatgacttttttttcgaggcagggtttctctgtgtagccctggctgtcctggaactcactctgtagacaaggctggtcttgaactcagaaatccgcctacctctgcctcccaagtgctgggattaaaggcatgtgccaccgctgcctggcaagagtgacttttatgtaggtagattatactattctaaatcttacttttaagcctgggtgtggtgacacagacctttattcctagcattcagaaagcagaggcaggtggatctctatgagttacaggccagcctgctctacataatgagttccaggttagtcaaggctacctagtgagaccttgttttgaaaaaaataagtaaataaaaaatagaagtaggtctggagagatggttcagtggttaagagcactaaccagaggtcctgagttcaattcccagcaaccacatggtggctcacaaccatctgtaatgggatctgatgcccttttctggtgtatttgaatacagttacagtgtactcatagatacatacatacatacatacatacatacatacatacatacataaatacaatgttttaaaaaatagaaataaatctttttatgaaaacctatggcttacaacagaaccaagtccaagagctcagctcgatgtccaaggcctttagtgacctgctgacccaccctgccctgttcttgctaacactcacacactctgtacaccatacccagtgatactctccatgttcatattagctgaaggtcagggaggggtttcctagagcccctctttctgtccccaacatctcaatctttcagcaaaaagtatatacaaaagcccaggaagtatagggaagtgagtagagggggtggggtagggggtgaggtagaagtgggcggggtgagaaacaagatttgggctcctgtctcagccttcccgagtccaaagaactgtccatcatcaaacttggtctctctttccggaactctgggaagagcggggggtggggggcagatactgtccaggagagctagccgcctcctccagatctcatgctttcttgcagttatggggagtagggtatgccccccatgatctgctgtcttctctgctacactgttccaggagccaggtcagtgcctgcacagaataggtgatgctcagtgaattcctgaggaaggcaggcatcaactccacacactaacagtgactctgggaattcatgctcccttaaaactccaatagtctcagctgagaaatactgaaattaatgcctagtaatctcacagagaatatactgtggtggttaatttgtcaatttggcatgttttagaaccaggtaggaagtgcacttctgggcatgcctgtgagggtgtccccagggatgtttaccccatcttctgacacatcttgatgtgggcagtagcatctcattagctgggatgcaggactgaacacaacagagacagcaaactgagcactaatgtcttaagggtttcgctgatgtgaagagacaccatgacccgggcaactcttacaaaggaaaacatttcattggggctggcttacagattcagaggttcagtccattatcatcatggcgggaaccatgacagcgtgcaagcagacacggtgctgaaggagtcaggagctctagatcttgattcacaagcagcagcaggagactgtgttccacgctgggcatagcttgagcatagaagacctcaaagcccacctccacagtgccacacttcctccaacaaggacacacccattccaacaatgccacacctactctaccaaggccgcacctcctaacagtgccactcctatgggcaaagcattcaaacacacaaatctatggagtcctattcaaaccattacaactagcatttctctctctgcatcctgattggggacacaaagtgaccaggggcttcacactcctgctgccatggaagagccgtttccactgccatcttctttaccttggtggactatgcccaccaactcagagccacaattaaccctttctcctcaagttagtttcatcaggaatcctcttacagcaatgaggaaagtaaccatatagaaacatacagagtttaaaactctgtgtatactgcaaacttcaagaatataagagtttactgttactttaagcactgaacatttatggtcccaatttgagggtttttttttttttttaggcaaagaatttgcatttttaactaaaatgctgaaaggacagtgcatgcagaagtgttttggcagaagtgtattaatgcctgtcgtttcctttgagatttatcaaaaataaaagatgactaagaggagcagaagagaaggctcagcggttagaaacatatgccattcttgcaaaggacttgagtttagtcccagcactcacacccagtggctcataaccgcttttaactctgactccaggagatctgccaccctcttctggcctctctgggcactgcagccatgcataaatactcacataacaaatacacaaacacacatgatttaaatcttttataaagatgtctaatggagtggcagatggaagatatcactaagtattaaaacattagtaatgtgataattatgtagatgacaattttgtatataaaagagagtacagacacatgaatgccatgttgtatgtcaaagggcaactttctggggttttttttgtgggggggttctttggttttggttttttgagacagggtttctctgtgtagccctggctgtcctggaactcactttgtagaccaggctggcctcgaactcagaaatccgcctgcctctgcctcccaagtactgggattaaaggcgtgctccaccaccgcctagctaagggcaactttctgaaggtggttgtctaatttcaccatatgagctctagggattgaactcaggtcatcgggattggcatcaaatgtttttatcccatgagccatctggctaggccatagtaacaaagtctaaatgatgcacgagtgtagagccatgtggtataaaatcctgtcaccttttctacatgttccatttttctcatagtaaaacattatacaaaaaataaaaagtgtaaatttctgccaagtaaacccagaagcttcgaaagtgttcctttcatgacgtcacttagtcgctggccccatttcattaatgaacacgtaggctcatcatttgacaaggtcccaggtgttcctcctctacgtatcagcaagacgctggagcaggggaacagagacactgtgtctagcttcgctgtgggcatgtgaggaagccccagtcccacggggaagcatgtgccaccctggggtgtgcaagaggctgagaataaagagacactgtcctgaaaatcagggaaggttttgtaactcagcagagctgtggctgatgacagaggagtttcccagataaacactagaacaaccatgtacagtcagtgtccccaggacgaggccagcaagggagctgccaggctgacactggtccacatg

SEQ ID NO: 1256 - DNA, 2528 bp, Mus musculus
cggcaggcgctgagccggcggagcgcggagcgggcgaaggagacgggcggcgcgagcccgcacccttccgcgcggtgcgccgcgacaccatggagcccgccgtgtcgctggccgtgtgcgcgctgctctttctgctctgggtgcgagtgaaggggttggagttcgttctcatccaccagcgctgggtgttcgtgtgcctcttcttgctgccgctctcgctcatcttcgatatctactactacgtgcgcgcctgggtggtgttcaagctgagcagtgcgccgcgcctgcacgagcagcgcgtgcgggacatccagaaacaggtccgggaatggaaggaacagggcagtaagaccttcatgtgcacggggcgcccaggctggctcactgtctcgctgcgagtcggaaagtacaagaagacccataagaacatcatgatcaacctgatggacatcctggaggtggacaccaagaaacagattgttcgagtggagcccttggtgtctatgggtcaggtgacagctttgctgaactccattggctggaccctgcctgtgttgcctgagcttgatgacctcacagtggggggcctgatcatgggcacaggcatcgagtcatcgtcccacaagtatggcctgttccaacacatttgcactgcctacgagctgatcctggcagacggcagctttgtgcgctgcacaccggtcaagctctcagcctatgccaattctctctcccagtctgaaaactcagacctgttctatgccgtgccctggtcctgtgggaccctgggcttcctggtggctgccgagatccggatcatcccggccaagaagtatgtcaagctgcggtttgagcctgttcggggcctggaggccatctgtgaaaaattcacccgcgagtcccagcggctggagaaccacttcgtggaagggttgctgtactccctggatgaggctgtcatcatgacaggggtcatgacggacgacgtagagcccagcaagctgaatagcattggcagttactacaagccctggttcttcaagcatgtggagaactacctgaagacaaaccgggagggcctcgaatacattcccctgagacactactaccaccgacacacgcgcagcatcttctgggagctccaggacatcatccctttcggcaacaaccccatcttccgctacctcttcggctggatggtgcctcccaagatctccctcctgaagctgacccagggcgagacgctacgcaagctgtacgagcagcaccacgtggtgcaggacatgctggtgcccatgaagtgcatgtcacaggccctgcataccttccaaaatgacatccacgtctaccccatctggctgtgcccattcatcctgcccagccagccaggactagtgcatcccaagggagatgaagcagagctctacgtggacatcggggcatacggggagccacgtgtgaagcacttcgaggccaggttccaaatgttatacgccgattgctatatgaaccgcgaggaattctgggagatgttcgatggctccttgtaccacaagctgcgcaagcagctgggctgccaggacgccttccctgaggtgtacgacaagatctgcaaggcggcaaggcactgagcagggcacctggggagccagctgcatggacctgctctccctcgctcgctccggcttctctgctttcccaggtctcagaaaagaaacccctccacatccccgaggcagcccgatggcttccagggtggctcgggcaagtggaagcacgtggagtcagacagacctaagtcccaggcccagattagccactcgttagctgtgtgactgactctgggctagtcacctggcccctgtgtgccccgtgttcatctgtgaaaggaggtaaaaaaaaaaaaatatctacctgctggatgtcaccccacactaagggcttccaccactgcttccatgcaacctcacgcctggctcctgctttggatctaacagctgagtccagacaggctccccacaggtcacccttgcacgggtttggccaacaccatgaaggagttgccttggagtttcacctgcatagcttgcatcagccccgagagggcaaaggagggtcagccttccacttggcctcgggggtggggcagggggcatctgattggcaggcaggcccaggatgtgctgtgccaaagccaggtctactccaaagtcctctctgccatcttcggaccatcctggccctacttctgtgtgctcgagctgccccagccatcactgagcccactcaggactgctcctggaagacatctcaaggtgggaagcctggctttcctgggctttgctttcttaactcccaccatccaggcctcctctagagtccactgagtcacaatgggggcacatgctcatgactgtgtcacttaggggcggtccccacactgagtgagaaaggggcatctgccctgttgctactgtgaggaccctccctggggttagaaagaaagcatccagggtcactcatctccc

SEQ ID NO: 1257 - protein, 542 aa, Mus musculus
AGAEPAERGAGEGDGRREPAPFRAVRRDTMEPAVSLAVCALLFLLWVRVKGLEFVLIHQRWVFVCLFLLPLSLIFDIYYYVRAWVVFKLSSAPRLHEQRVRDIQKQVREWKEQGSKTFMCTGRPGWLTVSLRVGKYKKTHKNIMINLMDILEVDTKKQIVRVEPLVSMGQVTALLNSIGWTLPVLPELDDLTVGGLIMGTGIESSSHKYGLFQHICTAYELILADGSFVRCTPVKLSAYANSLSQSENSDLFYAVPWSCGTLGFLVAAEIRIIPAKKYVKLRFEPVRGLEAICEKFTRESQRLENHFVEGLLYSLDEAVIMTGVMTDDVEPSKLNSIGSYYKPWFFKHVENYLKTNREGLEYIPLRHYYHRHTRSIFWELQDIIPFGNNPIFRYLFGWMVPPKISLLKLTQGETLRKLYEQHHVVQDMLVPMKCMSQALHTFQNDIHVYPIWLCPFILPSQPGLVHPKGDEAELYVDIGAYGEPRVKHFEARFQMLYADCYMNREEFWEMFDGSLYHKLRKQLGCQDAFPEVYDKICKAARH

SEQ ID NO: 1258 - DNA, 57564 bp, Homo sapiens
ttgctcggtctactgattcaaatgctagttctcttctgctttatcggcgatctgggtattccctaacccagtcaagttgacactaaaattaatcatcacagtgcctgacaaataagacatgctcaataaatatgacctgttaccactactgtgattggcattgctttttctgcatacacatcttacctactaaattaagatccatgggacagaagtcctgctgaatatactcatatttcctctcaatctatgcctagcagtgctagacacataatagtcacttgatgaacatttatggaaaggattattgcctatcttataccattatgacatgtatgtgatatgcccagcatttttagtgaaggttgtatttttcgtacagtttgttagtgcttcatactgcctgctttatagctagctgttttcatatcttccccattggtccatgactgtccttttggcaaggactgagtctctgtcatttaagacccagctcagtttattatctgtcattgaaactgcatatacagaaaagtatttacatgaaattaatggtacttcagcttcagagctactcacttgatagatcatctcctgaagccctggttaatgagtatactcaattcagaaagcagagattgttcactacatgagaaaatttgaaatgctttgaaaccttacagctcataattaaaagaaacttaatagctggacgcggtggctcacgcctgtaatcccaatacatcgggaggccgagacaggcagatcacctgaggtcaggagttcaagaccagcctggccaacaagtgaaactccatctctactaaaaatacagaaattaaccaggcgtgatggcaggcacctgtaatcccatctactcgggaggctgaagcaggagaatcgcttgaacccgggaggcagaggttgcagtgaaccaagatcttgccactgcactccagcctgagtgacagagtgagacttcatctcaaaaaaaaaaaaaaaaaagaaacttaatagagcctttaccaaatttgacaacaatcaaagtgtattatagtattaacaatagctatttatatacctaaaactgttccaaactatcaataataaaaaaataaattttaatcaaccatgttggaaggtctggattatcattttattctctctatataaaatgcaaaaaaattgttgtcacatgaagaaatgataaaagagaatgtagccccaaaatgtaggggggaaaagtattagagaagtgtatctggcagtttaattaaaatataacattattttactagattttgtgatatgtgtgatttaattcacttttttttctttttcttttttttttgagatggagtctcgctttgtctcccaggctggagtgcagtggctcaatctcagctcactgcaagctccacctcctgggttcacgccattcttctgcctcggcctcccaagtagctgggactacaggcgcccaccaccacgcctggctaattttttgtactttttagtagagacagggtttcacggtgttagccaggatggtctcgatctcctgacctcatgatccacccgcctcggcctcccaaagtgctgggattacaggcatgagctactgtgaccgggccttcacttttttttttttttgagatggagtctcgctctgtcatccagactggagtgcctgtccaaggatcacattctgagccgtcaggccctggacttcatgaagtccttgctttaccagtctatgtttctctactgtgtaacttgagaagaatttcactggtgatttctcgttctgtctgtcttccccttacaccggtggttctcaaccagggaagagtttacctcctaggggacatgtggcaatgtctggaggcatttctggttgtcacaactcggtggagggtgctagtggcatctagctactactaaacaatctgcaatacctaagacatccccacagcaataattatctgaccaaaaatgtcaataatattgaggttgacaagccttgcttcatgagggttgggcatagaacatctcatttcggccaggtgcgatggctcatgcctgtaatcccagcactttgggaggctgaggcgggcagatcacgaggtcaggagatcaagaccatcctggccaacatggtgaaacccagtctctactaaaaaaaatacaaaaattagctgggtgtggtggtgtgcacctgtaatcccagctactcaggaggctgaggcagaagaatggcttgaacccgggaggcagagatccagcctggcaacagagcaagactctgtctcaaaaaaaaaagaacatctcattttctgttttatgtccagcgtctggcagcatgcctggcttatagtaaagcatagccacaggtccctaagcatgctgtcctccattctccatcccaattgtaaaaatttccatgttctatacctttccatccatgatggcagctggaagttatgaaataaacccctgatatcataaagttccacccagaagaaaattaaaaccaataaataacaggggatacaagctaatacgaaggaacattatgactactctgaagatgtttaatactcaatgatttactgattgctttcttaaatgaatgagtgttgactcaagaacattggtcagaaagtttgtcactgacctgaccacaaagaaggttgtagtcacaaaggaacagcaagaactgctcttgagaatgatcataaagggtgaaaacactctggcctgccacagcaccaaggatagaaatggtaatgacactgatttctgctgactgcctttggatcactatgactggtcagtctgggacattcacttgtttttcttatctagaaagccctgagaactaaacattttggcaatctggaaaaggagactggtggatgaatttcctccatggtgggctggtcttaagcaaactccttttatgtgtgatatgggagatactgaaaggccagatggagcaaccagctaagtatctaaaattcctaccatttaaacaacaaagagatcattgttttataattcatttataattgtctgttgatttatcatggtgatataaaggtggagacattgggggccgggcgtggtggctcacgcctgtaatcccagcactttgggaggccgaggtgggtggatcatgaggtctggagatcaagaccatcctggctaacacggtgaaaccctatctctactaaaaatacaaaaaaattagctgggtgtgatggcgggtgcctgtagtcccagctactcgggaggctgaggcaggagaatggcttaaacccaggaggcagagcttgcagtgagccgagatcgagccactgcactccagcctgggcaacagagcgagactccatctcaaaaaaaaaaaaaaaaaaaaaaaggtggagacattgttattcttatatcctgtgggtagcatgtttagagagtgattttgcaataggttgtgttgtttgtttttttgtagagatggggtcttgctatgttgcccaggctggtctcaaaacatgagctcaagctatcctcctacctcagcctcccaaaatgctgggattataggtgtgagccatcatgcctggcttaggttttaaaatataaatttattttaagaaaattttataagttttgtaacagttgtcagcatcaaaatggagtcactaatgtcaagaaaaccctgataaatagagctgggaaggccgtgaaaagagggttatcatgtatgcccgataacagaaaaagactacgaaaaccacaaccttggactaaaggccatcacaagcttacataaaaaatgcttctgcaaggacatctgcccagaaacttcctgtgtactctcggtaaggcataacccttgttacttatctttgcagccaaggataattatttcaaaacaattgtgtaatcctccttattttttcctttaaaaatctttgtcttcctttacctccctgaaaatgtacatagcttagcatggcacatgtattcccatcacaatgttttattcccaaatatatttcttttagagagcctctcgttgttatttaggttgacagtttgaaaatgtgaataataagggaaattcactgaaactttgctcatcataacaaaagtttaaaaacacttaaatgtctttcaataatagactttttgaataaattaagctacacacatataggtgtgcacacacctaaacacatacacctgaatacacacattggaatacaaagaaaccatatgtctattgtatattgttaagttttttaaaaacaaattgtaaagctcctgtagagttgctcttattttattaaatactatacatacgtgtatatgggcctagagatatgtctaaaaggaatgtcatgaaaatgtgaacttcagtcatctgcatgatggaatgagtcaatttttagtttcctctctgtacttccctgtatagtttgaattgtttagaaaagcatatgccatgtttacagaagcaatacaatgatttttacataaaatataatgttatagctgttattaatctcctttcaagaaaatattattgcttcaaagacagccatgctaataagggctaatttgtcagattgattcattgacatcttgggaagaagacatcagcaacccaaagggaaaggatacaggagacgtactctgtggctttgctatgcataccctgaagatgtccagctatcatttcttttcaccagaccagatgacctctaattcatcttccctcccactctaaccccaagactgattctaaacctacattctctgccatgctggtaaacatccttgtcatccaagcaaaatgcccggaaatcatctttgactccttttcttttttcctaccttctccttcaatctgtctccaactattcatctactttccatttctactgatactgccttagctttgtaacctcatcagttctcacctggatttttgtcggcatcctacctggcctcactcctgctcaccactgatttgtctcccttcctgcagtcagagcaattatcctaaatattgtgagaatggtggcactctctcttcaaaaatctcccagtagttctctattgtttgtactgtacaggataaactttcagttcccctaaatatcacatccactcacctgcttctgagctttttgggcatggcatccctcttctggaatgctcttattccttagacccaatacttcacctggctaacttccacttatcctgtggtatctctgcttagtcatcacttcctctcagaagcccttcgggactgcatatatctatctacctatcaatggattgattgatagatagatatcttcatgtgcttccataatacccttatcatagtacttatgatgttgatttataattaattcttgattgcctagatccacacatgatctgtcaggaaaagaattgtgtctaattcactactgtgtccccagcattttgcacaattcccgcacatttaaaatcattgaatgaatgtgctgcagaaatggttaatttccatctgaaattggttccccttattttgctagatgttgctgtatatgatgtagcacctggaacatggctgctctgccctcatcaggggagttaacctgagaagacagagtaggcaaaagataaaaagaactgggtctttcaaattgtcactgaaccaatgaattaaccaactcttggtcaatctgcattcggacttcttttttgttttggacagggtcagtctatcacccaggctggagtacagtggtgctatccatagatcactgcagcctcaaccttccggattcaaacgattctcctgcctcagcctcccaagtagctgggattataggtatgcaccaccatgccaggctaatttttggattttcagtagagacggggtttcaccatgttggccaggctggtctcgaactcctgacctcaagtgacccacctcccccaggcctcccaaagtgctgggattacaggcatgagccaccaaccttggcctgttagggctttactttaaaacaaagaaaacaaaggtaatactatatatatatatttttttcttttttcttttttgagacagagtcttgctctgctgcccaggctggagtgcagtggcatgatctcagctcattgcaagctctgcctcctgggttcacgccattctcctgtctcagcctcctgagtagctgggactacaggcacccgccaccacacccagctaattttttgtatttttagtagagatggggtttcaccacattagccaggatggtcttgatctcctgaccttgtgatcttcccgcctcagcctcccaaagtgctgggattacaggcgtgagccaccgcacctggccaaacaaaggtaatattcttaaagaagttccaggattaatactcagtccaatctcctaaattttagcatgcataagaataacgtagctgacttcttaaaaagtagatttctggccccacttctggagatttagcttcagtgggatatggtagagtctaggactctgcattttagcaagcattctgatgtagttggtctacaaaccacacttcaacaaaccctgttctaaaacttctacttcatatctatggaacggaaccacatgaatggctcccaacttctggatctttccatcatttgaatctgctcccttgattattgtgtgaagtgtagtttgcagaccaactgcattagaattctctattcaccagaataagacattgatcaggtaagtcacttaacctgagtctaaatgtccccatttatttaaaaaaaaatacatattaattccctgcattgccactcctgagactggttgcaaagatcaaatgatctcagtagctgcactgtacaaatataagaaaatgcaatttgttaggactctggtatttatcatgctcctttactgaagaaaaaaaaaactgttctttacactctatttattaagaaagaaatagaggctcacattgtagaaagattgctacgtggtcaaactataaaaggggtttacctagttaacctgaaaagttcttgcccagaacatcctattcctaagcattctgactgtctgcatgctccatcaactctgtaagtaatgtataatatgaatagattccctgacaaaggaagctgctttgactccagcaaaaattagtaggtccaaggttatatatcatatgattccattcatatgaccttctggaaaaaaaacaaaactatagtgacagaacagggcaatgattgccaggggctaggaggtaggggagagtatgactacaaaggggcagcagagggagttttttggggtggtggaactattctgtatcctcattgtggtagtagttacaggaatcctcatcatgctaaaattcatcagctgtacaaagattaagcagttttactatatgttaacttaaaaaattaattaattgattggctcaactcaagtgactgctttccttacctggataaaagcaacccaaaggattagagtttggggagacagaaaagaagaatcagaaatatgaggagggtaggcaggaagagagaatgagaaacgtgcacactgaataaacaattgttctgagtactttttcacttttttgttgttgagacagcctgttgctaacactagtatgcagtggcgtgatcatggctcactgcagccttgacctcccaggctcaagtgatcggtcctcccacctcaacctcctgagtagctgagactacaagtgcatgccacaatgcccagcttttttttttattcttttttttttttttttagagacagggtcttgctatgttgcccaggcttgtcttgaattcttgggctcaagcaatctgcccctcttggcctctcaaagtgctgagattacaggcatgaaccaccacacccagcctgagtacttttttattcctttccttttttgggagttgtttcctaaagatcagttgtatctactttctgggactccatccttctcttcccaagtataaaactattctgattaaccagtaatttccactgtttctcctacacaacactcttcagttaatttttaggtaaattttactttccagattacctcacacccccaaaataatcagaatggttaagcttctaaagcaaagccctctttaacagagtcagacagaatcggggagaggcatttttcacattggctttcctcttcatacttcactgtccccctgttggttggagcttctagagatgtaatacaagacaaatctgtaattttaaattttctagtagccaccttaaaaaagtaaataaaacaggtgaaattaattctaatactatattttacttaatatatcaaaatgttatttcaacatgtcattaacataaaaattactaatgagctattttgcattttttctttgtactaagtctttgaaatccagtgtgtgttttactcttaaagggcatttcagtttggactagccacataccagtagctcatagctgttgtgtaagacagtacaggtccaggctatttatttttgaagtccagtgcaaacaacctctcattctttgcactttgataacttgaatatttgagcctacaatcttcattcattcattggtcaacagccgctggagtgtttactgtgcacaaagcaccgtgctagaagctggaaggacaaaagtgaacaagacattgtttgccctaaggctcagtctgtgggggtgagagacacataaagagacaattataaaataacatgaaagaacggtgacagagatgcacactatttaatgagcatctggatgggcaggggagtgctctaaatgtttcagaggtggccctgagctggcttcggaatgtgtgaggtgaactctgagaaggggatgggaaagggcattcagaggtactagcttgaccagaggcgcgcaaatgaggaatgctgaggcccagggagcctcctgagtgcatgtcagggcagagatgaatggagagggaactggataggtatgcaaggccagacagagaagaacctggtatgtcatgtttagcttctaaactaaaacatctcgaaaacttcctaaaattccatatgaaatgcaaatggcgctggatttcagcttttgctggtaaccgtggcagctcccctacactggttgctgagtgagggcagggccatctgctttgctcaccaccctacccgaggcttgcaacactgcctggcacagagcgggcctggggagtttactcgggctgaaatgccttccttcattctttctcctccgggcctcccatctgcctcagtgaactggaaaaagaggaagagtgccagccatagccttccatgcttccaatggcctctggagttcacgaacaggtcttcacctttctgggctgcttccaagtgtacacaatggagctcaccactccccactgcccaggactgctgtgtagctcaaatgaattcgtggaaagtgccccctaaaaatgaaaagatgcctctggagaccttgcgcacaccgagtggcacgacctgcagaggttaccgccaggtttccatcctccgcgcccgggaaccgcctgtccggccaaagggtgactgactcagggccggggcgcctcccagccctccggcggaaagccactgcaaaaccgcttaaggcgcgtttggaagaggcggccccgcagccccgagggcctggggccctgagtcccaactgcccacccccagtattcgcagcggaccccaccggcacccagtccctggcacccccgcctcgcgcggcggcggggagaaaagggtggagcggtccgactcccgcagccaatgaaagctgcgggttcctggtccgatccccggcgcggctcgccattggtcgccgcccgggtctcggcccaccgaacctcggcgacccgagccaatcgcgaggcggcgggcgatcccgggctccccgggctgtgggctacaggcgcagagcgggccaggcgcggagctggcggcagtgacaggaggcgcgaacccgcagcgcttaccgcgcggcgccgcaccatggagcccgccgtgtcgctggccgtgtgcgcgctgctcttcctgctgtgggtgcgcctgaaggggctggagttcgtgctcatccaccagcgctgggtgttcgtgtgcctcttcctcctgccgctctcgcttatcttcgatatctactactacgtgcgcgcctgggtggtgttcaagctcagcagcgctccgcgcctgcacgagcagcgcgtgcgggacatccagaagcaggtgagcggcgccgggtgcggccgggactcagggccggaggcggcgtgcgcggggatagcgggacgcgaggtggcgacgggagctgcggtgcgggggcggccaggacttcctgggggggtggggagctggcgttggagaggggttggaacgaaacaaaaatgtgatgggggcgggggaacagaacaggcaaagtgcccactgtgtgcagggcatatgcgggtacctggagggagatgaagaaggggaagagggggaggtgcgaagcactcaggtaactctcacccggcccaagcatttcagagaaggaaaggcttccgggaggtggagctgggtctagagattgggaagtatgggaaatgattgggggaaggtgtgtgggtggagggactggtgtgagcaaatgctgggaagccgacaagtgcagggcaggggcgggagaacgtcggaaaagtccgtttggtgctaggctggagaggggccttgatgccaaggccgagtttggactttattttgtacagcaagacgcttttgattgggtttaggatagaagactaaagcaagaaggtagaacccagcccagaagcgggagggaagaacctcacagcctctgctgacggagggctcactccttgacaaaggcagtcggtccatctctcagttcctcaggcacccacggagcctgtgacctgctgtggctcacagtggagcctcctctgcatccagggacttgggcagtttcttgactccctctgcttctctttatgttcctctcttgttggcatcaggttgcagagagcttctgtttcctgctgccacccttccgtaggtgtagcagcctccatattctgcttgctccgcgctgggtgcttcaggcaagagcatgaagatggatgcggagagacgttcccatgaggcataagacctggggcctggtgggagaacgcagtgtctggaagtgctttgccctgtagctctggattttgctggtcacagtcatggctccagagcctctgcgtgtcctccctccccacctgcaccctgtttcctagctcttttctcgagttcaaattctccatttacctgcttgtctcccctgtcagactgtgagctcctagaatgcagggactgttatgtgactcgcctgtggcccatagggcctggctcaaaacagcctagcgagtgcctattaatcttggctaagccacaagattcactgtgagcaggaaaacaggggcccagctggactagcctctaccccagacctgccatgtgccattgccatcctcacagcaaccctggtagatcttgtgcctatcttacaaacagggaaaattgagtttcagagtgtgagtcatgtgctcaggaagactagtcagtaaatggggctagaacctaggttagctcgatttcagagcctgaactctgacatttcttctttcccaggctttcccttcccccctataggtctggttcagttgcctcacacctggcttgtaatagctgtctgacctagttgcccttttttctgggctctctgtttggcctccagcttcagtgcagcacccctaatcactccctcccatctctgggcttgtgtcaaactccgtggctgcagattcaggcagggacgagacctggttggtcgtggaatcctacctatcatcccttttcccccaaatcacaggaatctcttccttaatacctgccctggcctctgatcaaagaaaagtccttccccgtgttgagctgtttgcctagccagctccagtgcagccttctccaggagacctgaccagtatttgaccagacttttggttgcaagtgaaagaagctcaattcaaactgacttgagcaaaaagggattttattggctcaggtcctgaaaagtctgggagtacaactggatcaggcatggctggatccaggatcctctgtcccccatctccatctgtccatccctctgccatctgttggccctgcttttctaggttgacttcattctctggagcctctctccctgcagaggccccaacagtttctggctcatatccaaccggcttagcgaccccagtaaagagagagtggctgtcctggaactggtctcattggcttgacttaatgagatgtcattaatctgtctctggccagaagtatagaatcagtcctcagtcatgtacccacctcctggggtaggggagtagaatcagtctcacttggaccaaaggaagatggggattgttagaagtggatgaagaggaaatggatggtcacaggtcaaaatgacaaatatccaccccccctgcacttgtctatctcagcagaaaagaaacacttcctcctgcatttctgatgggcttgtcatccatgggccatttgttctgtgttttgtgctctggtcacttaccttagaggttttgtaaaacctcttccttccattggcttggtggtccttccctgctcctcctcttcccctcaaagtgatgcatgagttaacatatacaaatgtttaaacaggccttggcatgtgataagcctccacacgtgttagctattaccctgtgaactgttaccacaactccatctatctttcctgtcctgaagtcaaacagtcctggctatgaatctcagctctgccatttaccaattgtgtgactttggacaagttattttgcttttgagtttccttatcctcaaaaaaagggtgtcatcgtaacttcctgggactgttgtaggaattacacaagacagtgtgcagtagatgcctagtgtgttgggaatacccagtaaatggtcctcatttttatacttgctattatcaccattacaaaaccttttctgaacttcccagctagagttaatgttttcagaacacttcgatcctctcttctagctctttcatcattctgccttgtggtgtagcaatatgttggcttttctgtcagccttgctggccagggaggtgccagagggtagggccagcaggccttttcattgttctgtttctccagtgcctgatggaggcatcattcccagctcgcccttgaagaaagcagggctgcaggctgctctggggattcccagtggggccagctcaccctctgtcctgtggttgcaggtgcgggaatggaaggagcagggtagcaagaccttcatgtgcacggggcgccctggctggctcactgtctcactacgtgtcgggaagtacaagaagacacacaaaaacatcatgatcaacctgatggacattctggaagtggacaccaagaaacaggtgagagtagcacttttccgggctctgggagcaggtggggcactgcccctggtgcaagtgactcatagggagatgattttagccaagggcattgcagagtggacaggaccaatgcccacagtcatagaagatactccctgccattgctgtcctcaagcctcacagccaccaggggagagatgggtcataataggtcaggggaaccctttgcgtttccacaggaagtcaggaatggggaattcgtgagcaaaaatgagaggcaaaaaggaatctacttaccccttcctgataaggaagtgtgctggtaaaaaatgggctacagaagtgactgagagacatgggtcttgttacaagcttcctggaaaccctcttgtttaatagccttcgaaatgtacatactttttggcccatctagtaattttacttctcgaaacctggcttaaggaaaaaggaaataggcttcagtataaagatacccaacacagagtgattatatcacagctttatttctaattgacaacaacacaatatccaataatagggtagtcattaaatatggtatgtctacttgatggcattttgttattattgtgagaccttggccaagttacttaatctctctgtgccattttttttaatagctttattgacgtatttaaagtgtggtaaaactcttaccacaatcaagacaacaaacatacccatcacaccccaaaatctcctcatgctccttggtaatcccttcctctagcccctagccctgcctcttcccctacccgccccccacagccttaggcaaacaatgacctttctgccactataaattagtttgattctagagtttatataaatggaatcatacagtactttttgtttgtctagcctctttcactcaacatctttatttggagattcatccatgttgaaaggtgtgtcaatagttcattctctttcactgctgagtcatattcccacacatattgtgtggatgtatcacagctggtttatccattcacctactgatggacattttggctggctccagtttggggcaattacaaataaaatggaacatttgtgaacagtctttgtatgggcatatgccttcctttctcttgggcaaatatctaggaatggaatggctagatcataaggtgggtgtacatttaactttttaaggaagtgccaaattttttttccaagtgattgtagcattttacatttccaccagcagcgtgagtgttgttcttgttccacattgtaatagacttgatatggttagtcttaattttagccattctaatagatgtgtagtagtttttcattgtaattttaattcacatttccctagtgactaatgatctttccatgtgcatgtttgctatttgtatatcttctttggtgaggcctgatcaaatcttttgccaatttaaaaaaattcaggtggttttcttatatattctggaaacatcttttttttttttttaaacttttaaattaagtggtacctgtacaggtttgttatataggtaaacgtgtgtcatggggtttgttgtacatattatttcatcacccaggtattaagcctagtacctattagttatttttcctgatcctctcccttctccctccctccaccctctgataggacccagtgtctgttgttcccctgtatgtgtccatgtgttctcatcatttagctcccacttataagtgagaacatgcggtatttggtttcctgttcctgcattagtttgctaaggataatggcttccagctgcatccatgttcttgcaaaggaacatggctgcatagtattccatggtgtatacgtaccacattttctttatccagtctaccactgatgggcatttaagttgattccatgtctttgctattgtgagttgtgctgcagtaaacatacacatgcatgtgtctttatgatacaatggtttatattcctttgggtatatatacccagtaatgagattgctgggtcaaatgctgcttctgttttttggtctttaaggaatcaccacactgtctcccacacggttgaactaatttacactcccaccaacagtgtataaatgttcctttttctctgcaacttcaccagcatctgttattttttgactttttaataatagccattctgactgtgtcagatggtatttcattgtggttttgatttgcatttctttaattatcagtaatgttgagctttttttcatatgcttcttggccacatgcttgtcttttgaaaagtgtctgttcatgtcctttttatattcactttttaatgggggttgttttgttcttgtaagtttgtttaagttccttattgatgctggatattagaccctgaaacaacatcctttattagattcatgatttgcaaatattttctcacagtctgtggcttctcttttgaaaaccagaagctttatttagtttttctttttgagacagagtttcactctgtcgccctggctagagtgcagtggcacgatcttggttcactgcagcctccgcctcccaggttccggtgattctcctgcctcagcctcctgggtagctgggagtacaggcatgtgccaccacacccagctaattttttgtatttttagtagagacggggtttcaccatgttggccaggctggtctcaaactcttgacctcaggtgatctgcctgccttggcctcccaaagtgctagaattacaggcgtgagccaccacgcctggccaaatcagaagttttaatttttcccaatttgttaatttcttcttttatgcattgtgggggttttgtttgtttgtttgtttgtttgtttatatttttgttttttgagacagagtctagctctgtggccccggctggagtgcagtggtgctatctcagttctcggcaacctccatctcccggtttcaagcaattcttgtgcctcagcctcccaagtagctgggattacaggtgcacaccaccacacctggttaatttttgtatttttaatagagagggggtttcaccacattggtcaggctggtttcgaactcctggcctcaaatgatccacctaccttggcctcccaaagtgccgggattacaggcgtgagccaccgcgcttggcctactttgcattttgatattttatttaggaaatctttgcctatccaatgtcagaaaggctttctcctatattttattgtagaatttttatagaaaccttaaagtgaagctctctgggcctggagttttctttgtaaggaagtttttaagcacaaattcaatttctttaataggtactgggctcttcagtttatttatttcttcttgggttagctttggtagtttgtgtctcaaaggtatttgtccatttcactaagttgtataatttattgacataaagttgttcacaatacttcctttagatatctgtagctatgtcaagtctttcgttcttgatactggtattttgtttctgttctctttttttcctgaacagtctggctaaaggctattgaattttattgatcttctcaaaagctagctttgatatcattgatttttccctttgtgtgtgtgtgttgttttcaatttcattgatttctgctttggtctttattatttcatttcttttcttacattgggtttaattttactctttttccagttttttaaggttaaagtttaagtcattgacttagaccttttttttctaatataaatgtttagtgctataaattttcccctaagcactgttttagaggcagctcacaaatttctatatgttttctttttatttcagttcagaatactttgatttcccttttgatgtctgctttgacccatggattatttagaagtatgttgattttttatcactagttttgagcaattttattatgatgtgctttggtatagttttattcataattcttgtttggaatttggcataatttttcatcaaatcaggaaatttgggggccattatttcttcatctgtttttctgtcccctcctttttctcatctagtttagagacagctaggccatttcaagttgttctacagctcaggtcattgaggcactgttcatttaaaagaaatttttttcctctctttcattttggatggtttctgttgctgtgtatttaagttaactaatcttttcttctgcgatttctaatttgctattagtgccatccattgtatctttcatttcagacattgtggttttcatttccagaagtttgatttggattttttttttttttttttttttcccagatggagtcttgctctgtcctccaggttggactgggtgcagtggcgtgatttcggctcactgcaacctccacctcctgggttccagcgattctcctgtcacagcctcccgagtagctgggattacagatgcgcaccaccgcgcctggctaatttttttgtatttttagtagacggagtttcgccatgttggctaggctggtttcaactcctgatctcaggtgatccgcctggcttggcctcccaaagcactgggattacaggtgtgaggcattgcacctggccggatctttttaatatattcttaatgtctctagttaaattttcgaatatagagaatatagttattataaatgttttgatgtccctgttcactaattctaatatctatgtcagttctgggtctgtttgattgattgatttttctcattatgggttgaatttttctgcctctgtatgcctggtaaaattctattggattctgacattgtgatactctgacattttaccttttggggagctgggtatttttatgttcctataaattttgagttttgctctaggaggcagctaagttacttggaaatagtttgatcccactgggtctcaattttttagatggggccagggaagtatttaatcttgagtttattatgaggcaagatcattttgagtactctacacagtgccctgtgaatcatcaagttttctagtctggcttgtgggaacagacactatctcctgccctgtgtgagtccctggtactattacctattatctttttttttttttttttttttttttttgagacagagtttcactcttgttgcccaggctggagtacagtggtgcaatctcgggtcactgcaacctccgcctcccggattcaagtgattctcctgcctcagcttcctgagtagctgggattacaggcacccaccaccacgcccagctaattttttgtatttttttttttagcagaggcggggtttcatcatgttggccaggctggtctcaaactcctgacctcaggtggtccacctgccttggcctcccaaagtgctgggattataggcatgagccaccatgcctagcctattacctgttgtcttttctggcagttttttccctggcttcagcctcaggtaatagcctcatgtgtatttaccgattagtactcagttgaattcccaaggacgccttttgcatttcttcagttttttctctgtgcaactctctcctctccagtactctgtcctgcacactgtattcaccttggtcttctggaactctcacctcttttttttttttttttgagacagagtctcgccctgtcatccaggctggagtgcagtggtacagtcttggctcactgcaacctccatgggttcaagtgattctcttgcctcagcctcctgagtaagtgggattacaggcgcttgccaccacacccagctaattttttgtatttttagcagagggaggtttttgccatgttgtcgggctggtcttgaactcctgacctcaggtgatccacccacctcggtctcccaaagtgctgagattacaggcgtgagccaccatgcccagcctcacctccatctttttaactcttagaaagtccactggactccaccacctgggtttccctccctgcactgcctaactccaggcagttaaatgggccatccctagagctcacctttttttaaaataattttttatttttttatttttaggtcttgctatgttgtcctggctggtctcgaacccctggcctcaagcaatcctcccgcctcagagctcaccttgtttcctgtctctgagggatcactaactttaattgtttatgtccactgcattgaaaactcttatttcatatattttgtcaggtttttttttcaggcagcagggtaaatgtggttcctgttattccacttcggctagaagtagaagtccaagggatgtatacattaaaaatcatgtgttccaagaatgtgtaatgataagagatgatggtcatagtatagtgttaaattttaaaaaggcaaaacagaaaatgagatatgcttttggtttgtgtgtgttgtgtttaaaacatacaaaatagtgtgaaaggaaaatcttggggcccccaaattactaaactaagggaaaagtcaagctgggaactgctcaggacaaacctgcttccgcattctattcaaagtcatccctctgctcactgagatagatgcatattctgattagctcctttggaaaggcttatcagaaactgaaaagaatgcagccatttgtctcttatctacctgtgaccgcaagccctctccctgcttcaagttgtccccgccttcctggacagaaccactatacttcttacatatattgattgatgtgttctgtctccctaaaatgtgtaagatcaagctgtgcaccagcctccttgggcacatgttgtcaggacgtactgaggctgtatcagaggcgcacatcctcaatcttggcaaaataaactttctggattaactgagacctgtctctgatatttgcggttcacagtaccaatacagtatgtgtggggaaaaaaaaaccaaagtaaatacactgtgttattaacattagtaattctgaagaactaggaagggtgaattttttttttgtttgtttgagacggagtctcactctgttgcctaggctggagtgcagtggcacgatctcggctcactgcaacctccacctcccaggttcaagtgattctcctgcctcagcctcccaagcagctgggactacaggtgcccgccaccacgcctggctaatttttgtatttttagtagaaacagggtttcaccaagttggccaggctggtctcaaactcctgaactcagatgattcacctgccttggcctcccaaagtgctgggattacagacatgagtcaccacaaccagccaggatgggtgatttttgttttcttcttcacttttgctgtatcttctaagtgaatgagtatttctcctgtaatttagaaaaggttaagtcaaatatttagtataaagatacttgaagggcgaggttgaacactagctaaccgagagccagaaatcacattccctgtaattaaaggcaatgttctagaaagagcctgtaaaggctatataggaatccctgcagtgagtgtttgggaaggtttgagatgacaccttctgtgtgcagcagctccccttgggcctggcagcctccttttgacccagggtctcttttcttgtgtcaacagattgtccgtgtggagcccttggtgaccatgggccaggtgactgccctgctgacctccattggctggactctccccgtgttgcctgagcttgatgacctcacagtgggtgaggaccctatattaacgggcaagaagagacacacggtcctaggaccggagctgatgggccttggccaccctccatctagtcctggaattgccgctattccatctgtgacagaagtcattcagtctcttacttgcctgctccaatgacagggtgttcactgcctgctgttccatttctgagcagctcaagttatcagaaggcacttttaatttctggtttgaatctgcttccctgtgacttgttcccattgctccaattccaccccatggaacacacagaataagtatagtctctcttctcctcccataggattcatagcccccaaagcctcttcttcttcagggaaaacaccttcagttcttttaactattcccatgggacagggcttcctgtcaccccttcaaccccccttttcattaaagtccctctcaagatgaatgcacacagatttctaggttgagtctggccagaggtgaggtgtgagtacacttgacaaggtctgctcgccactcccttcctctaaggacaccctcatgctcccatctgagcccctccttccctctcctgctctctagattgacaggtgggaaatctcccctaagtcaacagccccatttctgctagcctgccaaacctccctcatgctaggaggccccccagctccaacccacccccaaccctgtacccacagctctccctgctgacactgtgtgtgatgtctctgcagggggcttgatcatgggcacaggcatcgagtcatcatcccacaagtacggcctgttccaacacatctgcactgcttacgagctggtcctggctgatggcagctttgtgcgatgcactccggtgagttcagcaatgggagatgtccatgccagcctgctctgggcattaaggatcctgaggtcagggaggtggctcctctaggtgtgcttcattcccagtacctgttcagtctgggtctatatctgtaaacaaaaatttgtgtagccccttatatgagcttaggcaatgttgtaaatccattatatatattaaggcatgcatgttatccttcaacaacctaatgagggaggtttattatccctattttatagattattattaaataatagaaggattattatccctattttatagataggaaactaaagctcagagagattatttgccataggtcacacagctgggactcacaccccagtaatcaggctcccaggtcccttagccgttcattatgccatcctgcctctctggagaggaagtcaggccttggcatcaaagctgtgtgtcttaacactgtgaggtacagtcatgtgtcacagaacagtagggatatgttataagaaacaagttgtaggcaattttgtcattgtgcaaacatcataagagtgtaattacataaacctagatgagatagcctacttcacacgtaggctatttggatagcctactactccttgactacagacctatacagcatggtactgtgctcaatactgtaggcagctgtaacacaatggtatttatgtatctaaacatacctatacttggaaaaggtacagtaaaaatacagtataaaagatgaatggtacacctatgtagcgtacttaccatgcatggagcttgcaggactggaagttgctctgggtgagtcagtgagtgagtggtgagtgaatgtgaagtcctgggacattactgtacaccactgtagactttataaacactgtacacttaggctacactaaatttattttttgaaattttctttcttcaataataaatactgttagcttactataacatttttactttataaactttttaaaaacttttgactcttgtaataacacttagcttaaaatgcaaacacattgtacaggtgtacagaaatagtttccttctttatatccttattctataagcttgtttctatttaaactttttttttaacttgttaaagtttttttgttaaaaacttagacacaaggctgggtgcagtggctcactcctgtaataccagcactttgggaggccaaggcaggtggactgcttgagcttagcagtttgagaccagcctgggcaacatggcctacaacatggtctacaaacaatacaaaaattagctgggcatggtgatgtgttcctgtatttccagctactgtggaggctgaagcaggaggatcacttgagcctgggaggcagagattgcagtgagccgtgattacgccactgcactctagcctgggtgacagagcgagaccctgtctcaaagaaaaaaggtcaagacataaacgcatgttagtttaggcctacacagagtcaagattatcaataacgcttccacttccgcatcttgtcccactggaaagtcttcaggggcaataacacacatggagctgtcatctctgacaacaatgccttcttctggaatacctcctgaaggacctgcctgatgctgtttacagttaacttttttttaataagcagaaagagtacactctaaaataacaattaaaagtgtagtgtagtgaatacataaaccaatgacagagtcatttatcattatcaagtattatgtagtgtacataattatatgtgctatacttttatacaactggcagtacagtaggtttgcttacaccagtgttaccataaacacatgagtatgacattaggatagctgtgatagcagtgataccactaggcaacaggactttttcagctccattataatcttatgagaccaccattttatctgtggcccattgttgactgcaacgtctttatgtagcacgtaatcgtgtaagtaaaagtgattagagaggatgttttagaaaaataagaaacacttctaccacccaaactgggattcaaacatttaaagcgttttacctaaggggtgggataggagtgacactttaaataaccttggatctgtcctggcaggtgtgagggacccctgggatgggagggacagttggtcctgttgaagtgggtatttcagggagccacccgactccttcacttcacagaagagggcccaaggaaagactcccagcttggcagcactggtcttggatgagagatacccctagcaagattcacatcaattcatcctgctttcctgaacgcttgcggggccctgtcttttgacctatttattatcggcagagaaaggagactgacatttgtgaattctttcccttctctgaggcccaggttcctcactgacaaatatgtggttgagaggaataagtaggtcctgtatgggaagctccttgcatagagctcagcatgcagcaagtgtgtcatcttcactgccatggccaggagaatgtgattagctgtgggcccaagggggaattggtgagcgtagtgctgctgttcctgaggtttctgccagcctgctgcagagcctccttgctccagctctcctgccctgctgcattcactgtgcccaccaccaagagcattcaggttttgtggagactgcacagggctgtcctcttagtaaaggcaagacatggctggactttttcaaaagagctttctttactagaactgaagaatcccaatcagaatggccaaggaaaagtcagttgtctgtgtccaagacaaatgtcaaaacaataaaatgatgaggttggacattgatttatggaagcagatgaggtgttgtaggaaaaacgctggccggggagttaggtggtcttgcctgagccctggcattgctgcagctgacttttctgggaagactttggtgagtcatggcagctctgagagactcagtttctttacttgtcataagggggtgctagcgctctccctgggctctgtcgggggtggatcccacaagccgatggactgggaaaggccttgtaaattttagtaatggttcagaagggaggcattttaatgttccccagctacactgcctgacacccactaaagggtgtcaaggcctggccttggactcctgcccttgtgcaatgcccctgccattgtgggtcgttgggcagcagtgccagtcccagctttttcctgaatagcctctgggtcaggggctgtgcctagatgggagaaggaggatgctctctcagtgagggtccctgagacagagggcagtattaggttccatgtcatgtcgaagctgcagggaggaaactaaagcccagcaagcacagtttgtaaagctcattgtttgggtttatacaagagagtgagagaatagggactctcccaggctttgctcccccactgactgcatgccacaatgtggggcccaaggtttcagctcacaacacatcaattctgtctcacagtccgaaaactcagacctgttctatgccgtaccctggtcctgtgggacgctgggtttcctggtggccgctgagatccgcatcatccctgccaagaagtacgtcaagctgcgtttcgagccagtgcggggcctggaggctatctgtgccaagttcacccacgagtcccagcggcaggagaaccacttcgtggaagggctgctctactccctggatgaggctgtcattatgacaggggtcatgacagatgaggcagagcccagcaaggtaagccagggtgtcagctgctgctgaccaagactggggaggcatgagtgtgctaggactgagccggttcccgtatcctgaccctggcagccacctcttcaaggctgctgcctgggtcaacccacctggggtacaggcaacaggatctatcatcagaaatgtattagacagtgatggaagctttcatctactctgcccctaccacctgcctgggatgtgcttgtctcttagtggatgtaatctttggtccttatagcaaacccattttatagatgaggaaactgagtcttcaagaggtaatgtaggctgggcacagtggctcacacctgtaatcccaacacttaaaagaggtaatgtaaacttccacaagattcgagtaatcgatttgatgccttggaatctagattgacattccttccacatataccatgcaatttttattagcagttttttctccatttagaaaggatttgtgcttattgtaagagacttggaaaggatttgtgcttattgtaagagacttggaaggtacaaacaagtaaaaaggaaagaaaagactccacctgtaaatatgtcccaaagccagtgttgctaatgtgtttggtacacagttggccccttgtatctgtgggtcccacaacagtggattcaaccaactgcagattgaaagcgttcaggggccaaaaaacggatggtttcatctgaaatgaacatggacagactttttttcttgtcattattccttaactgttacatagcatttacattgtattaagtattgtgagaaatctagagatgatttaaagtatacaggaggatgtgcatagggttatatgcaaatactaaatcattttacgtaagggacttgagcattcatggattttgggggatcctggaacaaatcccccatggatactgagagacaactgtatttatttcctctttctctgtatggatttttttgaaagtttttaaattataaaagtaatgtaacaatgctgaaatatataaagaaaaagttaaagtgcatctctttacgccagggtgtaaccacttacgtataacagttttgtgtgcattcttcgagacctatttatttttatttatttattttcttattgttttttttttgagacagggtctctgtagcccagactggagtacagtggtacgatcacagctcactgtagccttgaactccagggctcaagcaatcctcctgccttagcctcctaagtagctgggactacaggcgtgtgccaccatgtccagttaaaaattttttttttttttttgagatggagtctcactctgtcgctcaggctggagtgcagcgcgtgatctcagctcactgcaacctctgtctcccaggttcacacgattctcatgcctcagcctcgtaagtagctgggattacaggcatgcaccaccatgcctgcctaatttttgtatttttagtagaaatggagttcaccgtgttggctaggctggtctcgaactcctgacctcaggtgatctgcctgccttggcctcccaagccaagtgctgggattacaggtgcgagccactgtgcccggcctggttaattttttaatttttaaaatttttttgtagggatggggtcttgctatgttgccaaggctagtcttgaactcctggcctcaagcagtcttcccacctcagcctcccaaagtactgggattacaggtgtgagccaccacacccagccgagacctatttctctgtgtgtgtgtgtgtgtatatgtatgtgtgcatgtcttcatttcattctgtaatatcccatttttgcatgtaaataattggcctaatttagcccttactgacatttatgttgcataaactgttttgctcttacaaataagattgcattgaagatttaagactcacatttatcctgtccttctgtacaaatatttgtgtaggattgagtcagaaaaatggactttgttacacaaaggtttgagcacattaaatattaatagatatgaccaaacagccctcgagaagagctgtgtttatgcctacttgtagtaatggtctgtgagaacacctttttccctacattcttgccaacactaaataggatcactctttcatttttgccaatctgatagcgttaaaaatagtatctcgttttattttgcagttcttggatcacttgtgagggtgagcctctctttgcagcattttgcagtttgtttgtcttcagcagtgatcacttggttcacatttgtcttttcttgtttattgttttttgttttgagacaaggtctcactctgtcacccagactggagtgcaatggtgcgatcttggctcactgcaacctccacctcccaggctcaagcaattctcctgtctcagcctcccgagtagctgggaatacaggcgcatgccactgcacctggctgattttggtatttttagtagagacggggtttcgccatgttgcccaggttggtcttgaacttctgagctcaggtgatcgcctgcctcggcctcccaaaatgctgggattacaggcgtgacccactgcacccagcctttttcttgtttattgtgataagcatttccccctgttgttacattgccttcataaccgtcattgttaatatccatcttttattagaactattacattgccttcataaccatcactgttaatgtccattcttattagaattaaagaatcccaattagaatggccaaccttgcattgcaccttgcattgaggaaatgaatgccctattgctgcccatagttggaaatttaagttgcttccaatttttttattactttaattaatggagcaatgaacatcttttgtctgtaatttgagtaatatcttttgtttttttttgagacagagtctcgctctgtcacccaggctggagtgcagtggcgggatctcggctcactgcaagctccacctcccaggttcacgccattctcctgcctcagcctcccaagtagctgggactacaggcgcccaccaccacgcccggctaattttttgtatttttagtagagatggggtttcactgtgttagccaggattgtctcgatctcctgacctcgtgatccacccacctcggcctcccaaagtgttgggattacgggcgtgagccactgcgcccggccaattggagtaatatcttaacataaaatcgcagatcaaaggataggcatcccttaagactcttaatctatacctatatacatacttaaaacattttaaagttgtgaagggctataaaatcatccggtacaatcctctctacaaataaggaaatgaggcccagaaagggaaagagacttctctgaagacacacagctagcacagaacagatttaaattccagcttctgactcctggttcagtgtcggttccctgacatatcagcctgcagactttagcactatgcaaacattgctccctgtgggacactgcggtaagtgctggaggtcctggaacagcggtggcaataccggacattgagctgaagtgctctggccctcctgggcccctggatctgcctgaggccaaagctcagacagtgtgtgtcacctagcaccaagtcacctagcaaggacatctagaccagagctttccagctgctctgaggtgttcccttgaggctctcaggggtaggaaagctgaggagggatgggaccaaggggagtcaccacccccactgtacccaaagtggctctgctgccatccatttgatgtattagatgctccctaagattatgatttggcagaggggtttgcccagcttttgaaatatttggagacctgatctgattcccttatttcccaaggagaagactgtgaggcacagagagccttacccaaaggccctcccagaatcagcagcagagggatatttgccaagtgccccagtgagcaagaccctgatacctgagggaacagggctggggcagagtggtggatgccattagacatctgggcatttcattttagaagcattgcttccaaacatttctgtttctaagcattcaggaatttgtccctgtgtgccaggccctgtgatgggccctctgcaggcactgccccgtgtaaacattgctgcaatcctgtgagaagcagcctacccccatttcacagaggaggcccagagataggaagtggcttgcagtcaagggctggggtggactggagctcatgcagccacctggcctcctcagctggtgtgtgcctggaagagacagactatctgggttctttcccatgtcctgggcttctctgcatggctcctgatgcatcagtgagcaccaggagcgcctgtatccaggtggccctaagtctcactttcattatgcagctgctgccactgccaggtatgtgacacacctcacctggggttagatcaggttgctctgtttcctgctgggttcccctgttcacattagcaggcagaggccagcgtgagtgttttttgccctgccccataccatccacaccaaaactaatttgggcaaagaggctctttagccccagtttcctccctgcagagtggcctcaccagcagggtggccttaccagcagggtgggcctgcacaagcgggtggcacacagataagctgcaagtgctggaggccagagatccacggcaaagggttgcctggctgtagggtagagcaggtcaacaagggaatgggtggggactgatacttcagccacctgtggaccaggcaccgtgcttggcactttctacatcatctcttttagtcttccagaaatgctaagtaacctgcctaggctctgctaagtgtgttgtaaatggaaaaagcaaattggcaaacagtacgtgtaagatggtcccatttttcaggaggctgaggcaggagaatggcgtgaaccagggaggtggagcttgcagtgagccaagatcgtgccactgaactccagcctgggcgacagagcgagactctgtctcaaaaaaaaaaaaaagatggtcctattttttaaaaacagtgggcatatgtatgtaatttctaatagacaaataactcccacaaagtatgtatttttattgtcatgttacatgtgaagaaacaggctcagagatgacctgcctgggtgtgtccccagctgcccaccctaaagcttgtgcttttccaggatcccccctgcctctccccgagagcatctgccagaattcatttatggatgaggaagctgaggccaggagaagctcagccatcccaaggcacacagcacattgagtcatgaccatttagggctgcaggagacatcagctcaatagaagatttgggtgtgggagcccccagggccagggaggtatgagccttattcatgtgagcatcctccagacgatggtggctgcctggggagtgctgtacccggaggactgtggagcttggtccagggacagcagggaaagtgccatgaccagttggtgccatgagccctgggttgcactgaggggctgacccattcccagagttcgtgcttccctggccttggggaaggtgggaagggagggagggagggaattcccctgcatggggcactgcatcagggcagttaaatgtttaactctgttaaacacttgcaccaggctaggcggggtcgctgagttctctagactgtcggggactcactgtttggccctgggcacacaccacttaacctctttgagctcctgctctctctgctagaggatacccgctgtgcctaacctcaccagctttcaagagtctcaaaggcagtaatagacatgaaagagctttgaaaaggccaggagtgctgaacagaagccgggtgtcgctgttacaccccgatggtgctgggcgcttgtctgcaggctgatcacaatgccctctgtcatttcagctgaatagcattggcaattactacaagccgtggttctttaagcatgtggagaactatctgaagacaaaccgagagggcctggagtacattcccttgagacactactaccaccgccacacgcgcagcatcttctgggagctccaggtgaggcttgggtttctgtagccctggctcctccaggccagctgggcagggagcccggacagttaacactgtagccatactctctcccttcagggtaaagagtggctttgtcctaaggaactgcaatgccttcttaagcagcaacacagtcgtttccttctgaaggaaccaactaccttcagttcaagcagcaggctcttagcaagcatctgcttggtgctggggagtaagcccctgggccggtactttggggaacacagacctgttccgcccttgaggaagggttagcctctagccacggtgagcagacagatccctgcactgtaaagggccgcaggaacattagtaggaagtggctagttctgcctagggctcgaggtaacagccaagcctggctgtgaaaggtgagtgagaatttgctgttgcatgtgtagatgggtgggtggatgaggagcagtgacactttaagtgggggaaggtcaggaagaacccctcaggagatgactttgtgagcagggacctgaacatagggaaggcagaccaggaacaactctggggaggactctggaactctgttcacaggcagagggacagccagagcccagggcttgagctgggctaacaggaaattaaacattataaaatggacagttcagggtagtttagtacattcacagtgttgtgcaaccactacctctgtgtagttccaaacattttcatctctgaaaaggaaaccctatacccattaagcagccactccctattctctcccctttccccagcctgtggcaaccaccaattcatcttctgtctctgcagatttacttattctggatatttcacatatatggaatcattcagtatgtgccttttgtgactggcttcttttacatagcataatgttttcatgtatcaatatttcatttctttttatggcgggatagtagttcattatatgagagaccacattttgttttgtcactcatctgttgatggacatgtgggttgtttcaaccttttggctactgtgaacagtgctgctacaaaccttcatgtgcatgtatttgtttgaatacttgttttcagttctttgggatatagaactaggagtggaattgctgggtcatatgctaattctgtgtctaactttctgagcaacaaccaaactcttttccactgaggctgtgccatttttcattcccaccagcaatgtatgagcgctctattttttcaacattctcaccaacacttgttattttctggtttttaaattattagtattattattatagccattctggtgggtttatggtattgacttgcattttccttgaaattaatgatgctgagcatctttttatatgcatgttaaccgttttgtatatcttctttggtgaaaagtctatttgaatcctttgccaccttttaaaatttggtcatttgtctttgttgttgagatgtaagagttctttgtatattctggatactagaccctcatcagatatatgatctgcaaacattttctccaattctgtaggtttcttttcattgtcttggtaacgtcctttgatgcacagaagtttttaatttagatgaattccaatttatctattttcccttttgtttgtgcttttagtgccatatataagaatttattgtcaagtccaagcccctttgttttcttcaaagacctttatagttgcagctctaatctttaggttgttgagtggggtaggagtccaggctccattcttttgcttatagctatccaggtgtcccagcaaggctgcatgtgtttgaaaaacagcaagaagccttcggagccagcatgcccacgctgagctatggtgaggaatgaggtcaaacaggcaccagaggctagatcatatggctccttgtaggttaggaaggactttatattttattctaagtataataggaagccaatgagggctttgaacaggaaagtggcatggcctgatttttgttttaaaagaataactgtgacagctggatagagtggatggggacgggagtggacaagagtggaagagtagaagaaagaagatactgttgtctgggcagcagcagaggagaagtgtcaaatctgggagatgcagtgcaggctgaaccaaccagcaggatttccagacagattggccgtggatgtgattcaaaggttcagggccaaggttgactgccttttttttttttttttttttttttgaggcagagtcttgctctgtcacccaggctggagtgcagtggcgcaatttcgcccactgcatgctccgcttcccgggttcatgccattctcttgcctcagcctcccaagtagctgggactataggcgcccaccactacgcccagctaattttttgtatttttagtagagacggggtttcaccatgttagccaggatggtctcgatctcctgacctcgtgatccacccgcctcggcctcccaaagtgctggtattacaggcgtgagccaccgcacccggcctggttgactgccatttgaaacatgggggaggggactggaaaggggaatcagaagccattcagatgtccaggtgggatgacagcaggagccagtgacgtgtgtcgggacttcaggagttcagtggaggttggagccctatatacacatttctcagccacagagaaatgttttctaaagccatggagggagatgagtgagggcagatagagaagaccctgggacaccttgcaggttaggggaggaggaactagccaagggcaggagaaagtgctgtcaaccagggcaggggaacaaaaccaggaggatgtggcatcccggaagctaagggaagactgtttcaggaggaagaccagcaactgtgccacgtgctgctgaaggagatgaagacagactcgacctctggatttggccataggaatgtcatcattgactttaagcaataggggtgaatccttgaccagtgggtttgagagagaactggagacaaggcggtggacacagtgaaaacaaacctgaggctcactatcaagagaggcagagaaacagggtgatggctggaggcgggtgtggggccaggtgaaggtactttgtctgtgtgattgctttaagatgggagagatggcagtcatgacagtgatccagtggaggggaaaatgacaatgcagaagagagggtatattgatagggtgaagtcttgagtaggggagtggagtggctcctgagctcaggtggagaggctgccttttgatgggcacatggaaagttcatccagttgtcaggagggaagcagtactaatggctacagttgctactaatgggaggaccatagggtggtgggagggtgtgggagttctcttctgattgcttctgttttctcagtgaaataaggatttcagctgagatgaaaggggagaggattttgatggtttgaggagagaagagatgtgaagctgtccctcggagagtgggaaatgagttaactggggaaacactgtggcattgccaggcagcactgggcctaccagggattcacactcatgaatttacagtgagaccagccctgtgtttgtgggttttcacccaggaatctgtgttgctggggtacagagtaggcagagagttatatttaaccatggctgaggttttgcagggagtgtgatgtgtaggcaagagtgaggacccaagggtgtgttatgatgaaatctaagccagctatggaggggaggccggatgtgagaggcccccagggactgacaagggactgatatggtggacaggatgccctgggtggagtggagcattgaagtcaggggactagagggcgtaagctaggaagagaggcggtgatggctgagagcaaacacttgcaatggaagctatggagactgtgaatgtagggcagggtgacagagcctaggggtcagcaaactttcctaaaaggccaaacaacaaatattttaggcattccaagctacagaatctatcacagctcctcagatctgccacatggaaacagccagggatggtacataaatgaatagggatgactggccccagtaaaaccaaatttacaaaaacagtcactaggccacatgctcacttccgctcccacactggatccccacgggtagtaatttctgtcccctcctccagggtatgttgtgagagccagtggccaaggacatgtggaagataagatcactggaatgtaaagaaagaaggccaagggcagagaggccaggcgtggtcaggaccttctctgtgggttttaaattaccaaaagtttttttttttttttcttttttgagatgaagtctcgctctgtcgcccaggctggggtgcagtggctggatctcggctcactgcaagtgccgcctcctgggttcatgccattctcctgcctcagcccgagtagctgggactacaggcgcctgccactgcacctggctaatttttttttgtatttttagcagagatggggtttcaccatgttagccaggatggtctcgatctcctgacctcgtgatccgcccgcctgggcctcccaaagtgctgggattacaggcgtgagccactgcgcctggcctcaccaaaagttaatgttgaagaaagtgacggttttccaggaaccggtgaaaggaaccaaggatgttgggattcggggaattcagtgatccacactctagtgaggggagccatggttatcagaggaggtattgggcacatgtttccaagtttctgaggttggtttctgggcatgggggaggaacagagatctggaagcagtaatgaggggccagggggaccctacctcacctccgtgtatcccagtggcaggagggttgtaggggagaaaatgataccacttaaagagggcttcagggttctagttaacaaggaggggagaggaatgttcagagaagagactgagaatggagagggttttgttaaggtcagaccatgagagcagggcttgagaggaaaggcggtggggcagtggcaagtgaagtcagattaagagatgctgcattgctgtagtaggctaagatcacagtaacaaggcatctggcaggccatggtgactaaggacattagaatgtaaggcatgacggaattatacctggtgggcttctaggagagggtgattggtcagttctgacattgggcaagtatcttaagcagaatgtgattgggcggtggtaggggtggaggagtgtaggggtgagggtctcatcatggcctggaggggctatggggtctcccccacacccattagtcttaatcttgggcaatgtcaaggcccacagcaggtggtgggcaattttgccaaaagcagaagccactatgagtccttcttgatccctgccaagagcagtgttaaggttgtggagtgtggttttgttaagagaaaggagaggaactagtgaaagaggatcagaaagataacagcagtggttaacattagccactcccaatgtgggtggacgttaatgctgaacactttccacgcattatcttcatcttcccaacaaccctctgagagtagatattagtgttatttccattccatagatgagaatactgaggattaggttatccaaagtaactaccagcttggtcaacatggcaaaaccctgtctctactaaaaatacaaaaatgaaccaggtgggttggggcatgcctgtaatcccagctacaagggaggctgaggcaggagaacccaggaagtggaggttgcagtgagccaagatcacgccagtgtactccagcctgggcaacagcgagactctgtctcaaaaataagaaaaaaaaaaggaactgttggagacaaagtaaataacacaactcagagaatgagtgtattagtgatctattgctgcataatgaacaaaaccaaaagttagagattaaagcagcaaacatttattatatcatagtttctgaaggtcaaggatttgggagtggctgatctgggtggtcctggctcagggactctcatgctgtgggctatggcagtagtcatctggaggcttgactggggctggaagatctgcttccagctcacatggatgttgaccagagaccttagctccttgccacatgggttcctccagtgacctcatgacaaagcagctggcttcccccagagcaagtgatccaagagagagaccaaggaagagtctgcagtgccttttatgacccagtcgtaggtcacacctctcacttccaccatattctccttattagatcagagtcactaatccagcccatactcaggggaggggcactgagctccacttcttgagaaaggactagcaaagaatctaggggcatatgttaaaaccgctacagaaggccgggcgcagtggcttacacctgcaatccagcactttgggaggcggaggtgggcggatcacctgaggtcaggagtttgagaccagcctgaccaacatggagaaaccccatctctactaaaaatacaaaattagccagatgtggtggtgcatgcctgtaatctcagctactcaggaggctgtggcaggagaatcacttgaacccagaagcggaggttgtggtgagctgagatcgcgccattgctctccagcctgggcaataagagtgaaactccatctcaaataaataaataaataaaaataaaaataaaactgctacacagagctaggattcaaaatgaggtttgtcttacatatttgttctgttaagtaaacactggcccacactgccttcaggtaaaagaagaatctggaagaataggtgtgttcagcctacatttgcatgcaggaagtgaacgttcagacctctagggatctgtcattgtgctgatctgtcattgtgtggtagtagggaagtgggactgggaagagggagaagtcaagctgtggtgcagtcacaaggaagacctcagctaacccacaggcagccctggggtaagatggccctccagagttgtgtcacctttaggccagtgggctaggactttataccaaatgctgccccatcaaccagtcattgtgcagactgaccttggatgaggcagctcccttctgccaagggcagttctccctgagtgtcagcagtcagcaccctgtgcagctgggggaacgggtgcctccctggagcgggcatctgcgcgcagcatcctctacagtagaaatgcagaagacaagacatttctagaggggaggaataaacaatttcaaatgcatgccttttccccccctctgctgggataactcttctcctcccattggcggcctttcccccaggttcctccctgatgagtaaggccctggaatgaaccaagtgtgaccaggcctgcgtgctaagccccttaacaagctgcattctgggtgattagtccattctggtcacacctgtgccaggcctggctggtccagtcacttcccttcccccagcttggtcaatcagcaacacgcggggtcagggttagctgcataatttgtagggccaggtgcaaaaagcaggccagaagtgccattaaaggtactaaatataaagcttttttctttctccatggtctgtctcttgtcataaatatttgcaacttaatgccattctaagtgaagaaaaatttaaattattagtatgaattttactgttcattgtttaaatgttacatttaactcctcatgtatatgtatttcttggtttcattaagaatgctgcataaactctttttacttctctttgttacatgcacattctaccaacactacctttgacttacggtaaggaaggactgaaagaaaaggagccaagctgggcagctctgtcttgtcattcctttttatgtcatcattttagtataagcggttggctaacacagggagttaacaccagtaagaaaggataagatagggtccttgtgttcatagaaggccattgccccaggacttcctgctggggctggggttcctggctcaggctgggccccttagatttgccatggggccctacagccagtgagcaaggatggccagagaacaagggctgcagtgagattctctgcaatgactggcctcagcaagggggcagcttaggaccctgacatcccaggtcactaagccacataggataagtaatgggtggacagaagcgggaaaggagaagggcagggcacatgtttaaaacttgaactttctgaggctaagactggaaaaggaatggtttcagctgatatatttggataccagttgactatttttaggaaaaaaacacaaatggcttttaaacatcacagtgtgatacagtctaactcagaattagagacaggcaaaacagaactccaggagtctcatttttcacctatcagaatgaatgacagtgatctagaagtttgatgtcacattgtgctggcaagggagaagggaaacagtgttctacattgtctgggagagtataaaatggtacaagctctgaaatggtatccatgaaaattgcacacactgtttaagccaaaatcttccacttctaggaatttatctttctgacacatatataaatgggcaaagataacatatacgaagtatattagttggaataatctggaaataatctaaatgtctgccagtatagaagtgattaaataaattatgacacatctgctgtaatcgagcaggggtcaataacctttgtttttttttttgagacggagtctccctgagtcatccaggctggagtgcaatggtgcaatcttggctcactgcaacctccgcctctccgcttcaaacgattctccttgcctccgcctcctgagtagctgggattacacgcacccgccaccacgcccggctaattttttttggtgtttttagtagagacagggttttgccatgttggccaggctagtcttgaactactgacctcaagtgatctgcccgctcagcctcccaaagcgctgggattacaggcatgagccaccgcacccgatccaataagcattttatacaatgggccagatagtatacagtctaggtttttcggaccataaggcctctctagtaactgctcctctgccttgtagcctggaggcagccatggacaatttgtaaaggaacacacaaccagagggtgggccgaatttgtggacccctgcagcacacattagacacccacaaccgaaggcagtagtgccctctgtattgatacaggatacagtgatgagccagtggtgctaagatgccaccatttatgaggtttttttgctttctgttttttcaaagctcctctgcttctccgtatcagatgtcccccaaagggtaggcaaatcattcttaccaatgcttgccattagggagggggaggagagttgagggtgggtggggagccaggtcaggtcattgctgggagggaaacagggtcaggaatgtgcagggaggcttaacttttgtactatggggatttctgctgtgggcatatgtaggtcttccaaaggtaaccaaggaaacaataaaagccaggctatttattgagatcctgttgcatgccagacattggcaaaggcgcaggatctaacagaagaaaacaggcaggtccctgacttcatgggagtggtccggcagctccagaggagtgagggaaagggtcactcagccttcagtgcttacacacatggctgctttggggagtcaccgtgccccctagtctgatgtggaccctttcatgagctgccccagcctctgtttgtccccactcttcccacactcatccagtggcctgtgtcttccacacctgcggttgtgggtgtcttaaggacagagaccatgtctcagttatcttggttccccagcacccagcatagaacctggttcctgacctcggaggccccttggaactgtttttttttttttttggagacggagtctcactctgtcgcccacactggagtgcagtggcgcaatctcggctcactgcaagctccgcctcctgggttcacgccattctcctgcctcagcctcctgagtagctgggactacaggcgcccgccaccatgcccggctaattttttgtatttttagtagaaacggggtttcaccgtgttagccaggatggtctcgatctcctgacctcatgatccatctgcctcggcctcccaaagtgctgggattacaggcatgagccaccgcgcctggccagaactgtttaatgaatggaggagcagccttggcttcaagggctcccagagctgtgagaatcgggcatcagtggacactggggaccctcaggaacatggtaggactcaagcagggaggaggattgtgacccaggggccaaagtcttctctgttggaggtgggcagagctggagggaagagggggccatcgtcaggaggcagcagtgctgagtgaggaagctcccgcctcgtggcagtctgaggcgtggaagagaacagcttctgcgcaggagggtttccagggagaccgaattgggggagccaggcgggtggtcaggctgtgagcaagggatgctgcaaaccagtgggctccttgtcgaacctgagccagactgcacccaccccatgagcgctgtctctggctgtgtgcccctagggagactgcttaagttctctaagaatcactatgctcattcaacagcattcgtttctcaaacatttatggaatgccagctctattccagccagatctcaacagctagatcaggaatgatagctagctcattattgcactccaggcatggggttgagtgccttccacttggtattaatatctcattatcctcacaaggcccattttacagataaggaaactgagctcaaagaagttaagtaactagcccggggtcatcactactggcgaatgccagagctgagaagcaaacctagattggactggtaaagtcctaggtcccatcacaccccctccaaagaggggaattggactcaggcgtgcttctgtcaagcacagaatgggacctggcccctggccccttgcacttggagacattcaacccttgttggtttttttctctccaaccctaatctttgttttccaggacattatcccctttggcaacaaccccatcttccgctacctctttggctggatggtgcctcccaagatctccctcctgaagctgacccagggtgagaccctgcgcaagctgtacgagcagcaccacgtggtgcaggacatgctggtgcccatgaagtgcctgcagcaggccctgcacaccttccaaaacgacatccacgtgagtggggcagggcagggagggcgcaccaggtgcattcccttggaatccatggtctcctcccctgaaccgtgtgaccgaccttgggcacactgccctctgggtgttttcccaactttaagatgaggtccttgtccctatgtctgctgaggcctcaacccactcagtgatggcccccctgggagaggagtcatagggtctggcatcgagcactcccatgacctgctccgattgtgtcctccaaggtggtggagtcagggtgttctcagccagggctggggggcggggcagtgaagctgagagcacctgagggggtcttgagaatgctgcaaagccttcatttgggtgggtatgagcgggccagccatgagcctgtcacctgttggagaaaaagcaccaatacccacctccctggtctacccaggtctaccccatctggctgtgtccgttcatcctgcccagccagccaggcctagtgcaccccaaaggaaatgaggcagagctctacatcgacattggagcatatggggagccgcgtgtgaaacactttgaagccaggtcctgcatgaggcagctggagaagtttgtccgcagcgtgcatgggtgagtggcccagagtatagtatgttgcctctagctgacagccccagggtactgctccaggggaatgaggccagctctatggagaaccaggagccccaagcctatcaactggttccttagggcccctgcagctgtggcagcctctgggtcaggaggtaagctgtgaaagatgggcagggggtgggcttgcaggactacttgccctcttctccctgcaccccctcctccagtgaacatgtcacacccccccagcagccccagccagaaacctgggagtcaccccactcctccccacggaacagatgatgggtgtgggcttagctgggtccaggggcaactgctccagatggaaaggccaaagctaaggagagagggattcctgtctatgaaaaccacggagaggcccaggacagaggattgctcagaaaacagcctggataaactattgagtggaacatggacaaagccaggaaaaaacaatgccatatgattcctttcatataaaattcccaaaaacacacatgaatccatactgatagcgcatcagtagttgcctggggatggcagagggcaacggataactaaggggcatggggaaagtttggggctgatggttatagccacgatctggactgcagtgattggagtccttggttgcatgcatgtgtcaagcttatccaattgtgtactttaaattatgtctagtttattgaaagtcaataacagattaaaggaaaacaaccccactgctccattaggggaggcagctgtgcctctggccaagcagaggggcagaagcccagcagtctgagctctactcctgactctacctccactgctaagctacctaacccccaagccccaattccctacctgcaaaagggggataagaatacctgcaccatcttcttcaccaggttaacggggttaaacaagagaaatcctccaaaagccttttctgggctgcagaatgagcagttgggtttctctcacgcctcgcgttccgtgtgcctcctggcgtcctcacccacttctctgcctctgcagcttccagatgctgtatgccgactgctacatgaaccgggaggagttctgggagatgtttgatggctccttgtaccacaagctgcgagagaagctgggttgccaggacgccttccccgaggtgtacgacaagatctgcaaggccgccaggcactgagctggagcccgcctggagagacagacacgtgtgagtggtcaggcatcttcccttcactcaagcttggctgctttcctagatccacactttcaaagagaaacccctccagaactcccaccctgacagcccaacaccaccttcctcctggcttccagggggcagcccagtggaatggaaagaatgtgggatttggagtcagacaagcctgagtccagttccccgtttagaactcattagctgtgtgactctgggtgagtcccttaacccctctgagcccgggtctcttcattagttgaaagggatagtaatacctacttgcaggttgttgtcatctgagttgagcactggtcacattgaaggtgctgggtaagtggtagctcttgttgcttcccgttcagcgtcacatctgcagtggagcctgaaaaggctccacattaggtcacctgtgcacagccatggctggaatgatgaaggggatacgctggagttgccctgccatcgcctccatcagccagacgaggtcctcacaggagaaggacagctcttccccaccctgggatctcaggagggcagccacggagtggggaggccccagatgcgctgtgccaaagccaggtccgaggccaaagttctccctgccatccttggtgccgtcctgccccttcctccttcatgcctgggcctgcaggcccaccccagccaccactgagtccactcggagtgccctgtgttcctggagaaggcattccagggttgaatcttgtcccagcctcagcctgggacacctaggtggagagagtggtctccgctctgaattggatccaggggacctgggctcattcttcttggctcaccaaccctgcaggcctcatctttcccaaaacccactttgtcttggtgggagtgggtccgcgctgctctgcagcaggggctggggagtggacagcatcaggtgggaaagtggagtccaccctcatgtttctgtaggattctcaccgtggggctggaagaaaagagcatcgacttgatttctccaaccactcatccctctttttctttcttccaccactccccaccccagctgtagttaatttcagtgccttacaaatcctaagctcagagaaagttccatttccgttccagagggaagggaacctccctaggtccttccctggcttgttataacgcaaagcttggttgtttatgcaactctatcttaagaactgcccagcctcagctgaaaacccgaatctgagaaggaattgcgtcatgtaagggaagctggaattaagggagctgagccagtcatggttgtggcgtgtgagtcaggagacctaggtttcagcccctctctactgtcagcgagctgtgcaacgtgggcaagtcattgtcctctgagctgcagtttcctcatctgtcacatcgctacagacaagacctccctggaacccttctgattgtcttagacactgtggttgcaaaacccacggaaagcctcatttgtgtggaaagtcagaggaaaaatgatccagtggacacttggggattatctgtcattcaagatccttccttcaaccccaaggtcagctcccatctcatttccagaaaggctcatacctggcttgcagggaagcatctgtcttgtcattccaggtgccagaatcctctcagagtcattgaagggtgttcacccatcccacccaaggcttggcacactgccagtgtcttagcagggtcttgtgagggctgggggcatccaggcactcagaaggcaaaggaaccaccctacccatttggcctctggagggggcagaagaaagaaagaaacctcatcctatattttacaaagcatgtgaattctggcattagctctcataggagacccatgtgcttccttgctcagtgcaaaactgatgattctacttgctgtagatgaatggttaacacgagctagttaaacagtgccattgttttgccagtgaagcctccaaccctaagccactgggacggtggccagagatgccagcagcctctgtcgcccttagtcatataaccaaaatccagaccttatccacaacccggggcttggaaaggaaggtattttggaatcacaccctccggttatgttgctccagtaaaatcttgcctggaaagaggcagtcttcttagcatggtgagctgagttcatggcttttttttgtagccagtcctgtccctggccatccatgtgatggttttggatggagttaaacttgatgccagtgggcagtgcatgtggaaagtatcagagtaaggctctcccctccagagccctgagtttcttggctgcatgaaggttttctttagaatcagaattgtagccagtttctttggccagaaggatgaatacttggatattactgaaagggaggggtggagatgggtgtggcagtgtatggtgtgtgatttttattttcttctttggtcatgggggccaaggagaaaggcatgaatcttccctgtcaggctcttacagccacaggcactgtgtctactgtctggaagacatgtccccgtggctgtggggccgctgcttctgtttaaataaaagtggcctggaagctggcgtttgtcgtttcttgcttgggggaccaaaatgtggagtcagatctgggctcgggtgcaggctgtgccattccccaactcagttgctctcactgaacccatgagcccatggccgagggctagaagaacatgcaggaactgacaggtttatttctatcactgtcagagtgtgattggagtaagtgttgaaaggatccctctgtgtgcagggtggcaagcagaccagtgagaaggccaccactgcagtccaggtgagacgatggtggctctggttagggtggaggcctggctttgtcacttggttgtgaccaattaattttagcaagttaatcctgttgagactgttgtcctcatctacaaactagtggacccactagctgtccattaaaatgcattcctccattctttggacacatagctagactacctttcccagccttccttacagtcagttgtgtccttgtgttaagagctttccagtggaatgtaaacagaagtcataaaaacctatatgaggtctcctggctctccccttcactcagtgcagatgacaaccaggccataggtggttggagagtcttatgtcagaaggaacctggattcctgagtcactgcaggagaagcgcttgtggccagaagtgcaagaccaagcctgagcaacatagtgagaccccatctaaaaattagctaagtatggtggcaagtatctgtaggcccagctactctggaggctgaggcaggaggattgcttcagcccagaaacttgagactgaagtgagctatgatcgtgctactgcactccagccggggtgacacagagcaagaccctgtctcaataaataaatataaggcattacctgggctggtgcctgagagcccaacccagagctccttggtttgctgagcttaggcgctagactggactgggtttgctgagcttaggcgctagactggacaatctgtatgttgctcctcccagttccaaatctgaatcttagcagcagctgccttacaaacctcaagccatgaacctggcatcaagacctatgagaagaagcaagagggccacgtaggggccttggcttggtttaccaacctccttacaggagggtgtcaacaatctgttcactacctgacctaatggaagctgaaagtagaagagaattcacatgcgtatccttggaacttctagttaccccactggcagacctgaggtctgatccctctgggggaggggtgagaaaggtgtttgtgggagggggtcagtggtgtgctggaatatggcttgtaccagcttacaaggaccatcatgcacacctccttccacttccatgttcagtgacattggcagcctgaaatcacccacagggggagcatttacaccacagaaattagcagcactacgaatcagggcttgttctgttgtattaatcagtgttctccagagaaacaatcagtaggagatacacacacacacacacacacaggcacacatcccttaacgaggataagttctgagaaatgcatcattaggtgatttcattattgtgtgaatatcacacagtgtagttacacgaacctaaatggtacagcctactacacacttagctatatgggatagcttattactcctaggctacagacctgtacaacatggtacagtactgaatactataagcaattataacccaatgctaagtacttgtatatctaaacatagaaaaggtacagtaaaaatagggcattataatcttatgggtccaccattgtatatgcagtctgtcattgaccaaaatgttatgcatcacatgactgtatagaaaggcaagacacatgcagagacagagaaacagagacttacaaagtattggttcatgtgattatggaggctaagaagtcccaagagctacagtaggcaagctagatacccaggaaagccaatgatatagttccagtttgagtccaaagggctgagaaccaggagagccaatggtgtaagttccagtccaaaagctggtaggctcaagacccaagaagagcccatttttcagttcaagtctgaaggcaggaaaaccctgatgtcccagcttaagcactcaggcaggaggagtttcctctcattcagtccttttgttctgttcgtgtcttcagttgattgaatgagacccacctgctttaggaagggcaacctgctttgctcagtctgattcaatgttaatctcatccagaaacaccctcccagacacacccaaagtaatatttggtcacatgtctgggcaccccgtagcgctgtgaaattgacacagaattaactatcacaggagggctttgttttgttttgagagacaaacatttaccagcataccacttaacagagacctctcttaataagccctccaaatgcaagcttagcaggaaaggtggctcctgcaccctggctctggcctcagtacattcgcctcttaggcttctgaacctcaggcatctctatgatcatccccactcccttgttaatcattctcattattggtgaacccccattccctggctaatgccgccgcaggtccaggaagagggagtggatcaactgaacctgggaacaggtgtaaactgctcctgagaaggaggagctccaagggtcaagttggcgaaggtgaaactgccttcagggccaaaggactatggcagggccggagtgggacctgggcttgctcaggcccaggacaggcatcaagcagcccacagcaatgaggatgggaggacctgagcttttaacaaagggagcttcccagagctggcctggctggtgtgcccagggatgttgtgaactcaaggtaaaaagccaaagaccgcacggtacaacgttcatgatggtcagaaccgtcacccttaggtattgataagaacctaacacagcagatgaagtcccattctattaatgtttactaaagcaaccacgccgtgcaacctatgtaaacttgttcctcctgtgggcctcagtttctccctgtaaagtgagcagctatgccagccatgcttcaccttgccaaggcattgcagatgaccagctgcccatgcccactagctgatcttcagaacctggttgcagcaggactgcctatgtgtgatgcccactcattgttacgttacctgtggtccatgttgcaaggtggtgctgaaggcatagtaagaacctggatgttaagtctggtggcatggcttgtaaaaggctattttggcctgctcagggcttcccacaacctggcagcatctcacactggagtgggagagatcactaccctcctgagcaaccagggaggtgctagaacctgctgttgcttttttaagatgtatgtgctggagggttaaacccagtcacctgcaggaccacttcaagagatggaactagaatttggtggttattaaatatttatttattcatttcatttttggctgtggagctttttcccccaaacaaaagcgtttagggaaagtccagtatataacaaacgtggagttactttgagtcaagctgggtgcggccaggagtccagccctcatggtcagggcctgtgccctccttctccagggattgctggaggccgcagcagagtccagttaacaacctgcagaactccatgtcctcttatggccctgccctggcaggagggcaagggtcacaacaagccagattttagctcaacatccaaaggacccttttacaatcatagctgccctgcactgggaagggctgtcttgagggtgtgcaagaagagcctggacagacagatggagttattgtcgcagagcagagcagtggtcaccaaatgaggttcccaagcccagggtgtaacaggatgatccatcgggatgcctgagaaaatgttagtgtttgtcttggtttgggtttccctagaagccaaccctaagacaaagatttgaatgcaagcagtttatttgggaggtgaagaaaacaccagcaggggagtggagaagggatgacagccaataatgggttcattctcaagcaggttaccactgggggccactacagtgtaactgcactgggaaaactggaaaccagtgtaaaacatgcgtttcaaaggtacatcccacaagggctgagggagctggtatttatacaccaacttccctcagtgagggtagctccagagggatgtggagttcctggcacttctagccctccataggcagcaaagccggccctggcagccagagagccttttgctccattatagatgaatgtccctccccagcacacattatttttgtaacacacatgaactcattcttatctcatggcaaaatatttaaaagaattgcctaatttaaagttgtggccaggggccagacacggtggctcacacctgtaatcccagcactttgggaggctgaggctggtagatcacttgaggccaggagtttgagaccagccaaaaccccatctctactaaaaatacaaacatagccggtcgtggtggctcatgcctgtagtcccagctacttgtggggctgaggcatgagaatcgctagaacccaggaggcagaggttgcagtaaactgagatcccaccactacactccagcctgggcgacagagcaagactttgtctcaaaaaaaaaaaaacaaaaaacaaaaaaaaaaacttgtggccaggctcggtgatttatgcctataatcccagcaatttaggaggccaaggtgggaagacagcttgagcccaggagttccagaccaagctgggcaacatagcaagaccctatctctgaaaaaacaaaaacattatccaggcgtggtggtgcagcctatagtcccagctacttgacaggctgagaggtgtgagcatcacttgagcccaggaggtcgaggctgtagttagccatgatgacaccactgcactccagcctgggctggacacagcaagaccctgcctcaataaataaataaatgaagttgttacacaggtttctcttataaaaaggcaagcatcacaaatttgctgaccttctctctctttttttttttttttttttttttttgtttttttgagacagagtcttgctctgtcgcccaggctggagtgcagtggcttgatctctgctcactgcaacctctacttcccaggtttaagcaattctcctacctcagcctcccgagtagctgggattacaagtgccttctaccacgcctggctaatttttttttcgtatttttagtagagacggggtttcaccatgttggccaggctggtctcgaactcctgacctcaggtaatctgcccaccttggcctcccaaagtgctgggattataggcatgagccactgcacctggccttgctgaccttctctacagtgacagtgactgtctataatatgatagctgatagagatatttgaacaaatatacttattttgtaaggtaaacagtctctttaaaaagttttattgcatacattttaactcgttttattactttatttttatttgtaattaattctacagaaacatcacaatggtagtagagcaatccccctcacttgccttcccctgatgttaacatctttttttttttgagacggagtctcgctgtgtcacccaggctggagtgcaatggcacgatctcagctcactgcaacctctgcctcccgggttctaagcgattctcctgcctcagcctcccgggtagctgggactataggtgcccatcaccacgcccagctaatttttttgtatttttagtagagacagggtttcaccatgttggccaggctgacctcgaactcctgacctcaggtgatctgcccgctttggcctcccaaagtgctgggattacgggcctgagctaccacacccggcctgatgttaacatcttctacatgaactaagatagttgtaccattttacacttccaccagcagtatatgagagttccacattctcaccaacacttggtatggtcagtcttttcaattttagccatcctaataggtgggtagttgtatctcattgtggttttaatttgcatttccttaatgcctaatgacattgagtttattttcatgtgcttatttgccatccatatatcttcttggtaaagcgtctgttacatcttttatacattttttattttgttgtttcttattgagatatatatgaactcacatatatattctggatgtaagtcctttattacagcagtccccagcctttttggcaccaggaaccggtttcatggaagaccgttcttccacagaccagggtagggcggggtggcaggggaggatggtttcaggatgaaactgttccacctcagatcatcaggcattagttatattctcataaggagcatgcaacctagatccctcacatgtgcagttcacaatagggttcggctcctgtgagaatcgaatgccgccgctgatctgacaggaggcggagctcacccactgctcacctcctgcctcgaggcctggttcctaacaatccctggggaaggagggcacaggggctggccacgagggctggtctcccggcctcacccagcttgattcaaagtggctacatgtttgttatattggactttccctaaaagcttttgtttggagaaaaagaaaaaaaagaactcctcagcccccaaaaataaatgaataaatgtttcataaccacccaattccagttcagtttctagaagtggtcctacgggtgactgggttgaacactccagcacataaatcttaaaaaagtaacatcaggttctagcacctccctggttgctcaggagggtagcagtttttccccactcttaacgtccaggttcttagtatgccttcagcacccccttgcaacatggaccacaagtaacatgacaacgagtgggtgtcaaacataggcagtcctgcggcaaccaggttctgaggatcacctagtgggcatgggcacctggtcatgtgcaatgcgttggcaaggtgaataaagatggctttacttcttcaaaaacatttgttttgacacaggagaataactgctttttgtaagacactcgcgcatggaagaaagtgtttcaagtattttttatcattatgtgtgctttgtggacgaaactgtggtatcccagtctcctctagggacaacctgctcccccattctcactgacatgaaacagtgagggaagggtgcccacaagggctgactcaggggtgaaaccgatgttccccatggctggacatggcctgaggtccgcagtttcctcatcagtgaggccctgctaagcttccagaagcatcctgggatggcaatgaggtgttcctgcagagtcctagaattgccgtgtaatacatgctacactctcccaccactttctgaactttaataaacaaggagccaagcactctggctttagaatagaaagggtcccacaagtgtcaactacgtcccatcccttcagtccatctgctctctggcccccatgttcatgtcactggctgagttgagttctcaggataattgatctcctgcaacaaaagatacctgtccccagctgtcccggaagacactgtgaccttcaggtatgcagctctggcaaaggtgatccccatacatctctcccctctcccaagcccatgtgtcctttctctaagacaccccactcccatgcccatgctgtcacccccagatttgtcttcaggcctttgggctctctggtcactgcaggctgtccttcgcatgtggctttaaggagtaggatctgaattgtaatccacagttggagggcactttcccttagtaaatggtgtgatcctttccctttaaaaagacagaaaaaattaaaaaaggaagtgatcccttggaagggagtgagctcctcatccctggagggacacccatagggaatgaacaggtacctgttggttctgcttcacaggagatcctacattggtgagaggccaaaattgatgacttctaggcctttccaacaaaacagcctgattctaaggatgggattacagcaattcacactcagttcagctcattaaagcacccaacttggcttgtaagaacttcaggtataaaatcatagtccctggaaaattatctaacccaaccctgagaggaagaccaaggaccagagagaggagggaacttacctgaggtcacctgaaggccagcatcagggccagaatgtaagccctgacctcagtcccactttccctccactgctccaattctttcccatgagtggaaaccctgaggactcaacctcccatcccgtgagccctttggaagatggcacttccataagaaccccttgctgtgtgtgtcaaacagcatctgccagcccttacgttacacactttatgtatctgtttgttgtctgtcctccccaacaagatgtgaactccatgaacgcaggacttgcacttcttcattggtatttcccctatgcctagatcattacccatgcttaacaaatatttgtcaaaggagggaggactcactagggtaagagaggtctttcccaccatccagtgggtctccacacctcctgtctctccattcctcaccatgcccacggcccctggcccagccccatgcctcatttctcatttctactattgaggcagcctccctgtctctatccccgcaacagtccataatgccttaagtatgtttattaaacacaagaattacttcccattaaaatccttctggatatctgggaaaaaatatttgcaaaacacgtatctgataaaggacttatgcttagaatatctaaggaactaagcagcccatttgtttaaaatgtgcaaaagatttgaaaacacttcaccaaaagaagacatcagaggaggcctatgaaaagatcctcaacatcttgtcactggagaaatgcaaattcaaaccataatgaaatatactattagaatggcttaaattagaaaagaaaaaccctgacaataccaagtgctgacaaggatgccaaacctttagacccctcatacgttgctggtgggagtgcaaaatggaccagccatttcaagatagttcagcagcttcttacaaagttatacacacacccaccaaatgacctagaaatcctactcctagatatttaccagagagaaataaaaacatacgtctacatgaagacctgtatttaactgtttatagcagctttattaaaaattccccaaactgtaaacaatccaaatgtccctcaacttaggaatggataaacaaactgtgtcacaaccatacaacgcaatccaactcagcattgaaaaggaacaaactgtgatacacacaacaacagcatggctgaatctcaagaccaccgtgtaacatgaaagaaaaagatacaaaattctacatacagatgattccacttatatgacattctggaaaaggcaaaactccagggatggtagaattgccagggttggcagtgggaggagtagactgactacagatagcacaagggggatgggaatattctatatcttgcctgaggtgatatgtatgacaactacatgcatttgtcaaaactcctagaattgggctgggcgtggtggctcatgcctgtagtcccagcactctgggaggctgaggtgggtggattgcttgagcccaggtgctcaagatcagcctgggcagaatagcaaaagcatgtctctacaagaaatttaaaaattagctgggtgtagtagtgcacacctgtagtcccagtacttgggagcctgaggtgggaggattgctcgagcccagaaggtcaaggctgccataagccatgttcatgccactgtgctctagcttgggtgacagagtgttgacactatctcaaaaaacaacaacaaaacctcatagaattgtatacctaaagagaatgaattttactgcatgtgagttatgctataataagttcaactttaggctgggcatggtggctcatgcctataatcctagcactttgggaggc

SEQ ID NO: 1259 - DNA, 4248 bp, Homo sapiens
cccgggctgtgggctacaggcgcagagcgggccaggcgcggagctggcggcagtgacaggaggcgcgaacccgcagcgcttaccgcgcggcgccgcaccatggagcccgccgtgtcgctggccgtgtgcgcgctgctcttcctgctgtgggtgcgcctgaaggggctggagttcgtgctcatccaccagcgctgggtgttcgtgtgcctcttcctcctgccgctctcgcttatcttcgatatctactactacgtgcgcgcctgggtggtgttcaagctcagcagcgctccgcgcctgcacgagcagcgcgtgcgggacatccagaagcaggtgcgggaatggaaggagcagggtagcaagaccttcatgtgcacggggcgccctggctggctcactgtctcactacgtgtcgggaagtacaagaagacacacaaaaacatcatgatcaacctgatggacattctggaagtggacaccaagaaacagattgtccgtgtggagcccttggtgaccatgggccaggtgactgccctgctgacctccattggctggactctccccgtgttgcctgagcttgatgacctcacagtggggggcttgatcatgggcacaggcatcgagtcatcatcccacaagtacggcctgttccaacacatctgcactgcttacgagctggtcctggctgatggcagctttgtgcgatgcactccgtccgaaaactcagacctgttctatgccgtaccctggtcctgtgggacgctgggtttcctggtggccgctgagatccgcatcatccctgccaagaagtacgtcaagctgcgtttcgagccagtgcggggcctggaggctatctgtgccaagttcacccacgagtcccagcggcaggagaaccacttcgtggaagggctgctctactccctggatgaggctgtcattatgacaggggtcatgacagatgaggcagagcccagcaagctgaatagcattggcaattactacaagccgtggttctttaagcatgtggagaactatctgaagacaaaccgagagggcctggagtacattcccttgagacactactaccaccgccacacgcgcagcatcttctgggagctccaggacattatcccctttggcaacaaccccatcttccgctacctctttggctggatggtgcctcccaagatctccctcctgaagctgacccagggtgagaccctgcgcaagctgtacgagcagcaccacgtggtgcaggacatgctggtgcccatgaagtgcctgcagcaggccctgcacaccttccaaaacgacatccacgtctaccccatctggctgtgtccgttcatcctgcccagccagccaggcctagtgcaccccaaaggaaatgaggcagagctctacatcgacattggagcatatggggagccgcgtgtgaaacactttgaagccaggtcctgcatgaggcagctggagaagtttgtccgcagcgtgcatggcttccagatgctgtatgccgactgctacatgaaccgggaggagttctgggagatgtttgatggctccttgtaccacaagctgcgagagaagctgggttgccaggacgccttccccgaggtgtacgacaagatctgcaaggccgccaggcactgagctggagcccgcctggagagacagacacgtgtgagtggtcaggcatcttcccttcactcaagcttggctgctttcctagatccacactttcaaagagaaacccctccagaactcccaccctgacagcccaacaccaccttcctcctggcttccagggggcagcccagtggaatggaaagaatgtgggatttggagtcagacaagcctgagtccagttccccgtttagaactcattagctgtgtgactctgggtgagtcccttaacccctctgagcccgggtctcttcattagttgaaagggatagtaatacctacttgcaggttgttgtcatctgagttgagcactggtcacattgaaggtgctgggtaagtggtagctcttgttgcttcccgttcagcgtcacatctgcagtggagcctgaaaaggctccacattaggtcacctgtgcacagccatggctggaatgatgaaggggatacgctggagttgccctgccatcgcctccatcagccagacgaggtcctcacaggagaaggacagctcttccccaccctgggatctcaggagggcagccacggagtggggaggccccagatgcgctgtgccaaagccaggtccgaggccaaagttctccctgccatccttggtgccgtcctgccccttcctccttcatgcctgggcctgcaggcccaccccagccaccactgagtccactcggagtgccctgtgttcctggagaaggcattccagggttgaatcttgtcccagcctcagcctgggacacctaggtggagagagtggtctccgctctgaattggatccaggggacctgggctcattcttcttggctcaccaaccctgcaggcctcatctttcccaaaacccactttgtcttggtgggagtgggtccgcgctgctctgcagcaggggctggggagtggacagcatcaggtgggaaagtggagtccaccctcatgtttctgtaggattctcaccgtggggctggaagaaaagagcatcgacttgatttctccaaccactcatccctctttttctttcttccaccactccccaccccagctgtagttaatttcagtgccttacaaatcctaagctcagagaaagttccatttccgttccagagggaagggaacctccctaggtccttccctggcttgttataacgcaaagcttggttgtttatgcaactctatcttaagaactgcccagcctcagctgaaaacccgaatctgagaaggaattgcgtcatgtaagggaagctggaattaagggagctgagccagtcatggttgtggcgtgtgagtcaggagacctaggtttcagcccctctctactgtcagcgagctgtgcaacgtgggcaagtcattgtcctctgagctgcagtttcctcatctgtcacatcgctacagacaagacctccctggaacccttctgattgtcttagacactgtggttgcaaaacccacggaaagcctcatttgtgtggaaagtcagaggaaaaatgatccagtggacacttggggattatctgtcattcaagatccttccttcaaccccaaggtcagctcccatctcatttccagaaaggctcatacctggcttgcagggaagcatctgtcttgtcattccaggtgccagaatcctctcagagtcattgaagggtgttcacccatcccacccaaggcttggcacactgccagtgtcttagcagggtcttgtgagggctgggggcatccaggcactcagaaggcaaaggaaccaccctacccatttggcctctggagggggcagaagaaagaaagaaacctcatcctatattttacaaagcatgtgaattctggcattagctctcataggagacccatgtgcttccttgctcagtgcaaaactgatgattctacttgctgtagatgaatggttaacacgagctagttaaacagtgccattgttttgccagtgaagcctccaaccctaagccactgggacggtggccagagatgccagcagcctctgtcgcccttagtcatataaccaaaatccagaccttatccacaacccggggcttggaaaggaaggtattttggaatcacaccctccggttatgttgctccagtaaaatcttgcctggaaagaggcagtcttcttagcatggtgagctgagttcatggcttttttttgtagccagtcctgtccctggccatccatgtgatggttttggatggagttaaacttgatgccagtgggcagtgcatgtggaaagtatcagagtaaggctctcccctccagagccctgagtttcttggctgcatgaaggttttctttagaatcagaattgtagccagtttctttggccagaaggatgaatacttggatattactgaaagggaggggtggagatgggtgtggcagtgtatggtgtgtgatttttattttcttctttggtcatgggggccaaggagaaaggcatgaatcttccctgtcaggctcttacagccacaggcactgtgtctactgtctggaagacatgtccccgtggctgtggggccgctgcttctgtttaaataaaagtggcctgg

SEQ ID NO: 1260 - protein, 516 aa, Homo sapiens
MEPAVSLAVCALLFLLWVRLKGLEFVLIHQRWVFVCLFLLPLSLIFDIYYYVRAWVVFKLSSAPRLHEQRVRDIQKQVREWKEQGSKTFMCTGRPGWLTVSLRVGKYKKTHKNIMINLMDILEVDTKKQIVRVEPLVTMGQVTALLTSIGWTLPVLPELDDLTVGGLIMGTGIESSSHKYGLFQHICTAYELVLADGSFVRCTPSENSDLFYAVPWSCGTLGFLVAAEIRIIPAKKYVKLRFEPVRGLEAICAKFTHESQRQENHFVEGLLYSLDEAVIMTGVMTDEAEPSKLNSIGNYYKPWFFKHVENYLKTNREGLEYIPLRHYYHRHTRSIFWELQDIIPFGNNPIFRYLFGWMVPPKISLLKLTQGETLRKLYEQHHVVQDMLVPMKCLQQALHTFQNDIHVYPIWLCPFILPSQPGLVHPKGNEAELYIDIGAYGEPRVKHFEARSCMRQLEKFVRSVHGFQMLYADCYMNREEFWEMFDGSLYHKLREKLGCQDAFPEVYDKICKAARH

SEQ ID NO: 1261 - DNA, 35076 bp, Mus musculus
  misc_feature (1)...(35076): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacacacgcatgcatcacaaatggagggtagttaacgtgtgacctcatgtacagaccactttgcgcgttccaccctattactgtagccctagatggaaaggcagtattagccatccagcctacctggcccgggtggaaaaggtgtccaagacgcagagataattaaacagaagcgcaaaggggaatgcagccccttgataaaatgataaaggatgcagaaaaaagagctggagccaatccatcctgaatgtgaggcccactgtccttcctagagtccctaagtggtgcccttgtgaaagggaagtcacaactgggctctccgtagcctttttataggatgtagaaaggcctgccggacaaaatgaaatggaagcactggagataagcaatgtaaaggttggcttcccaacagaggggtggagccatggaaaccaaagtatgcaggcattctctcccctcgcagtgtttactgaaaagtcactctcagaggctgtaccctgcaggcagtgtggcatattatcttctttccggccattacactcttctatattttcttcactaagctaatgagaaaaatcaatggttgtggacagaaaggcttaggaccaaaggaaggcagaaccacaggacaaaaaaataaaactcctcttctcaactacttcttttttttcttattgttttttgggggtgtttatttgtttgtttgtttgttttgtttttcgagacagggtttctttgtgtagccctggctgtcctggaactcactctgtaaaccaggctggcctcaaactcaaaaatccgcctgcctctgcctcgtaagtgctgggataaaagacgtgtgcccccacctgccagcttcaactacctctcttagagtgacttttcttccagagcaacatcacccctcccaagtcacgaacctattgctgggttagtttattttctgccctttataagcaaagcaagagatctacaaaggccaggaccctgtttcatttattacaacatctccagcacacagactagggataaaaatatgctttgtattcaataaatatttattgaagttaagtgccacgcaagtgtgggaggaaacatttttataaaatcttttctttgagggataggtaatgtaaaagagacttccttaaagcaagagtgagaagccatctctaggctagttgagacctgtctgcttagcctggacatcgcaaggaggtccttacccagccgggctcaatacatttgaggagggcgctgtcgcccccgcgctaggctctctggtgctggagaaagaaagaaataaacacctccagagtcttactctcacggatctcagttccggggaagacaggacaataaataaattcagcttaatgagaacttatgaagaaaaataatcagaatagaggggtggtctgcgttttattacaggataccaggttctggatatctgtgtctctccttgaagcttaatcctcaaggtgatggtattaaggggtggggctttggagatttgacaaggaactctctgccctcccgtatatgattagtgtcttacaaaagggcttaccagaacttatttccactccatgaggctgcagtgacaggcgccatccatgaggaactagccctcaccatagaacctataatactctgatctcaagcgtcccagcctctaaaattatgggccaaatttctattattcagctccgacacaatgccacataaaacatgctagagttagagggatctgagaacttcacctttaactcagcacaaccgtgccagcaattcactctgccaatattcacctctcagtttctattatgccatttgtatcgctgcatacacgtctcatggtgtctttgatcttgtttgtattttgctcggtcaggccttagggctgttgcttacgcttctccattgaatttgctgctacaacacgttcattttttcaaagacgtgtgtgtgtgtgtgtgtgtgtgtgtgtgtgtgtgtgtgtgtgtggcccacggaggccagaagaccatatcagttcccctggagctagagttaaaagcttctgtgagccatctgtcgtaagcactctccagtatgacacattcttcactcttcagccatatctcatatacaccctctccttcccatgccttctttctctcattcttacctcctcctcttactttatttttttttaaattaatttgtttattttatgcgtacactgtcactatcttcagacacaccagaggagagcattggatctcatgacagatggttgtgaactttcaaatggttgctgggaattgaactcaggacctctggaagagcagtcagtgctcttagccactgagccatctctccaggcccttctttttgctccttcattataacctttgatagcattaattattcctaaaatctgggcagcctgacagcgtcttcatttcctctcccaactactttacccacttcgtgggttttgtttttttttttattttcaaagtcattctaatacataaccccccccccatttccctcctcctcctgatctgatgaactaaaacctgaagaagcaccacactatccttggtgtttctcctctaacagttatggggtcactcattgttaacttgcttgtatggcagccccatagtgatgacaacctagcgtatccctctcagggaataatacagagctcacagcaggcaccctgagcccctggactggggaattactttctaagctacacactcaacactaccacacccaggtcctccttgagccctgcaagtatttcatctgaaagcccagagccgggagctagagagatgtctccgtggttaatagcactttccaaacgaaactaagttcgattcccagcacccgtatggcatttcacaaccacctataactcagctccaagaattagacacctccttctggactctctggacacacatatacatatagcattcatacacacaggcaggcaatatatccatacacctaaaaaaattataaataaattaattaatgattaaaagccaaccaaccaatcaaccaagggtctggcaagattgctcagcggttaagagcactggatgttcttccaaaggatccaggttctattctctgcatccacctggaggttcacaactgtctaaaactccagttctaggggaaactgacaccttctggcctccaaggtcactgaaatacatgcaaggctcctatatacataataaaaatgataacacaatacaaaccagtaaagtcgaaaaataataaccaagcaacaaaactagcatcaggtatacaaatcccaacacagtgacatagtatgacacagttatgacaacaaaacttctctaaaagatgttaaccctctagtaagagcatttagtgagagtaagttgaacccacccaaagaactcaagctaaggattgcaaacatgttcaaaggcacagacagctgaataaggaagggatacaggatagaaggatccaataatgagacagaaatactgaagaaaaactactctgagatgctagaagtgaaaaacatggtgaatctgtggaggcttgaatgaaaagtcacctctatagtctccggtgtttgaacacttgatcagaatttggtggtgttgtgagaggaggaataggaggtgtggccttaacggtggaaggtgtggccttaatggtggaaggtgtcacagaaggtaggctttgccacattccttgctttttctgttctgtgcttgtggttccagttgtgagctcttaacttcctgttcctgcccgtgtgtccgccaattgctgccctgcatcacctctgcagtcacatactcttatttttctggatccgtaagccaaaataacccttttctttctaaaggtgtgttctgtctctgtgagttccaggccagcctggtctacactgccaattccaggccagccagagatgcatagtgaggctcttgtctgaaaacaacaaaaacactaacacaaatagccccgtgggaaacctcagagacaggacagaccaaggagaggacagaatgtttgatcttagagacacctgcaggaactagagcaattcagcaaggacaacggtgaagagacggctcagaggtgaagacaggcactgactgctcttctagaggtcatgagttcaattcccagcaaccacatagtggctcccaaccatctgtaatgagatctgatgccctcttctggtgtgtctgaagagagcgacaatatactcgcatacataaaataaataaataaaccttttaaaaaataagaagaaaagaaaaaaaaagtatgaatgggagttccaagatctactctaaagtctaagacaaactctgtgggctacagacatatgaggtgaagaatcttatcctaaaggcttagaaaacagtttcaaaagaattgtgacaggaaaggcccccacaggtttagggagattgaggaagtagatacaggaagcactagacaggaagaccagaaaagaacctcccctgccatactgtatttaaaacactaacatggaggaccataaaagaaaaaaaaaaagtgtatttaaagtgcaagagagcatcaccacaccacatcacctgaacaggcgcgtccctctgaatgaaggtaggctgttcagctgaaacttcaaacgtcaagagctcacaatgatgtatttcaaagtctgaaagtactctggtactgcacccactaaacctacgtgttctagctaaaggaaaaataaacactttctactgcaaaaacagactcaaagctgggcagtggtggcgcacgcctttgatcccagcactccagaggcagagacaggtagatttctgagttcgagaccagcctggtctacagagttagttccaggatagccagggctatacagagaaaccctgtctcaaaaaccaaaaacaaacaaaaaaacaaacaaacaaacaaaaccagactcaaagaacacattaccactaagccaggtctacagaagacctggaggaatctttcagactgaagaaacaagtccttttgagaaatcataaaaaagaataaaccacactagaaaaactgttaaaacaatacaacaaccactataaaaaccaggaaaatggcaggagccataactctgagtaaccaagggtgaccttgaatttgtgatccttcctgggctgggtttatgggtgggttctgccatggccagtttcgtgtgactctctggaatgaactctggacttcatgcatgctaagcaagcactgtaccaactgagccaacagccccaacacaccccctttaagatatttcttggtgtgactagaaattgcttaattaagaaacagattgtcccggataaccaggagtgggccagattcaatcagtttaaagggttcagagcaacactgaaacttcccccctgaaaagaagaaattccaccggtgggtagcagcttggccttccaaatgaaaagtcccagcttgatctacgggtttcgaacttgcacagcagatccctaacaaactaattcctaacaaaaccctcgtaattcatatctcctgctggttctgcttctcagaatgaacccttattatgccacctgggtcctacgtagcagtagttgggagatggaaagacagcttggtttcttcaaagtttaatagcgtgagatgacaaagcctcagaagagccaagcacacacacatacacacgcatacgcgcgcgcttgtaaagagacgtttaaaaactggatttgatgttcaaaagagattttgacaggcttagggaggaagttaaacgtagagtgaacttaacgataaggatcagggctgctggggttaggatagacttggtaaacactgtcaagtggaaaaaacgactttccaggaggcagaagcgaagcaagccaagccaaccccgaaaagcaaaccatcctcagcacgcaagcgcgaacctggaaagcagaaggccggtctctcaggccccgcctctcccaggccgtgccaggctctgcaatcccatgcagagatcatcgctctagccaggctgcaaaaatcgatctcagctcttcctgagacccgggcttgacgatggcggagaagacgcaaaagaggtacgtgttaacacctccgcaggagcagaacccgtttctggtcgcggcgtgggggcactgagacggtgtataggtggatggctccataatcccatacctggcgtccgtggggtgtgggggcggagagggtttgttccgtgacccccacccatcccagcacgcctgcgcagactccattggggctgcgtgggggactcagggaggctgagggaggttgtgcgggcgagaaggctgctcagcggtggctgcaccgtcggccctgcctctgatcaggaagagggaggcctggaagaagacactgatgctgtcatccttatgtcagtgcctgagagcccagggccggcaactatggcttttcctgtcacagtcttcaccagtgagagccgttggtgggaagagaccgcatggataacagaaaagcatagggattcatttgccgttgcctcctttgtcctgggattaatgtcttgagatatacatatacatatacagctgtatgtatatgcatgtatcggtgttaaggtgtgtgcgtgtgaatgttgtctctcaagccagaagagggcgtggatcgccccggaaacaagcattcagttatcacaggacaaagatctagagagacagggtgtttctgggcaactttctcggctcagaatcgagaatactggtatcagaacagtgacgccccaggaataaactttgctctaagaactttctggtatgcattatcatttgatggtctgtagaaattctagggttagtgtcctgatgagttctaactgtcagcttgaaacaacttagagtcatctgggaagagggaacctcaattgaaggatcgtccatgtcggggtgagtgtcttgatctgtgattgagatgggagggcccatcccactgtgggcagagccatctccagtcgggtaggcctgggccatttaagaaagctacttagcaagtgggccagtaagcagtcatagttcctgccctgagctccctgggcatggtgagcaggaagtgtaaggcgaataaaccgtctcctccccacgctgcatttggtcatggtctttatcacagcgacagaaagcaagacagaacagttagaatactgttaagaaataaaatccaaagctgttttgttaagcatttaaaagtatatgtgattttggcctaataggctgtgtgccacttaagaagttcataatacattaaacattcttaccactgacttgctatttttccatgaatctcttaaaacctttttcttagctacagagtcagcatggctgtattaaaaacttttttttcatattattttttggtggtgtgaatgacacagtctcctataggctcatgtgtttgagtacttagaccccagttgatggtgctgtttagaaagatgcgcaagcacactcgcacttgtgagtgcatgtgtatgtgtgtgtatgttcttgcttgcacatgcatgtgtgtttcaagctgtggtgtctcagcttcctggtttgctgccacctgctgcctggctcctcacaatgatggactctcatccctctggaatcttaagccacaataaattgttgccttctgttgcgcgcgctcaactggccaggaagaacgacgctacaacaggatccttctgcacacatttattcagtcctgtttcttctttctccatatatctcccttgtttatatctcccttgtttttatatctcccttgtttttatatctcccttgtttttatatctcctgtttatatctctcccttgtttttatatctcccttgtttttatatcttcccttggttttatatctcccttgtttttatatctctcccctgtttttatatctctcccttggttatatctcccccgaaccctgggcctctcannnnnnnnnnnnnnnnnnnnggcccgcacactctgcacctaacacatgtgccaaacacaaaacacacacacactataacaagcatacatcccagggctctcatccccgctcatcttccctgaagcaagggatagatagccagaggggctatctctttaagggaaattcagggatcaaaaagcgtggaaagaatatcatgtcgagctggtatcggcttctggaataccgaaaggatctcccatcttggctccatcgtttgtgcttgtgggatcatccaccacatccacaggggcaactggatcaggacgctcattcttgcagtgtctcaccaatctctccggcacccaaagaggttccctctggtcctgtggaaacacacaaacagaccctctcgcccacgtcaacacctgatctactcgatcctctccaaatctccagacagaaggtccacctacaggtggctgctgaggatgcatagggaggaggcacagaagctaattcgccttcctcctccacctcggctcttttgtttcgtcctttctgttcacctgattttactgtgtcttctttttcctttttctttttaagcccttctccttttccgacatactttcttgttgctctgtaaggattttctgacctgtcttgactgcctctacacacaaacagtaacagagtccatatatcagaacaaacaagaccaaaactannnnnnnnnnnnnnnnnnnncacttgttgcgcgcgctcaactggccggtagaaacgacgctacaacagggatccttctgcacacatttattcagtcctgtttcttctttctccatatatctcccttgtttatatctcccttgtttttatatctcccttgtttttatatctcccttgtttttatatctcctgtttatatctctcccttgtttttatatctcccttgtttttatatcttcccttgtttttatatctcccttgtttttatatctctcccctgtttttatatctctcccttgtttatatctcccccgaaccctgggcctctcactccttttatactctcatccacgcacagcaggccacgccgcctcaccaggcacgcagcctcagctaatcagggcagcaggggcaaatctccaccaaattggattcacctgtatcctggtacacctgcccagcactcaagatgtttgtgtcttatatgaggaagtcaggtgcaagtcatatgacttagctgcagtccctggcgcctttgggactgccgccacacccgctcctaacagccttctacaaattgctctggttacggtgtttcatttccacaacagaaaaggaatcccttcacattgattgattgatggatgattaaatgtgtttatatgtgtgagagtacacacatgcagtagtatacttatggacacttatggaaattgattctctccttccaccgtgtaagacccagggattgaactcaggtgggcagacttggcagcaagcaccttcctttatcagcccctttctccactgagccatctggctggccccagcataccttctgtaacattatatttacattttaattttatttccatgggtcccaaggctctgaatgggtcactgggcttacacagcagggctttatccatggagccttctcacccaccgtccatactttcaatgttgctcaggatgagtgttctctttcttcctacagtgtgaagattgctcccggagcagtagtgtgtgtagaaagcgaaatcagaggagatgtaaccataggtaagaaaatggttgatgtttctcgagagctaatgctggataaccgactttagcgcttctcttttcagtccagttgtctgtgtctgttacgctgaggcttacaatttttattggttttgttgttatttgttttgttttgagtttttcgagacaggatttctctgtgtagccctggatgtcctggaattctgtagaccaggctgggctcgaactcagaaatccacctgcctctgcctcccaagtgctgggattaaaggcgtgtgccaccactgccagcatttgtttgttttttgagacagggtttctctgtgtagccttggctgtcctggaactcactctgtagaccaggctggccttgaaccaaagatttacctgcctctgcttctgcctcctcagactaaaggcttgagccaccaccacccaacttgagttagcttgttttaaagagctttcctgaacattccacacagccattcacccatgtgtctcataacaaggtagctgatgctggagccgctacactggtccccatgacatcagggttcccccggcaaggagaggagagtgacagttagtagttgtatcgcaggcagaataggagtgtgaagtgagagcaaggaagttttcagttagtaccctcagctctcaccctgtagtctggccagtagttccatcaccaagacgaaaccagcctgcacatgcgggtaacttacatgcgagtccccggtgcctcatctactacccagtcctgtttgtaaggtctgtttcctgagcactgtgcccctgcagatttaactgatgggcactcatccttagtcacagctgcctgtcacctgcacagacacagcagcacttctattctcacataccaatggtttcttggtttggtttggtttggtttggttttgggtcttgagacaggatctcagtatggagtcctggctggcctcgaactcatgagatccagctgcctctgcttctgagtatgggattaaagtgtgcatcatgaggcctgacaatagtttctttaatggggggggggggggatgtggagaacgccattttccctggaataagtcgaggcttccagccagtggcctgtcttacgagaccagtgaagaccatgctactatggcggaacttcgtttaaaacgtgacctgttgagtgactataggctgacaggatgtggaagatgattggttcttttctgtgctcttaacttttgtcttcactgcaaactttgcatgatttctcctgcatgtcacagtgtcctccatttctcgccacctgcagagtgtatgtggctctcatcaccactcaggaggaacacaagctcacagctgttctgtaagtagaagaaaaggcagactaaagtcatatgtgcccttaactaggaacacttcccttgggttccttcctctttctcattttaagtagtttatgatatgtgctatatagtacatctatagagatggtggatatacccacagcattagcacacagatgtatacttgaaatggccttacagaagcttgcggaaactgtcagaacacaaaagggaagaatggttgtgacaggctcatcacagctttaaagggattcaggctgtggcagctggaaaggcctgagggcgagagctcccctcagggtataacactgccttatctgcactcaggagacaaagtgggcaggactaggaacggcaaggctcagcctcttacagatttccccagactgtaagacagtgctgccagcgagcccatacaggacttttcacactcagagcccacaatggcccctgcctagggctctgctctagataattatttctgtcactgttgcacttagcataaaatatcttcactttttggcaagtatttatttttctgaaataacacctcggatgtaaaccctcctcctttataaacactattataaagtttaatcagagccaagttacctggttccagctctccgaccatgtcttgcttttccatgtcaagcttttctttggttttgctcgggttcctggagtaatagttgtaaatcattcctgttgtctatgcagttggcagttggaacttgataaactactccccagagagttggggagcagtaaacagaagtgtatggggtgccccacagacgtgtgtgtgggtgctccacagaagtgtgtgtgggtgctccacagaagtatgtgaggtgctccacaggagtgtgtgaggtgctccaagaagtgtgtgagtgctccacagaagtgtatgtgggtgctccatcgaagtgtgtgagtgttccacagaagggtgtgagtgctccaagaagtgtgtgtgggtgcttcacagaaatgtgtgaagtgctccacaggagtgtgagtgctccaagaagtgtgtgtgggtgctccacagaaatgtgtgaggtgctccacaggagtgtgtgagtgctccacagaagtgtgtgtgggtgctccatagaagtgtgtgagtgctccacagaagggtgtgagtgctccaagaagtgtgtgtggatcgcttctcggccttttggctaagatcaagtgtagaagtgtgtgtgggtgttccacagaaatgtgtgaggtgctccacagaagtatgtgagtgctccaagaagtgtgggtgggtactccacagaagtgtgtgaggtgctccacaggagtgtgtgagtgctccaagaagtgtgtatgggtgctcaatttaaggactgcccatctttttacacttttattagtttgaagagggcagggttttcttttcctgtgtttcaagttatttgaaccttacactggatctgtggttttctagaaattgatttatttgttctaacagtgaggctgactagaagtatgaagccaggtgtgtgttctgtcagggctgcctacatcctactgtctcagaatgggggtgtgtgggtggggctgtgacagaggggctgttgcagggggtaaatcatagaagtccagccctggggaggcacaccgccactggaaggtgctcagactgagtcctgctcattttcataggatcaaacttgttttctattagactgttacaaagtactttctgtaaatcctccctctgagagttggctggcatgtaacgtgaggaaggccccaggggagccccggcccacgagcttgtgaggacagacccccatggcacaagaggagcagcccgggcacagtgggacactcccacctgaccctgtgaagtccagggtggccttgaacttctcaccagcagagctcaccccaacccagagcctctgctggggtcaagggagtggtgtaattttaaaaagaaagagcttgggtttatttgttgacatatgaaaatgtatgcagagcttgcaaaggtgaagagcgccctttaccaaatgaggggaaaggaggcatgatgcaggaatgtcctcctggcggggctctggaagcccagccagcggtttagaaaaataactcatacgccagttaagggagctctgactccagacacatttgtccaaacaaggagataaggcagagaggctttcagcacactcagtaagaaagtatacaaaccgccctgccaggagccgcgccaagaaggtccactcggagtcaagtgggaaaggggactcggcatggggacttgtttttaaagagcattttagctttaagacccctacacatggcctaagtcagactcgttctaggtagaaggtttgtggcacccaggaggagattgtctggtaggtgtcatgccgcccgccgctaaggctgcccggaaggccaggccctctgtcccaggcctgcagtgtgaaactgcacacagctgtgccttcttcctgttctccacaccacactcttagctgtcacatgtgctctgtgctagcctcactcgaggggctgtgcagtttcttgcgcaccccctcccactgcctccccaacttgctttcatctctcaactcaaagcagattggcttccctctctatttcagtccctgtgcgccacaacctgcagttggggcaggatgccagcaggtggcagtagtgtcaaaaccaaaggcctcacctaagctgtccatgtgctagctccaagagagcatccctgacatttatacccagttctccagttaccagttctattagtaactcacgattaataaataataatgacagcaagaaaacatccgcttaaactgttcagatgccgggcaacagagagtcagaggcagatgcacctctgaatttggggcagccaggactacatagagagacccttactcaaaaaaatactcattctgatttgattttgttatgtaataactttgtttcattttacttgttttgtttttggtttttatggtttttgtttgtttgtttgttttgagacagagtgtcatgtagcccaggctagcctccaactggttgtgaagtccaggatggccttgaacttcagatcttcttgcccccgcctaagtgttgggattgcaggtggcaccaccatgccaaactgtgttttgtaaatagaagggtggtatgtgnnnnnnnnnnnnnnnnnnnncaagtgtctccagggagccctttgtcatggatttttaaagaaaaagtagcattgtcatttgttttcagaggtacacggaagaggaatgttaaaaaagaaagacaggccaccagtgccaggggctcctagtcttcagaatacatccttaggtgggcttctcacaaattgtgcttgtcacagctccaacttaagggtcagcaggaggcctggtgcctctggctgcttacccagctctgaccagaggtctgctgcctgtcatggctccaatgatctccatgtcccacttaatcccttaccaagcagaagactctcctgtagttaaaagctgttaccatgacacctgaggaaaggagaaagcaggccctgctctgtcctcaggcctaaactacccactttgctcagttttcaggaattctgagctcttcgtgacacagtaaccttgtcgtttttaatgtcttcctgtatatattgtgtgcatccaagagcatggtcaggggtcagggtcaggagtgggttccagcgtgtgggtctcggggatagaatttggttcactaagcttggcagcagtggctttccttgctgggctgtcctgtcagcccctgaatctctccttcagaactgcaggtcagatcctgtgacatctctttcaaacagtgttgtaacccacgtttcccgtcctgttacagatgtggaaacagcccttgagagaacataagcacacacattgcctatatgtgatagagaccagagtctagactttctagactaggatgggtacaggctggggctctaattacaaagaccctaacttagactgtggcccttggagtattttgaaacaaaatagaaatccgtattgagtgagctgtaggtctccttgggcttgtaccactggagggtgtagaacttgttatctcagaagaacccaggactggtgatggcattgctgagcacctggagcctgtgatgcctaagtggccatgctgaggaatgaggtaggtaaatgacagtgtattgatgaaatgtgagatgcgctgtagccataaagtgttcgaatgcttttctccgagttttattttcaagcttcttactgattttgtatgtgctggtgtttataggtctcaagtatgccacagtgtttagtctgtagtagcttttccctgcacttagacagtcaggcccgtaaggagtaggactcacagacaggccccaccattctgtgcttgctttattttaatttttagtcgtgattgtttatttattttatactatttgtgtgtgggcatgtatctatactatacatatatgtgggggtggggtgggtgtattgagaatattctctcccaaatagcaaggctacttgtgcagtctcatatgcctgtgtgctttgggactccatgccctgttttgggcccctactctctttatcagttcccttggttctttatctcaggaaaagaatgagctgcactgagagcccatccagagctccgctgctcaccttggaggcttcggatctgttggggattggttctaattgtgaatctgtgtgtccaaacgctgaaggtccttgtccccaattggtttttgactgatcagtaaagaaccaatggccaagcttggcaggtagactgaggcaagacttttagagttgtgtgggctaggagaaaacaaagaacaaagatggctatgacagggaagaagaaagaccagacctaaaggcctggacacgtgagaatcagggagagtggccacatgagccacttccccaattgtgtttggggtagcagagatgaaatataggttttaaaagatttcaacacagaaataccagaggggggtgtttgctagcagcaggaaggataagaactgcccagtcattaagctagtcaaggcatattaaaattacctggtgtgtgtgtgtttcattcgagaatccagatagctcttgggcgggtatgtacatgtgatcgatccgtcaggaacattaagcagtttaactatggctacgcgtatctgtttcatagaattgggtgggagttggtgcactaagtaatcccagttgtcaggacaacttcaaaggggcagagatagcctgtgttctgtgttcggggcgtgtgtgtgtgtgtgtgtgtgtgtgtgtgtgtgtgtaagagacgttggcattaggaatcccatgcagggccttgcacacaccacctatgctcacgctcaccaactgagctgctcctgctcccgctcccgctcctgcagtctgtttattcctctgttgccctttaacatagagtgttgcatcttgccttttataagcagatagtgactgtttatataccacagattaacagtttataacacagaatcctggaaagtgacacctctgcccccttgatccttccgtccaccttcctttctgagggagttacttctcatcactgtgtacaaataaaaatagcgttgagtgacccagcactcgggccaggcagagtccaacagcaggagatagagtgggatccttctttagaaaacaaaacaaaaacagaaagaaaaaatagcttcaatcctacgataagagtaggtgggtgtgtgggtggaggaaggtgttttctcatcagtgggaggtgggcgtgtggccacttcctccagagccacccagttctcagaagctgtcctccttgtgcccttagattgagactgagctgtctcaggtcagtgtcacggctcagcacccacctctggctcctcttgcctccctccccttgggtatgagaactgtgcttatcatgccctgcctgcttgcagttgctacacacactcagatgatacaaagaggctgaaggcgggcggactctgtgtttcctgacttctgtgcacctgtgtttttcttaatcacatagaagcgcttgctgcgttataagcagtgtcaggcccgtctgaaagcaaggacaagaattagtgttatctctgcccacgtaccacacactgtctccacactctgaggtcacaggcggttggatggaggctgagctgtccgctctgccgtgtgtgccctttcacttccctcggctgtaggtctggcactaactgctgctgataacagccggagatagtacctgtacggtactcagcacggtgcctggcacggccttagaaaaggttcctccccaagcttcccccacctccctcacctcccacctcctgctggaagtgcagcctgccctgatcatctcctctcccctgctctgctgcacaggcccgaggacggtgatccaccctaaagcacgaattatcgcggaggccgggccaataatcatcggtgaaggaaacctgatagaagagcaggccctcatcataaatgcgtgagtaagactcgagctgtgctccaaactggacggcacggggaaggtttcccaacatcggccgctgcccaggagcctcttacagcttagctcaggaaggagtattctttctgagcaagagaagggggaggtttgaggcctggttagcattaagtacatgagagacacagaaaccagaccagaaaacactgagaaaaacacacacacacacacacacacacacaccagccctgggtctggtgatctcccagtgggatacttggatccatcagcaaacctgtaatggtttcctgatcccatccaacatccctgtgttgtgcttaccatacctactactgttttggttggatttcttttgatgtctgtatgtgaatttaactctgttttgccatattccacatgggaagcatccagaattatattcacaagtatgggatccttgtagcaatttgtaaactttaaagataacaatgtgagaaactgttaatgtatacctttgtgcactgagctacaatacccaggatattttcgaaagcatgtataaatttttctagataaaattttggcaagaaatttaagcttttacctaatttgtagcaacaacgtatggaatttgtgtgggaaaatatttagctgtgataaaagggctgatttgtctgacacttacacaggacatgtgggagtttctgacggtgtgaatccatctttcccagtattactatcctccatctttggcaccttggttgtgagatcattcatagcagcctgtgaatcagcagagatcagctgtcagctaaagctctgctctaagaggacagctttatcgtccacatatgtcactaaatacccatcgctccgaagagcggtttccatttcgcagttgcaaatggttattacaaatggaaaaattccacgttaggcctgattttgatccttctctagcaggctaaaagtatatttattgtttgggggtttgctgttgtgttttacattgtcctagagaactgtcctctgaacataatttttcttttattggatattttctttatttacatttcaaatgtgatcccttctcccaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctataagggtgctcccccacccacccactcccgccttcccaccctggcattcccctacactgggaaatgtcctctgaagttagaatttaagaaatgaaggaaggctagagaagtggcttgacagttagcacctcttgctgtccttgtggagtccttgagttcctgtctcttcactcacacagggcagctcgcagtggcgtcaactccaggaggtctgatagattccccgtcccagttctctctctctctctctctctctctgagacaggatctctctgtagccctggctgtcctggaactcacttcgtagaccaggctggcctctaactcaatcatctgcctccctctgccttcctaggattaaaggtgtgacaccttcttctgaggttgttttgttcttgtgacttctcacatttctgtagttatgttcaacttaggacctagcctttcccagcacagaggggatgtggagcagttattcccctggctcaggacctaaccatgcatcttaagctaggatagccatgcatctaagctaggatagccatgcatctaagctaggatagccatgcatctaagctaggatagccatgcatctgagctaggatagccatgcatctgagctaggatagccatgcatctgagctaggatagccatgcatctaagctaggatagccatgcatctgagctaggatagccatgcatctaagctaggatagccatgcatctgagctaggatagccatgcatctgagctaggatagccatgcatctgagctaggatagccatgcatctaagctaggatagccatgcatctgagctaggatagccatgcatctaagctaggatagccatgcatctaagctaggatgccatgcatctgagcttggtgcaggtaaaactgagacagctgattcagattctgttttgttttggttttttgtttttttttgggggggggggttggggggcttgtttggttggttggttggttttggttttttcaggacagggtttctctgtgtagtcttggctgtcctggaactcactctgtagaccaggctggcctcgaactcagaaatctgcctgtctctgcctcccgagtgctgggattaaaggcgtgcgccaccacgcccggcttgattcagattctgaaaggggatgacagctgcttactgtgtcactggcctttggtgattctcgtctcttctctttatagtcatccggataacatcatcccagatactgaagatacagagcccaaacctatgattattggcaccaacaacgtatttgaagtgggctgtcgtatcctttgcctcagatcacctccagatgtgtttggtgcctagactgctccctgtatagaaactgacataccttatctatcccataggcttaaaatatgtatagactgggccatcacgctctttaaacaggctcattgctgtatgttaagaaatcttttctaggggctggagagatggctcagcagttaagagtactagctgctcttcagaggaccgtagttcagttcttagtatccacatgggtgttcacaactgtctgcaacttcaatctgaggggatctaaatccctcacacatatccatgtaggcaaaacaccgatgaaataaaaacaaatcattaaaagaatttaaaaaaaaaaagctcttttctaggaaagaggagtcgggaggagggagataataataaaggcaatacgtcctttctgggactggggctgtagtatagagcacatgagtgccatgtgtttaattcctgtcactacagaaaccaggaaggcactcctggtctggcaagtcactcggtaaggtaaatactcacacacaccaaaccatacacactatatacacataccacactcatacataccacacacacacacataccatacaccacacaccacataccatacaccacaccacacacacacataccatacaccacacaccacataccatacaccacaccacacacacacacataccatacaccacacaccacataccatacaccacaccacacacacacacacacatacgatacaccacacaccacatatgcataacacacacacacacacacatacacacacgtcttcagctctttgtaagtcctttcctaggaccatagctcgctgacaggtaaccttggatgagggtgtcagacactgagaacctaattctagctttagtttgatgtaaaagctggcaaagtggctcagcacttgccaccaagcctgactatgtgagttcagtgtcccttctcccccaacccccatggtgggagaagagaactgactccctcaactgtcctctgatctcaacacacacctggcacacatggatgcacaaattcccacatacgcacaataagtaagtaaatgtaataaggtatttaaaggcacaggggtcatttatttgtgagtggagatatttgtgtttgagaattaacgctttgtaagcagagactcttggcaaggcagagtctgtgcaacccttcccacacctctgtcacagtacactgaggacattccgtacacatgggaaaagtatttacacttaactggggcttacagattcccaagccatgaaaatgggagacaataatgtcattgagtcaaaaggtaagctgtgtccaggcagctccggggtcagagtgattccttcctttctcatcctgtctcctgggaaacaacctaagtgcaagcaaggtggcatgctggggttggaccaaagtcattgtcaggttaatcctttgcctgggaagaacctaacctagttatgtggttatctgataacgtggctaactacattaagtgaaaaggacagccgtgtactgttaagttggggctggattagagctccattgaaagatctgagatggcccccagccgactgtgtcggcgttgccatagctgatggcattcttgcagaatgaacttgccagtggcagctctgccaggaattgctttctttaattttgggactgctttgctctagccagagacaaatgtcatctgcttatcagaattagagccaggcagggcatcatgggaggtccccagcacctctgggaaccagctcccagagctcgcctccctgccctcggagggaacactgctttgtctttcctgatcctgactgacaggagggaaatgctgcttttttaataacaaaagtatactttctatgaatttgcttactagtttttagatgtcattactgcgagttatcttcattgttggccttttctgtatttctgagtgtcagacgtgtgctcttggcactatacattcattaccttattggtctttaaagggagcagaacagtaggatggatagactccccgctcagaggtcttttaccctggtgagccctatgccacccggcctgttagcaagggacctgataaatcctccgcacccacgcactgcctgctcaggtctgcgtctgtgcactcactgtgagacgtttcctctctgtatcttctttagacccattagcattttttatacctagatcatagtggggaagcataaacacagtgaggaatgtccatgctttcttgatgtcttaagctgtaactgtcttggctgcagcctacgtgggcaggaatgtcatcctgaccagcggctgcatcattggggcttgctgcagcctcaacacctttgaagccatccctgagaacacggtgatctacggcgcggactgcctgcggcgggtacagacagagcggccacaggtactaaaacctctctaacaggagcccgtttaggaccctcacttcccagagttccatgtgactactgtctcagtgggcagcaaatgcttaggggccaagggcgtggctcagtatgattggcatacaagggccatccccaaggcaaatgaatcagacatctgagaaacactcttcaaattttggtatttgcagttcacagttctttagattaaaatcatatatatattgtatatatgtctcctctgtgcatgtgtgtgcatgcgtgtgcatgtgtgatactgacgggcagataatggaggaggaggaggacctggagttgtttttccgtgcaccattgaccctacaccgaaatgttaattccttgactcgcttccaaatataagtcggggatgaggcgcagccctccaaacgtcccgtgggttcctagcgtcgtttatgaaagtgccatggctcgattataaacacagcttaggaggaaaggagggatgcttaggtatttatcaggcttacgagcatcaccccttcctactcactcagatggaggctaatgctagactaggagatggaggctcaggtgctggactccctagacatgaggctctcacactggggtttaaagctcgtgtcttggcatactcagtactccgtactcagtatagatttcttaagcttcctgttcttttcccttcaaagaaaatattttcaagacatttcatacttgacctttcttaaccatagttttaatcataaattaaaaccagttctttctagattactccacttttccattctcaggtttagtgtagtcccttctggtctagaattcacagccaagaatgaccttgaactcctgtccttccacgtccaactccctaggggttactgacggcaccactctgcctgatttgtgtggtgctgggaagcaaacccagggtttcctgcatgctgaggcacaccctacaccccacggagcagcctccccacccccaggactactcttttttttatttttttgtagtcttggcattattgtgagatggtattccttagactaaaggggaaatttaggtttttaaattatccttctgagtaatagcaaaagtggttaaaggggggaaacagtgaggattggagagaggcggtaatcgtggagtgagcaagagtggcagaagtctctcaggcagcttaggtgtgcagcctgctcctggatgtcacctgtcgtgacaggatgtcttgattaagacagcttcctcagcctctgtcacagtgtccagggtggagtccctcccatgagtttacagtcaggagagggacagtgcctgcctggggagacaaaccccagctgagggagggcctcacagggtgtgcgggaagcacttgcaacgaatgcttagaagcctggataaaaatctgtaggaatttgagtgtctttctgggtgttttatatgtaatattgcctggctctgttctcggacttgctgcattccatgactgacttaagatgagggccgactgataaagaagtaaatgagtggaggaaatcacgctgagccccttttcccctggtgttgctgacctctctctctctctctctctctctctctctctctctctctctctctctctctctctctctctctgtgtgtgtgtgtgtgtgtctgtgtgtatgcgcgtgtgtgtctttctgtcctttcagccccagacttttacaactggatttcctgatgaagatcttgcccaattaccaccacctgaagaagacgatgaaaggcagctccaccccagttaagaactgagaagatgtcagtggtgctcggttctgccagctgtcagcgggcccggctgttagcaccgtgctgactttccattggagacttgagttggagagaggtgggtcctattgtaacgaccgctataatttatatggactatattgtctccctgtccttgttctggtaatgtacagactcagtttttcttatgttatacaaaatattagccatgcatttattatgtaaaagactacccatgataacatgccatattatgtgtttatattctaatgtaaccatataccataactaaataaaagtttggctacttgcactaatcttcccaaatagctgcctcaatttccattattaatatttcggactcttccaagctgagggtcttcctctccccttgtgcattcatagctgtttaaacaggggagggtccggagagatgcttcagtggctaaagcatccgctgctcttccaggggagccaggcttgattcccagcatccacaggatggctcacaccatctctaactccagttccaggggacctgatgctcctctcgtctgacccctgagggagggcgccagagtgaataaatctaataaaattataaaccatgtgagggctggaagatggctcatcctttaaaggcgaggctcacaactgaaaatgctggtgggatttcagcagcgacggagtgtagccctcactctgttgtaatgggatgtagatctgtatgctgcttctctcagtaagtaatcgggaagagaagccttacatacattcaggagtgagctctgattcaaatggcaagcaagtgaccactcggctccgtggattcctgagtttctgaggataataaaactaagattggggtctgcagagatggctcagtgtgtaaaagcaaaaggcacttgccaccaggcctggtgacctcagttctgtccccagcactcacatggcaggagagagccggctcccgtaagccgtcctctgacctccacacatactgcatggcacaggtacacatgcacatggaataagtatgtatataaatactaaaatattttgaaacttttatgtttatgactctattttgacatggtactaatcactattggtatgtataatgttgcttatctaattactacattgaaggtgaaaaattaaggactgcactgtaatttgtttttcttttcagtgttggggcttgaaccgaaggcctcatatgtgttgagcacatagtctaccactgagccacaccttcagcctctcatatcttaataatccaatacaatggtacatagaattaatagaacacaacttttcagcttgtgaatttgaggacattaataccaagatactaaatcagatgaatactaagatagtaaaatactaagatagtgtcttgatacttaattttcttatgatatgacctagaactgttttaatatttctgaaattggtgaggacatatccaggacatggagctggagagatggctcagcggttaagagcactgactgtttttccagaggtcctgagttcaaattcccagaaaccacatggtggctcacaaccatctgtaatgggatctgatgccctcttctcgtgtgtctgaagacagctacagtgtagtcatacattaaataaataaatcttaaaaaaaaatccaggactcagactggaacaaaaacctctgcggcgaccagccttctgtcgtgtgctcactttgacacactcctgagtcaccacacttatcctagacagtaagcttcatggtagaataagccaacaggccctggctgtggtagcagccaggaggggagaaagaaactgtctctttccctgaatcttgggtcaggttttgccagttgaagagctacagcttgggccagaagaatcgaggagatgaagagggcgtggggtggggtggacatgccgtaggcttcatttctttggggccgccatccttcctccgtggctgtgtgttgcccactggaaacttgagtgtcacctcagaggtttttgtctgccctccttggagtttgtgggctgaggctgatgcctcatttccatctcaggctcagaggatcatttccatctctaggtctcgggggggcacaggatggaaggttccagaagcttgtggaacttaacaccaggaaccaaccgagataaagactaaatatttttgttttaccctttagaaatgcccctgaatataacataaatctcattaggcttcagtttaccttgtctagtcctgataggaattattactaacaaaagccttgaagaataatactcagcgggaggatgctgaggacactaaactgtttctgacactggtaaacacaccgagtcagcgccaagtttaaaacaaactgtgtctgttagctttcacggaggagctggagaggtggtctagcaggtatgatggtgagctggccttctagaggacctgaattcaggtacccagcacccacgtcaggccactcacaacctcctctgaccccaactcagggcggatctggagcctccagcctccaagggccacctgccgctcctgtgcacactcactgcctcctccatacacatgaacacaaataaggaatctttttttaaggtttatttatttattttattatgtgagtacactgtagctgtcttcagacaccccagaagagggcatcagatccccattacagatggttgtgagccactatgtggctgctaggaatagaactcaggacctctggaagagcagacggtgctcttaaccactgagccatctctccagcccccaaaataatctttatgtttgcatggaactcactacacatacacacacacacacacacacacacacacacacacacacacacacacacacaagcttgtttattccatattgactctgttcttttaatcagataatagcaccactattttgcagacgtggggactgaggcataaaaagggttggtaactgcccaagtttcctaagctcataagtgacatttggaccccacaagaggcgatctacatcatcgggtgttacctttgcaagtctcccccagccttctaaaatccagattctgtaatttagtgaacttcctggctgctaggtagaaaaagacttgcactgaacgtcttcagtctctaagatacttcatccacttgagaacaaaaataggagagatgtttaaaagaaaaagctacttgatgtttctaatggatttgataagaattaaccaaactggggctctcttgcttgaggctccctgccaaggtactgaaagctctgagcacaactgggctggtactttgcaccaagtgttttgctttttagttcttggtttctactgattagaccaatataatttcatttacgaggatttagaaggtgaggaagaaatgtaatttcacaatccaccctggaacaccagcgcttttcactttgagggctcctttcagcgtgcagtccagccaagcattaatgaactgaagagcttggagtttcatccaaaagcttagatgtcccagccacagagcgtcatctgttttatcccgggagacactggcaggggactgttgcctcttcctgatgctcaaaggtgctggagagccctcatggagactcactcacttcagacttttgctaacataaactaggagcggcttctctcctgcctcctcttcggagttaatatattaaaatattttagagttagcagtctcctaactaaaagcatccaacaggaagtacccggccacactgtcctatgggaaagcattaccagtcccaccggagacctggccaagaatgttttgattggctactcaacactagcatcccttccaaaggcctgagcgctccttaccttcatgtgatgtgaacagtgctaaggtcttaaaattacattctcctttatgcctatgtttggggtttttggttgctatttgcttttggatttttcaagacagcctcctctccctggggatggcttcaaagttgcaatcctcctgcccctgtatggggagtgctggggttacaggtgtacaccactaggcttggtttccagctgtgaggtcacatcagctcatcttcactccctctgtggcatagacctttgaactgcctttgctctcaagacccttcgccttttcagaactagtgagttgcctgcctgcccgatggtgggcgaaccgaatccctctctagaacctgagctttccaaaagctaattctgtttgttcccagccttgtttatgcaagtcgtactctgaaattacatcattcaattcaatatcacccaaaccaaacaactatgagtgtgaagagagttgtaatctttaggaaaataagttgaatgtttgagagttgataaaggcttgatttaaaagagaaagggaaaaaaaagctgtagaattacatgtgcacaaaacatcctgaaggtttgggtgtgggaggaaaaccaaaatctacaaaacttctcctctcagtttgcaagtgtcttgagtccttgctccagacaccttcagcttaataatgctcctcctacctgtgttagcaggagtcttacacagtcctggttggcagcctgcagtcagagaaaaagcttatgtctgtggatgtcaaaggaatggtggtgaagtcaatggatttactttttgattttgtatttaagacaagattttgatgagctgcagtatggtttatgaattccccactttcaaagacaactctggccaaattcagactctgactacttagggaagtggggtttctccagctcagtgcctcaggctggccagcacaggaacgcagtgaactgcctggccccgagcatgtccttggtgcctgcgagttatagagggacaactccgtatcgccagcatggggaggctgagacagagagatctcaagactggggctaccctgatgtacatcatgggttgaggatggaaagatagaaaataaaaaagcatagatacttcaagacatggccaaatatggacttctggaaaagcaataatccatcttctccttgtttaaactagaaccagaggggctgcctttattataagaagctttgggtccaaactgttacaaaatgacaaacttgcctccctactcgctgaccagttttgctggtcctataagcacactctgccctgcaccttctgcggctgctgagctggtgcgctaaggagggacccagcatgtacaggaaatggtgacggctttgagatccggcaataaacacacgtaaagaaaaaaaaaagtttaggaaatgatatgactcaggcatagactagatattaaagatccatctggcttctgagaactgcctattcatatcagcactgtcttggtaaggtccttccctcccaccctccctccctccctcccttccttcctttcttttatggtttggtttgggttttttgtttgggttttttttttttttttttttgtggtgggggaggtgttttgctttgttttgtattcagacagggtttctctgtgtagccctggctgtcctggaactccctctgtagaccaggccaacaccttgaaatcacagagatccacctgcctctgcctcccacatgctgggattaaaggtgtgcaccaccaccacccagcttggtaaaatatcataagatattagtgtcccagctttgaactcaattatgagctcagttcgtcacctacatcgatctttagcgactctgaagtggaaagtttcctacactggtcacagtcaaaggggcaggaaaaacctgacgaaggattcttcctcaagccgctggggtcttgcaaaactatcggaacatgttgtgtgtacaaatgaacctaaatagattaaagaagatgggcctcacgcacactggcagggtgggaagcccgatcatctggagacaaaattataacaagttaaaccttctaattggtatttatttttattgttaaatttagcatcgggcaacacttagttccataaaataaaatgtgcattattgtcggttgtacaaagggattgattttgtaagttttgtaagggaacaggctaaagaaagcagaaagaaaaaaagaacaaattggtcatttcagtgttattactagtaatggggtgggaggtcaccatcagggtacatctggttttttggttttaaggtttttttgttttttgtttttttaatatttgagttgaaacagggaacctcaatatcatgtcaattcaagcttagggactaaagctgccttggtggtggaacacttttctcatttttgcagggccccaagtctgatcctaacaacatcattaaaaaataatataaaataaaaaggatggaacagtggtgggactcacatttaatcccggcactttggaggcagaagcaggtggatcactgtgagttcgaggccagcctggtctacagagtgagttccaggacaaccagggctacacagagaagccatgtctcaaaaaaccaaaataaaataaataaatagcaaaaaaaaaaaaaggggggggactgtttgaggtatttggctactacctttctaagcctgacttcttctgcgaagggccgagaaacagctttattccagcttgccagaacttcaatgtgaacgacacttcctgtttgtcagcttcctgttactgtgacaaaatacctgagaacagagactttaagaggagaaaaggtctactttggatcatagttgtaactgtggttccttggccttgttgccctcagggctgtggcaaagcagcgcgacagcagtgctcagctcaatgacctgttcacctcataggacctggaaggagagacagacagacagatagaaagaggcagaaacagagagaaagacagaaactaagaataatcctagattatgacaagagaggttgtatgttaaatatatctttcctctttcttagagataaaactctatattttcctaggcttgccaatggcaccccagccactcaggagtctgaggaaggtgaatcagagttcaggatgagcctggactacagggtaagtgtgttcaagtctagcctgggctacttagttagactgtgtcttcaaacaaaaaggaaaaatcaggctgggcatattgctctgaggtagcagtgtagctcttacagaggtagcttgtaagaagccccaggattggtcctcaacccacacacctgtgggtggagttaagaaaaggggggggctggtgagatggctcagtgggtaagagcaccgactgctcttccgaaggtctgaagttcaaatcccagcaaccacatggtggctcacaaccatctgtaacaagatctgactccctcttctggagtgtctgaagacagctacaatgtacttacannnnnnnnnnnnnnnnnnnntaagttcttatatttatttttggctttagtcatattcatctctaaaatctacttcatgcctgttggaatgtgtatttagccagaaaagaaacattaatactaatcacacacacacacacacacacacacacacacacacacacacacacacagagttgtgctgtgatcatgaataatagaaaagtcaagaaaatggcgtatttgtagatctgctgcctcactgttaaatcctccagcctccttcctcattcctagattctggcattcaaaatctctggaggagatggctcagtgggtaaagtactcgctgggcaagaatgaggaggggagttcagagtctctagcacccatggacatgctaggtggctcacctataaacccagcacttaggaggaagccagctaactagaccatccaggaagacgttctgaatcagcacacacgggccacacacacattaaaaacaaacaaaacccaacaacaacaataaaatccttcagagttaataatcataagaattgacagacgtggtaaaaagctactagtactcacaggggtagaactggaatacacatggttctctgccggtgatgtcactgctggcaaatgaagttttggtaatcttgttaccaagcctagcgggtttcgcctgcctcagactacgtcggtcaagaaaacaagtttggcaaaagagaatttatccattaggtgaccaagtgtggagatagttaaagcctgtctcaaggccacctcctcgaagatgtgttttggacaaggtactgaagagctgcgacgttagaaaagggaatcggcggttaggagggcaccagtgttctgagcatgcgcaatctcacattctctcccatcaagaccacccggtaaggctatttattctctgtactacggacactgttgagttttgaagtcgcctcatatcaagcaactaagtgacgagggttagatctggaggctcgatactggctcgccttcagtttaaaccctgttacgcatgattgcttattcctttaataaagacaaatattcatttcgcacgtggtagtttgtagaagtgtttcgccatgagggaggcaagattgtaaatggttgacagcgggctggattcttatgatgtcaagaagagggctttggtcctaaggtcgtgaccttcatcaatcagccctgcacccaatctttcagcgaaagagcagcagatttttccccacccccacccgccggaatgtctctagagtgagatcaaagcgacgctcagaaaagccggcacactgatattttcctcagcgcagagcagcaaagagaggtattggttcatggtccagaagctctgatccaagggatgagcaggaaggattagagagcatcctacttgatttaccttctgacccaggacgcatgagaccctggaggtcaagaagtggtctctctagagccttgagttatgaaccgatagtcagccaagtggggtctggatgttttaaagttggtacgtggaggcagaatgaccccggatgtaaccaagccatgtgctgcgcgctcctgatgttgacataccctctctttgctcccaaatggctccatccccttgggattttcacctggtttcctttgcaacttttctcagcctgaccaatcacaaggcagcttccagcctctgcttagctctttccttcccttcctacttcaaaaccactgccacccgctctcagcagcgagctccctaagtacttgctctccttggcttggcatcctgggtgttacctctgcctcgagtttaaatgctaattacctatagtatggatctcctgctgggctctctcctgacatccacacctgcctctctgccagtcttcccaacagtccaccactacatcctgctagtagacagctcaactcagcttcttgcatctgaatgaactagacgtgcccaagttgggtgtgtttagaatgtgagtcccagtcttcacagcgaacagtggttgacgtgggtggcatcattagagaccttagaaaaccccagcaggactctctacctccactcccagacttgatttcttttcgtatgccaacccatcattcctattttctgtcttctgccagaatccttcagcaactgcctttttaaaaaagatttatttatttattctatgtatatgagcacaccattgctctcttcagaccagaagagggcatcagatcccattacagatggttgtgagccaccaggtggttgctggaaattgaactcaggacctctggaagagcagttgttgctcttaaccactaagccatctctccagcccagcaactgccccccccccctgcctaataagatacctgaaagtatttttatgaaaacaaaaaacaaaacaaaacaaaacaaaacaaaacaaaacaaaacaaaagagcatattgtctctcgggtataccggaacgctacataataggcagccactagcaaactttctttcacacttcctcctcttctctgatactcagtccagctcacccctgcatccaacttctctcttgaagatgtttccttttccctagtaattatcctgtgttaaccacttttgttgctgttgttgttgttgcaacaaaatacctgaataatagtaataagggagaaagggcttatcttggctcatgggtctgagcttcagcccttggggaggtggagagaccgcgttgagcctgagtttcgattagaatatcttagcagcagaaagatacagcaaaggctgctcaactcacactggccgagaagcagagaggatgcctgtgaccgtaggtgcctccttcttatccttgcccagcctgccatgcgttgccatgtgaactgggcaggtttcctcccttggccaccacactcctctaggaaggtccctcccacccccagacacat

SEQ ID NO: 1262 - DNA, 879 bp, Mus musculus
agtgtgaagattgctcccggagcagtagtgtgtgtagaaagcgaaatcagaggagatgtaaccataggcccgaggacggtgatccaccctaaagcacgaattatcgcggaggccgggccaataatcatcggtgaaggaaacctgatagaagagcaggccctcatcataaatgctcatccggataacatcatcccagatactgaagatacagagcccaaacctatgattattggcaccaacaacgtatttgaagtgggctgtcattcccaagccatgaaaatgggagacaataatgtcattgagtcaaaagcctacgtgggcaggaatgtcatcctgaccagcggctgcatcattggggcttgctgcagcctcaacacctttgaagccatccctgagaacacggtgatctacggcgcggactgcctgcggcgggtacagacagagcggccacagccccagacttttacaactggatttcctgatgaagatcttgcccaattaccaccacctgaagaagacgatgaaaggcagctccaccccagttaagaactgagaagatgtcagtggtgctcggttctgccagctgtcagcgggcccggctgttagcaccgtgctgactttccattggagacttgagttggagagaggtgggtcctattgtaacgaccgctataatttatatggactatattgtctccctgtccttgttctggtaatgtacagactcagtttttcttatgttatacaaaatattagccatgcatttattatgtaaaagactacccatgataacatgccatattatgtgtttatattctaatgtaaccatataccataactaaataaaagtttggctacttgcactaatcttcccaaata

SEQ ID NO: 1263 - protein, 181 aa, Mus musculus
SVKIAPGAVVCVESEIRGDVTIGPRTVIHPKARIIAEAGPIIIGEGNLIEEQALIINAHPDNIIPDTEDTEPKPMIIGTNNVFEVGCHSQAMKMGDNNVIESKAYVGRNVILTSGCIIGACCSLNTFEAIPENTVIYGADCLRRVQTERPQPQTFTTGFPDEDLAQLPPPEEDDERQLHPS

SEQ ID NO: 1264 - DNA, 47243 bp, Homo sapiens
  misc_feature (1)...(47243): n = A,T,C or G
gactcacagttctgcatggctggagaggcctctggaaacttacagtcatggtggaaggcaaaggagaagcaagtaccttctttacaaggtgacaggaaagagaagtaagagcgcaggaagaaaacaccatttataaaaccaccagatctcatgagaactatcatgtgagaatgatcacgagaacagcatggggaaaccgttcccataatccagtcacttcccttcctcaatacatggggattataactggggatgagatttgggtggggacatagacccaaacatatcagagactgctctgcacagagaagaaaatccaaaagaatcttattgattggggaactttgagcaagtcacatcacctctctgggactaagcttcaccttaaaactagacataattaggcctatctcaacagaactgttatgaaaatcagataaagcatgtaaaagcatggcatataaagctggctggttgaatgtagctgaaggtaaagtgattgaataattaacattatgagcattattgggctacctctttatgacagactctttgctaagcactaggaatatggggatgagtaagacatggtccctgcactcatgttgctctcagtctactggagagacagaaatggaaataaatacctttcttaatgaactgtaggtgcacaggtgtatggtaggggataaagaaagaaacaatcacctgcagaaatagggaatcaaaaaggattttggaagagtggaactgcttaagttggctctctatgaaaggatgtttgcaagcagatgggtggcttattctaggccacagaaggcacaaagtcttaggcaacaataaaacagttaatgggaatgccgagagtagtttggtcatggagaccctaacccagcagcactagaggaattaaagacacacacacagaaataaagcgtatagagtgggaaatcaggggtctcacagccttcagagctgagacctgagagcctcaaacagagatttacccacgtctttattgacagcaagccagtgataagcattgtttctatagattttagattaactaaaagtattccttatgggaaataaagggatgggccgaaataaaaggatgggctctggctcgttatctgcagcaggagcatgtcctaaaggcacagatcgctcatgctattgtttgtggtttaagaatgcctttaagcagttttccgccctgggtgggccaggtgttctttgccctcattccagtaaaaccacaaccttccagtgtgggcatcatggccatcacgaacatgtcatagtgctacagatattttgtttatggccagtttatggccagattttgggggcctattcccaacatgtcccccttctttgatttacaaaacaatacaagcaaaggcagctttgtcacagtgagctacttctcacaggagtcaggatatgcatctgcagactacacaaagacaaacaacacagattaaaagcacaatcatcattgaaatcacagagcatccaagtgtttttatccattttaatgggttactagctgctaatctgtctgcagctccttcaagcactccagttcctggtattaatgtcaggtgtgcctgggatgctttaaatatttgttcttttaattttgtgatatccaaagacaagtttgtacagtgtccttctagatgcttttttattcttttccaaattttgatcttattaagagctattaattgtttccacaaatccttatgtttagctcctacagtgggacatatcatttgaggttgaggtgccactataccaccatggttccagataataggaactcttgccatacttcttaccgtttctaccatctgactgttttgttcagaccagctgaatatagtgtggccatggcatgcagactgagaggtgcaattcaagctaaacatccccttggggacgaattaataatgattccataggaatcgttgcacagcacctctgcctgttctgcaatgcaatcttcccaaacaagtacgtccattaattctagccaggtccaattctgtttacaaataggtttttgagggtggtatgcctcagttataggagcagatttattatggtaaatactgaggtcagaaagcatgtgtaactgtgtcatagactgattacatccaggcattattgccagccaagattgataaatatgcccaataagtataattgttctttgtgtcagcccttgttgaaggaatacttacggcaatggtgatcaccacatcatagctaccattaaattactcattgtgactggttgtcccgcttttctcaagttttcttctgccatctgtgacagcttcttgatctgtcctcaggtgggtggctgtgtttgatgggtgttgctcgtgacaattggggtcctcctcagcatcagtctcaacgtggctgtaattggggggtcctcaggatcctcccagaatctcttcctcagcatctagttcatgataagttttcaggtgtcttgatggtatccaaatcggctgttgatttggtcctggagaaacacaagcataacgtctaccccaagttattattttaaggttgtataactgaattaatggctcttaagtcagttaacattctccatttacctgattttttcttaattacgaaaactggaaaatattggagctatgcgcccgttttctaattgttcagtaacgaattcctctaaagcctcaagtttctctacttagcggccattgttttatccaaattggctactctgttaaccattttaaatgtacagattctggaggcttaacaatggccaccatcaaaaatgatatcctaaaccttggtgggaactttgtctttccacttgaagcggttcctttaaaccttgcaaactttttcctagtcccataccagggacataccccatttcatgcattatatgttgactttgagggctatataattgttcaggaattagaacttgtgctccccattgctgtaacaaatctattccccatacacttataggtacagaagttataattggttgaatagtcccaggttgtccatcgggcccttcacaatgcaaaatataactactttgatatacttcaggggctttaccaactccaactatgttaaattgagtgggttgaattggccacgcggatggccagtgtgtagagaaatgattgaaatgtccgctcctatatctaccaaacctttaaatttctttccctgaatagttatttcacaggtaggacatttatcagtaatttgatttatccaataagctgctttgccttgcttattcgtgcttccaaatcctcctgttcatttaatttcatttttccccattcccacatacggcacaatcgggagctgtgctctgagttctcctggctctgctttccagggaacggaagtagatataacaatttgaatttccccattgtaatctgaatcaatgactcctgtttgtacttgtaccccttttaaatttaaactagaccttcctaaaagtaatcctatcatcgctgctggcaagggtccacagactcctgttggggcgttttgcaggggttacccagtcagaaggctcacagcttttgtgcagcataaatctactgcggcactaccggctgtggcaggggacagacattgtacggggtgagggaatggcctgagccacaaatgccctggtttggaatggggccgggatgggcccctcagggtgtttcccgaaatcgggttcccatctttatcaaacttagaatgacactggttagcccaatgttttcctttttgcattttggacatacttcaggctcagcagttttcttttttcccccatctggtggcctgacttcctgatttttttctacattcttttttagtatgaccatgcttcccacagttctccaggaaatggagtatttcctttatccactctcagtcctgccattgcctgtgccaacaaagtagctttatgcagattacctccgataccatcacaggccttgatataatcaactaaatgtgctttccctctaataggtggcagagcagcctggcaatcgggattagcattgtcaaaagctaataaccacaacactttatcttgagcagccaaatctgcaattacctttttaagagactcctgtaaccgagctataaaatcgtcatatggttcttttggtccctgctttacagcactaaaggaaggttattgctctccacctgaagtgattttttttcccaggctctaatgcacactcctctaagctgttctatggcatcatcctgcatgaccacttctacatctaaaccagcccagccgctgacccccaaaagttagtctgcagttatattaatttgaggttgggcctgggtgttgcgagcagcctgaatggaagcttcatctgcccaccaagttttaaattgtaagaagtgagtgggaattagaccagctcgagtaagaatgttccagtcagtaggactcatccgactggaaacagcaacattctttaacagtcccattacaaaaggagaacctggtccatactgattaatagcttgtttaaaattctttgagtaatttaaaaggaaaaggctcaaatgtagctgtaatagttccctgttgatcaggtgggtgtattctaacagggaactgccaagcctctatatcaccctctcgtctagcttgctgaattcctgcctgaatagaactgagagtggtcgctggaggcgctgctcgaacagtcactggggcaactacttttcactcagtgtcctccagaaaagaaagatctggagggtgaggccactctttttcttcaaaataataatgagggggtgcagaagggtagggatgaacctctccctcctttgccactttagctttagctggcaaataaacctcctctgtaacctcttctgttatctcgttacactctccttcctcatcatcagtgtgaaaaggttccaaagtggaacgaaccagagcccacacttgtcccattgttaccctgatgcttctgagctccccttcttacccaccacggggattgctttaagagtacttgggtgtcctccagcttagctccacattctccaaccattgctctgatgactcttcgacctgggtttgagcccccacgtatgggcgccacttgccaagaccagctcggtcctggagaccctaacccagcggcactagaggaattaaagacagacacatagaaatatagagtgcggagtgggaaatcaggggtctcacagccttcagagctgagagcctcgaacagagatttatccacatatttactgacagcaagccagtgataagcattgtttctatagattaactaaagatattccttacgggaaataaagggatgggctgaaataaagggatgggtttggctagttatctgcagcaggagcatgtccttaaggcacagatcgctcatgctattgtttgtggtttaagaacacctttaaggggttttctgctctgggtgggccaggtgttccttgccctcattctggtaaacccacaatcttccagcgtgggcgtcatggccatcacgaacatgtcacagtgttgcagatattttgtttatggccagttttggggccagtttatgaccagattttgggggcctattcccaacagggaagaagagggctccctaaggaactaaataagataacatcatattaaacatattgaatgaaaccaaatcccacatcaaatataatttctaggtatagaagagttgaattgcagttgattagttaagaaaaaagttgctttgtagacattgaattaagtatgtacgtgtgggtttggacacagtgactcatgcctgtaatcccagcactttgggaggcagaggcaggtggatcacctgaggtcaagagttcaagaccagcctggccaacatggtgaaactctgtctctaataaaaatacacaaaaaaaaaaaaaaaaaaaaaagggccaggcatggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggctacaggcacgtgccaccatgcctcgctaatttttgtattttttgtagagacagagttttgccatgttgcccaggctagtctcgaactcctaactcaaacaatccacctgcctcagcttcccaaagaactggggttacaggcgtgagccactgtgcctggccttagcattaattaattcctacctgtacggtttacattgctggaatcagtacattttattttcaggtttcaaacagttcgttgatccccaaaaagcctataggccctagacactgtacctaatactgataaaatgatcctttataagtatgccatagaagtctttcaaattaatataaatacacattgcttgaaaatggataggtgtttacatggttggcagtgacaaaacactctaaattcattcatatacttattcaacaagtttagaggaatatcaaccatgcaccaggcactgtggttggtgctgagtaaagagtgggaacaaaactcacatggctctaacttcatggaacttaagtctttggaggaaatggtaagataagtaagtatagctggtgatgagtgcaatccttaccccacagagaaaataattagaataggaagggtagcctatttttgattagatggtgctatggtctgaatgtttttgtccctccagaattcatatgttgaaataataccttcaaggttctgtcctctctgccgagcttcacatctgatattttattgactacttggcaattaagaggtgggacatttgggaggtgattaggtgatgagggctctcatcagacacagaatgtccagcgctttgatcttggactccccagcctctaggactgtgagcaataaatgtctttgtttataaataacagtagtcgcacttatccatggtttcatcttctgtggtttcagtaacctgtagtcaacatcagtccaaaaatattaaatagaaaattccagaaataaacaatttgtgagttttaaattgcacaccattttgagtagcatgatgaactctcgtaccatgctgctctctctaggcaagaacatgaatcatccctttgtatccacactgttggtactacctgcccattaaagctttctcagttatcagatacattgttgcagtatcagagtacttgtgttcaagtcactcttattttacttcataatggccccaaagcacaaaagtagcgatgcaggtgatttggatctgccaaagagaaactgtaaaatgctttaagtgaaaatgtgaaaacttcttgatttcaaaaggaaagaaaaaaaactatatgctgaggttgctaagatctatggtaagaataaatcttttacccatgaaactgttaatgaggaaaaggaaatgtgtgcatagtatatagagggttcagtattatctgtggtttcaggcatccactagaggtcttggaatgtatcccccgaggataagaaaggactactatacccagtctaaggtataactgtccctcagtatgcttggggaactggttcctggacaccctgatgccaaaatctgcagatgctcaagcccctgatataaaatggtgtagtatttgcatataactaactgatgcatatcctcccatatcctttcaatcatctttatattattcagaatatctaatacaattcctacatatcacttcattcatgtggcttcaatgtagcacttggcatgcagcaaattcaagttttgctttttggaaacttgcgtaattttttcccccaaatttttgatccaacgtgggttgctgtcaaccagtcacagatgtcaaacccacagatacaaagggccaactgtattttgttatagcagccagaaagaactaagacagtcaaggagggtttccctgagtgtgatggtcagttttttgtgtcaacttggttaggctacattcccaagtcattagtcaaacactaatctagatgctgctgtaaaggtatttttgtggatgtgattaaagcccatcatcagttcactttaaggaagagagattatcctagctaatctgggtgggcctgattcaatcagttgaaggccataagagctgagatgggcttccctgaagaaattcctcctgtgaacaacagcctcaccccttgcatgagagttccagcttagtgtacagattttggacttgcttagctggggctccacaatcatgtaagccaattccttacaataagccttttgatatccatctactactagttctgtttctctggttggaaactgagtatgtgacatccgagacataaagggtcagaaggtgttagggtgggggcaagtggaagcggttgggggtggagagtcagctttgcttttttggagaatgagggtgtgatcgaacacatagaaagagaaagagagaagtaggcaggggctggatgtagctcagagataggttatggaaagcagtttggattttagattttaaaaggaaggggaaataactgaatttggctcttatttttaatttttttccattaaaaaaatacattatagaaaaaatatatagagacgggatcatgctgtgttgaccaggctggtctccaactcctggcctcaagcgatcctcccatctcggccccccaaagtgctgggattaccggtttgagccacgcgcctggcctcaatttgtcttttaaaggatgattttgactacaagagaactacttggatcagggttgggggtgggagatgagggggtgtgatttcagaggccaagtacagaatgagtgaacaactgggagagacacatcggctgagattagagagatggtccggtagacaaaagtgtaagcatgagacccgaggtaggacaagcagaacttgcagatctattacagatgtaggggtgaggagtgccagggtgactcttgagtgtctggcttgagcagctaggcaaatggtgtggatcaaaaaagcagcaggttgcagggaggacggcagtgttaatcgaaagtcatgttctgtaagttttaggttcgatacgactctgagcggagatgtcaattagtcaaccgaatgtcaggtgtgaagatcggcacagagggcagaaccagagacattcattagagagcaaacaggtagagggcacttaacctataggaaggatgcactcatatagagcgagaaaagggccagaaggagccctaatgagtagagaaagacaggctgaaaaggacatcggcgaggtcagagaaatacctttagggtgtaattacgcctacgcgagtgggtaaaatgagggcataatgacgcggactggattgcaataaacagcttttattcttttatcagagacacgatctagctttttagcccaggccggagtgcggtggcatcctcacagctcgctgcagcttcactgggctcaggcgatcctctcgagtagctggggtacaggcgcaggccaccgtgacaggctttttttttttttttttttttttttttgaaaagagggtctcactatgttacccaggctagtctcgcagtctggcactcctggcctcaagcgatcctcctgcctcggcctctcggcctcccaaagtgctggcctgtgcccagtcaatggctgttccaaattagggtctacccatctttatgcagggctaaagtccgcgggcggccccgcaccgctaccaaaagtacagtcctgtgcgcccagacgcgacgcacacaagagtcgcaagcttccgggtccccgccccaccccggctccgcccctcccccaaccctgccaggctctccaatcgcatgtggaattatcgctctacccaggcggtggtgtcgatctacgttccaattggggccgtaccatggcggagaagactcaaaagaggtgggtttgctgcttgagaaaagccttttctcagctttccgtaggggtggaacctgttcctggtcgccaatggtggcgactcagaaggtgtctcatcctgggcattcgggccgaaggtacctgaagcccagacctggcgtccactgagggagggggcgacggagtgggggcggggagggttgagaagggacgcggagtcgctgcctggaaggtttttgttcctgtctggccgtccctccccacatgcgcctgcgcagagggggtctcccggccgggagggcggggggggctgtgaggggagggtgacgtcagctttttcctggggaaggccggctcccttctcccgcataatcggcggtgcttggcgccgctgtaccccacggcttggcgctggattctctgctgcatgttgcgagacccccacgccagtgctggccgcaccccaggcccttcctgtctctggagggtggggtgtgtaaagggatttacggtcgctgtcaaaaggggggccgcgcctggacttgaactgtgacacacacacacacacattatatagatgcaaggagtacttgcgcagatttgttgcatagataaattgcgtaatggtgaagttggcttctagtgtacttaccacccaaatagtgaacattgtatcagatgggtaatttttcagccctcaaacccctcctaccctcgctgcttttagagtccccagtgtctgttatttccctctttatgtttatgtgtactcattttagctcccacttaaaagtgagaacatgtgcatttgattttatttctgagttatcgcgtaaggtaatggcctccagttccatccatgttgttgcaaaagacatgtttcctttctttttgatggctctgtagtattccatcgtatagatacaccacatttcctttatccagtcatccgttgatgaacacttaggttgattccatactttgctattgtgaatagtacagtgatagtcataggagtgcagttgtctttttaatacaatggtttcctttgagtagatcctgggtcgaatggtagttccgtttggattggtagctctatatggattgctgggtccaatggtacttgtgtttagtcctttgagaaatcaccatactattttcaatagatgaactaatttatattcccaccaatagtgtataagcttagaactgtgacattttttgccaggcgtggagtggacaagctcctttgtaaacatgtggggacaggaagtttggcttcttctccggtagtcttcattgctgggggctgttggtggctgttggtggctgggatgagacaagtgcataagtaaagccatttcgaacagcagcagtgttgagctccctctgctgactatttttgacaaagaaaactgacattgtttctggtgccataaattaaaatgtagatttttcttccatttaagtagatactctgtaatcttttttcataagctaaagaggaacagatgtactataaatattatgtgcagtagatagcagtagatagtagcttacagtgaagattaaggtattgttgacttgttacttttacagatctgaggttaagtcttgccctcccatctgccgggctcacctcttctgctcccaccactccgagatacaaggggtccttgcagagatatcgggaccacgttttagttggcctagtggcctgccccactgagaagtgtgctgattgtgacgcaagcattacctgggatctctcccttgggcgtaaaactgaaggcagggggcatttgtgagtctctcctactctcagttgcccaggacaagttcaatgttagataatgctcttttcataatgagaaggaagctgaggaaatggaaaattgcaatgagaaataaggtctaaaacaagagacattttatagaggctaatgtatttgaccagggcttaataaaattgcatattttaacaaaaaaaacccactttaaatgaaaagtatcagagaaatgacatttacagctggtgatacattcaaggacagtgtcgctcatttatcatggaaaaacatctggagtgacaggatgtttccagaaaactttcaactagaagacagatgactgatttcaggacagtgatgccccaggaatgaactctgctccaagaaatttctagtctctgaatttcagttttttcttctataatatgagagggttagaccaggtgattttcttctaatcttactaaaatctttcttcttcaatacagcaggagggctacatattttctgttatttcagtagattgacttttttttttttttttttttgtgagacagagtcgctcaggctggagtgcagtgaaagctttgcaccatgcctggttcctttttttttttttttttttgagacggagtctcactctgttgcctaggctggagtgcagtggcacaatctctgctcactgcaacctttgcctcctgggttcaagcgatcatcctgcctcagtctccagagtagctgggactacaggcacccaccaccacacctggctaatttttgtatttttagtagagatggggtttcaccatgttggccaggctgatctcgaactcctgacctcaaggaatctgcccacctcggcctcccaaagtggtgggattacaggcgtgagccactgcacctggcccagattgactcttgacaggctgtatcacccagaaggaccattggtaggatttcattgacttacgccttataaaaagtcagagcctaacaaaatgatggaaacagctggagctgtgtctattctcaaaaccatttcttgaagatagactcagggattattagtttttttctatttgatacatgtttttttgtttacttagagctttaaaaattcatggcggtgtgaaggtttgtccaccctaatttgtggaagaaaaatttgtgtatgtcttcttttttttttagttcatcacaccagtagggaagttggtacaatcttaaaaatagttttcatcttactttgcatgtatattagggaatacttggggggaagattctggcatagaaatgatggagagacatgttaatgaaagaatctttacccttctgactctcagagctgtatttttagaactctcttatgagcttcagaatctgtattttcagtcgcttattggatatatctggtgaccattccatagatacctcagactgagtttatctaaaatttagccaaatgacttttttctctaaaatctacccctcctcccataggctattctcagatggtgccattagttttccagatcagaaacctagaggctttgaccttgctccctagctccagacttttgattagttttcttttttttttttttttgagacagggtttcactccatcacccaggctggagtgcagtggtgcaatctcagctcactgcaacctctacctcctgggctcaagcgatcctcccgcctcagccccccaagtagctgggagtacaggtgtaagccaccatacccagctaatttttgtattttttgtagagatggggttttaccatgtgacccaggctggttttggttgtttttctggcataagtgaagcagagtcacagcagctgattttgagccctggaatttgagcttccctctccatcaggaatcatcccttcccaggaaggggacaagatggcaccagtttccttatttcactccatgcccctcacacccatccttctgtagttgatatggtttggctgtgtccccacccaaatctcattttgaaatgtagttcccataattcccacatgttgtgggagggaccaggtggagataattgaatcatgggagccgtttcccccatcctgttctcatgatagtgaattagttctcatgagatctaatggttttataaggggcttcccccttcactgggcactcattctcttccctgccaccatgtgaagaaggacgtgtttgcttccccttctgccatggttgtaggtttcctgaggcctccccaaacatgctgaactgtgagtcaattaaacctctttcctttataaattacccagtctcaggtatgtctctattagcagtgtgagaacagaccaatacactagtcaaacttacttcccctgcacagagaagaaagcaaatatagtttgctctttatatccatgggttccacatccatggatccaaccaacctcagatcgaaaataggaaaaaaaaattgtgtctgtaaacaatacagtataattatttacatagcatttacattgtattaggtattgtaaattatctagaaatgacaaagtatgagaagatgtgtataggttttatgcaaacactgcagcattttatatcagagacttgaacatctgaggactggtcctggaaccaatctcccacagatactgggtactgagggatgcgactgtatgcactttgtggtccatggggcctgtaacaaggaatgggaaatacctaccttcaacgttgcctagaaaccagatttttattaaatgtgtttgttgccaagtcttgtttctatttcctagacatacctgcagcttctcctatgtgctaccagtgcatttgatatggtttggccctgtgtccccatcatatctcatcttgaattataatgcccacctgttgagggagggacccgtaatccaagtgattggattatgggagtggttcccccatgctgttcttgtgaaacctgatggttttataaatggtagtttttcctgcgctcacactgtctctctgtcctgctgccttgtgaagaaggtgtctgcttcccctttaccttccgccatgattgtaagtttcctgaggcctccccagtcatgtggaactgtgagtcaattaaacctctttcctttataaattacccattctcagggaagttctgtagagcagtgtgaaaatggactaatacagcatttcaggcctgcattatctctgtaggattagaccaactgcctccctgaccccccccaccaccaagtacttcttcatacaagtgtcaattatctgcataccatttggtgacattgttggcttgggaataggaatccttcagtgacttcttgcctacaggtgcaaattcaaatccctggtcatggtgtacaagcttattcatgggctgatcctgcttttcctcccagccttacctgctccctttctcttcatgacttttgtgcttcttctcattcagtgatgtccaacctgggaggggggaagaggtttttactttgttacttaccagtctttgcttagatgtatgcatatggtatttaaaaatagatagaatagataaaattgtgttttaatttttttttttttttggagacagagtctcactctgtcgcccaggctggagtgcagtggcgtagtcttggttcactgcaagctccacctcctgggttcacaccactctcctgcctcagcctcccaagtagctgggactacaggcgcccaccaccacgcccggctaattttttgtatttttagtagagatggggtttcaccgtgctagccaggatggtctcgatctcctgacctcgcaatccgccagccttggcctcccaaagtgctgggattacaggtgtgagccaccacgcccagccttaatatttttacataagcgttcttgcacaaacatttacacctttcttttcttttcttttcgagatggagtctcgctcagtcacccaggctggagtgcagtggcgctacctcggctcactgcaagctccgcctcctgggttcatgccattctcctgcctcagcctccccagtagctgggactacaggccaccaccatgcccggctaatttttgtatttttagtagagacggggttttgccatgttggccaggctggttggtctcaaactcctgacctcaagtgatccacccaccttggcctcccaaagtcctgggattacaggtgtgagccaccatgcccagcccaaaactattgtatttctgtatactgtgacaattggaaatcaaaattttgaaaaatccaaacaaaattacaaagacaaaatatctaaaatgttagtgttatttcatagtagctgagagcagatttaacaccatgaatgtcattgccatttagaaaaattcttttattaatgaaaagaagtttcctaataactatcactgtaatggagaagtcatttgatgtacttcctcatgtcagctcatggttcagctagggtcagtgtttacatacagctttgtcaaacaaaagataacagcagaatataaaaaagcatcaataagttatatggaaattattagagtcttttgaagaatttgtactacaatttatattacttggtaaaaagtttctcatatatgtgtatgtatatatatatatgagagtaaacagaaacatttgtaaattttaaatttctaagttagtattaccttgctggttgttaaatagtttgaatgtatattttttcttcctacctttacaaaaataatggcatattacatactgtccattttctcacttcactcttttttacttttaacaatatagcttggagatcattccatattttttttttaagagatgaggtcgccgggcacggtggcttatgcctgtaatctcagcactttgggaggctgaggtgggtggatcacctgaggtcgggagttcgagaccagcctcaccaacctgaaaaaaccccgtctctactaaaaatacaaaattagccaggtgtggtggcacatgcctgtaatcccagctactagggaggctgaggcaggagagttgcttgaacctgggaggcagaggttgcagtgagccgagatggtgccattgcactccagcctgggcaacaagagtgaaactctgtctcaaaaaaaaaagatgaggtctcactatgttgcccaggctggtcttgaattcctgggcttaagcagttctccttccttggcctcccagagtgctgggattacaggtgtgagccactgtgctcagccattccaaaatcttgacaagagattattcattctttttgatggccatgtaatagtccataatgtgccataatttattaactaatcttccactgatgaatatctaggttgttttcagctttttgttgtttagaaacgtgctgctattaaaagaaaagattcaaaactcttctcaagtgttttagcacatgtgatttgggatgatggacaatataccaattgaaaaatttataatgtattaaaaccttaccctcttaccattgactttccatttttccatctttttttttttttttttcctgagacagagtttcactcttgttgcccatgcttgagtgcaatggcgcgatctcggctcactgcaaactctgtctcccgagttcaagtgattctcctgcctcagcctcccaagtagctgggattacaggtgctcgccaccacgcctggctagttttgtatttttagtagagatggggtttcttcatgttggtaaggctggtgttgaactcctgacctcaggtgatcccgcccacctcggcctcccaaaagtgctaggattacaggcgtgagccactgcgcctggcctttttttccatcattttttaaaccttgttttcattacaatgtcacggtagctcctccaacagtatgtttaatcttacccctggtaaatgttacctttttcttgctacagtgtgaagattgctcctggagcagttgtatgtgtagaaagtgaaatcagaggagatgtaactatcggtaagaaatagtttatttactgtttttcaagaattgatgtgatttaatctattttagtgctttacaattagataccgtcttccatgtttatttcactgatgtcctagttttattgacaaaataatgcattttctcctatgtgtttaaatttctgaaagaatgtagtgtgatggaggctgtgtttaaactcctatctgaaatactaatgaggctgtataacaaagtcattcatgtatttaagagagatctgttgtgtacctgcgatgtgccaggcactgtgctagtgctagagacacgtcagtaagcacagcagacaaaggtgctgcctttgtggagcttcgtggagagcgtgggccatggagtcaacagacctgggctactctgctccttgctcctttcttgctgggttactttgaacatattacttaacctctctaaccttgatgtttttcccatctatataattgtgtgtatcaggatcaggttcggctgcatgtaggggtggcttacacctgcagaggtttattctctcatataaaaagtttcaaggtgagtaatggagggctgatcggttgattgtccagcatggagctccggccctgcaggccaggaagtgatggctagagcaccaagcatcatcttggatgagaaaggggaggcgtggaagcaaaagggcatgtgttccagctgtgagtcagctccctttaaacagccttcctgaaagttccacacgacccttctctgtgtgtctcatggctaagacaatctcatggacacatcaagctgcaagggagtttgggagttgtagtcttagctggttgcattgcagccgctaatgagatcagggttctattacaaggaaaaagaggagaagagatattggatggcaatgagcaattttcataacatgcaaaatagtagtatctacctcctaggtttcttgaaagaaaacatgaaaattgtgagtagtaagctgtcaataaatatttgctgttaacgctgtcagatcttctcagtgtagccttgccagagttcaagtccaacattttacttacgtgaacttgactaagttcctcaaacattttactctgttcttttaactggggtttacctggatatggtgcccttgtagttttattggtgtgagctcattcttaccagcagccgcatgtcacctgtatgctaccagactaaagtgttcagtgaactattacactttcagagaggaaatacactttatttccttaaatgaacagtttctttaatgaaaaaaaaaaaaaccctgtaacgtcattttttttttccaaaaaaaaatctaagcctccaaacaatttaggcatcttgtcttataaaaccagtggagattgtgccagtattatggaacattgttaagaatttgccaggttaggacgggcacggtggctcacgcctgtaatcccagcactttgtgaggctgaggcgggcggatcacatgaggtcaggagttcaagaccagcctcaacatggagaaaccccgtcactactaaaaatacaaaattagctgggcatggtggtgcatgcctgtaatcccagctactcgggaggctgaggcaggacaattgcttgaacctgggaggcagaggttgcggtgagccgagatcgcgccgttgcactccagcctgggcaacaagagcgaaactccttctcagaaaaaaaaaaaaagaaaaaagaaaaaagaatttgccaggttggttgatttaattatttcttttcagtgccgtggtaactctttgtcttttgtattacctaaaccacttgcgaagtgtttatgaagcaaaatgaggaaagttatgttttttaattttttacaatctctactgcagactgggaccacatatttatcaaaatgctcctctgtgttctttttactcatcattttactgcattataattgtggctatcatcatgatattctaggaataataccttatagtagtttgcaatgcattcttcagttagaaggaaagtaagactgaagtgatgtaattaattatgtagattttccctggcatttctacttcttccccattttacattttttcttttcttttttttttaaatcccccaatgttacaacaaccccgttttggttttttttttctttctttttttttttttgagacagggtctcgctattttgccaagctagtcttaaactcctgggctcaagcgatcctcctgcctcagcttcccaaagtgttgggattacaggagtgagccatcacacctggcccaacaacaaccccattttaaataagtatataatgtctactataagataggtatgtagatagtatagatacatctgcaggcataaatatacacaggcattatgtggtggggggggtatgtatttcagatttgaaataacatcttttgcagaagcttttctgggctgtaaaggcattatcctgtgcaaggaaggtagctgccagtgattggtggaccactgcctaggactgagttttaggggtatcagggatcagtattcactttcctgtttctctctctggttttcactacattgtggtcctcccccatctttaaccctcttatgttcctaccttccctacatgttgaaattatttaaggaagtacaggctggatgccgtggctcatggctataatcctagcactttgggaggctgaggttgggaggatcactttagctcaagagttcaagacgagtgtggaaaatatagtgggaccagaaagaaagacaaaaagagagagagaggaagggagggaggaagggaagaaaggaaggaagggaggaaggaaaggaaggaaggaaaagagacagaaagaaggagaggaaagggagggagggaggaaaggaaggaagggagagagacggaaagagaaagaaggaaagaagaaaggaaaggaagagaaagagaaagggaaggaaggaaggagaaaaaagaaaaattagcagaaggaagggagggaggtaggaagggaaaaattagctgcatgtggtggcgcatgcctgtagtcccagctacttgagagggctcagtgagctataattgcaccactgtactccagcctggatgacagtgtgagaccctgtctcaaaaaaaaaaaattacataaggaagtgcattgtttaaatctactttccttttagtttgtttgtttgtttagaaccaaggtcttgttctgttgggcaggctggagcgcaccagtgtgatcatggctcactacagtgtcgaacccctgcactcaagtgattctcccacctcagcctcccaagtagctaggtctacagtgacgcaccaccacacctggctaatttttgtatttttgcccaggctgatctcaaactcctggcctcagttgatcctcctgccttggcctactaaagtgctgggattacaggtgtgagtcattgctcttggcccttcagctagtttttgaccactagctggtagtgcacaattctgatggttaaaatgacattttaacacagattttctttctttctttctttctttttgagacagagtctcgctgtcttgcccaggctggagtgcagtggtatgatctcagctcactgcaaccttcacctcctgggttcaagcgattcttgtgtctcagcctcccaagtagccagaattacaggcatgtgccaccacacttggctaatttttttgtatttttagtagagacagggtttcaccatgttggtcaggctgatctcaaactcctaacctcaaatgatccaccctcctcggcctcccaaagttagcacagattataacataagaagtggtaatacatttttaaggaaagaaatctctagcgatttaaagtttatcacagcagacagcctccaagtgaatacttgttatatttactttgacccagtgtttctaaacaagaaaatttttgctcaaatactgaggagaaaaactcaattttaaaagttaaggaaaatatgaggaaaaatgaaggttcagaagagttatatagttacccatggttctgtcttctacaattcttgtctcatttttgttatgtatgtttcttatcttcaactgtataatatgggaatttttcagaattagtaattagataatcatttttgtcattgttatatttggtataaaatgtctcaagtcttttggcttctattaattcatttttctgatgtaatgcatcagattaaaaagctcctgggagatacaattataaaagcaaagagtggagataagtcatctgattacaactctccccaccctgctttatttttcattttagggcttttattgttgtttttacttagtttatctgagttaagtagcaataaactgttgtttaattcatagatttttttcaggatgttttgtgtaattttccatcttctagtcatgtatacttttacaaattattccattctgaaatatttcaggaagaaagtaatgttttcctttgctaagtttcaggctaatggaactttaaacccgatctgttttcctagaaaagcaggtatttgttttttcagagaaactagctggatgcttggaagtatggtccttaaccagaaaccctatgacttgaagctctgctggagcctgacccccttattcaaggctgttcagagacagagcttgggaaaagtaacagccctcttgttaattataatttgggtaaataaggtttcatagcatcaagcctatttttagttagtctgccttaattcatggcccatgaattatttcctgtaaatctttattttgagagctgaaaacatttctgaaaggtaccttgaagcaccgtcccgtggtccattacagggcgagaggccgggacagaacttggtcaggacatcagtatgtgaaggcggaactcggctcagtggaaatgttttgtgctggaagcactttgtcccacttacttagtctctctaggagagttttaatacggaccaaaagcctccctttcattgcggcagtctttttcagtaaggcagaacagtggctttgacttgagaaattatcacctataaagcactcttacaggtacttcagcttacagttcaagaaaattgtttagttgtcaaaaaaacagagcttaaggccttttgaattatttattgacaaatggaaatgtacacaaagattgctttctgtggcaaagatagacaggaaaagtgtcctttaccagggaaatggaaattggatgcaaggaatatctttctggctatgtggcaccaagcccagccaaccatttagaaaaataattcatcagccagtaaggcagttccaactctagacacatttttccaaacaagcagataagccaaatagggcttcagcacatttagtaagaaaatacacaaactaccccgccagaaggagcgccagggttcacagcaggctttcaatgttttccgtggtgacagatttttatttttaaagcactttaacctcaagacccttaaactttatgttgaattcagacctgatctaggtgtaataaaagtgctcatggcatcagaaaagcatgaagtgaaccgtggccacgtttcagtgtgctgtttcttatggtgcttgagttgctgggctctgggctctgtgctgcccaacctccatcaatagaccacgcagacaaagcagaattatccgcatcattcacggaaatcacagccttcctttaagaagttcaccaggccagaggcggtggctcacgcctttaatcctagcactttgggaggccgagtcgagcggatttcctgagctcaagagtttgagaccagcctgggcaacacggtgaaaccccgtctctcctaaaatacaaaaaattagctgggcgtggtggtgggctcctgtagtcccagctactcgggaggctgaggcaggagaattgcttgaacctgggaggcggaggttgcagtgaactgagatggtgccactgcactccagccaggacgacagagcgagactctgtatccaaaaaaaaaaaaaaagttcaccaaaccaaaatctagcggttatgtatcctgaagtacgcttatgctaactacttcagtctgtgcccaaaaaagacccgcaagaagttgagagaagctatttgatgagttattgcccgtgacatttgctgtcacctcacaatttaaagctgatcatttctcaaacttttatttcagcctcttaacactgggacctgtagtttggcaatgctgccagcaggtggaggtggtgtctaaatcactggtctcacctaaatgcggcggtgctttctctccctctctggacacagccctcagatttctaaccaggcattttccagttacttgtttaataattattaataatgataaagacagtaataacaataataaaataaaatacctgcttaaaatagctcacatattattttttaaatattgtgcaagacatcttatgggacttggggttgttttaatttttttttttttgagacagagtctcactttgtcacccaggctggagtgcagtggcgcagtctcggctcactgcaacctctgcctcccgggttcaggtgaccctcctgcctcagcctcccaagtagctgggattacagatgcccgccacaatgcccggctaatttttgtgttttagtagagatggggtttcgccatgttgcccggtctcgaactcctgtgctcaagtgatccacctgcctcggtctcccaaagtgctgggattacagatgtgagctaccacacctggcctattttaatttttaaaaatgtgtgcttctggtatcttctgtgaaaaaaatttttaaaaatttttaaaaagtgtgcttatttgtttgagttctttatataagaaatttgtattacttagtcatttttgaaagggaaaaatgaaactgtcacttgttttcataagttttaaagaaacacacaggtcccaggggtatccttgtcttgtcaagaactacagcttgatgaccggcagaatatctagtgtctctggctacttatctagcagtggcagaggatctgctttctgtaacagatatgacgatcacttcctcctatcttttttttttcccctcagagacagtgtcttgctctgttgcccaggctagagtacagtggtacaatcattgttccctgtagcctcgaacccctggactcaagcaatcctcccacctcagcctcccaagtagttgggaccacaggtgcaccccaccataactggccaattttttttaaatttttcattttgtagagaagggggtctgactcattgccctggctggtctggaactcgtggccttaagtagtcctcccacctcagtctcctgaagtgctgagattacaggtgtgagccattgtgctcagccccatatctaagatttttaaagctagttatggaaaatactttcattaatctttttactgtctgatcatgtggtgtggaatttttccccttggctaacaggaggtattaccctgatacctgagtagaggtgcaaagtggttcattttcttctgtgtcccagaccagaattagttattttgcttactatgaaaaagttgtgcattagctcttagtagtaaatagtgataaatctcccattttttaagaaccatggtccagaccccacaatccctctttcaaacatttcatataatccacatttcagcccaaagaagtaggttacagatctcttctttctgtagatgagaaaacaagcctttgtgagagtaagcacatcacctttagtgatagagtccggtgtctagactctctagacaaggggggtggggctggctggggctttgattacaaagaacctaaaagaggcagattgtgtcctgttatcatagaatattttgacgtaaaatataaacctggtatggtgcaaactacaaatttcagttggttcccacagctggaagccttacagtttctcctttaaaagaaatccactgctcatttccctgttgtttaggatcacagccccgaaagttgtgatgtctaaatgccattattaagggacctgtgaaataaattatggtatattaatataaaatgagatacttttcagccattaaaaagaatatctatctagatatacttacttggaaaaattaccatgaaataagcaaattgcagaagaaggtaatatttcttggtgtgaaagaagtgtgtgcttgaaatgcatatgtttttccaaatcgtatttatttttaaactttttaatgagatatagtttatatggagtgatatttacaaatttttttttttttgagatggagtctcggctctgtcacccaggctggggtgcagtcatgtgatcttggctcacggcaccttccaccttccaggttcaagcgatcctcccacctcagcctcctgagtagctgagaccacaggtgtgcaccaccatgcctggctaatttttttgtatttttcgtagagacaaggtttcaccatgttagctaggctggtctcaaactcctgacctcaagtgatccacccacctcggcctcccaaagtgctgggattacaggcatgagccaccgcccccagcaatatttacatatcttaagtgtacagtggagcttacatctggaataatatactccaaacttttaagaatagctaactatttttttgtaattttttgtaatgatcatgttattttatatatgtatctatgtgaatatgtgttatatatgcatatatattttttgtttgttttaaagaaaaggttagatgcacacatttacactcatgttcaacttgagaagcttcccagggatctcagagatccatcccatcttccatcctgaaatcttccatcctgaataggagaatatgcctgggaaattttactttaacagctgaagatttggaaagccagaagtgactgagagatcaaggccactcttgttatttcttaccagactgtgcgttctgataagaaatgttgggatgttggactgagcaccctgttttaggcccccgccctcattatcagcccccagcaattcctcatcaggaaaaacaataggcattcctgaggttctctccaattctctgggcaccagaaacacctccttatttattttagtacatttgtgaatgagtgtatattaagcattcccagttttcaagataacaagttcaaaaggacaaaaataacatgtatttatttttgttgccccataacatatagtgaggcatctcagctgtcacaggcagataataattatgaattgacaatttatatcattaggtggggcacagtggctcacgcctgtaatcccagcattttgggaggctgaggcaggaggatttcttgaggccaagtgttcaagacaagcctgggcaacatagtgagaccccatctctaaaaattagctggatgtggtggcatgtgcctgtagttccagtgattcaagaggctgaggcaggaggattgcttgagcccaggaattgaaggctggagggagttatgatcacactactacactccagcctgggtgacagaatgagaccctgtctcttaaaaaaaaaaaaaaaaaaaaaaaccagtttacacaattgaatactgaatttctttcctaatcccccaccccctctatcaacacttctgtccaccctcccttactttcagagtcagttacttcatctgcacttgtttacccataaaaattgccttggtattgaggggtacgtgggatggatattggagagagcctaaaggaggctatgttttctcatcagtggtttcattatcaccagaaccctcagcctgtggtagataaagctgggagggagtatgttagcattccaggctcagggcggggtagaccgtgctggtgaagtgggagtaatgagggccctggctgttcccttcaattcgagactagaggcatcgcctcagggctccccacgccaaagtcctcggactccagtgatcacctttgggtccttctgctgcctccctttaaccttttcagctttcactggtttaaatcatatcctgggccagacagcagaagctgtgccacctttcagtaggtgtgcttgtaatagggacactgacagaggaacaaagctgttagatcccataatttctgacttctgtccacccatatttctccttttttttttttctttttttgagacagggtcttgctctgtcacccaggctggagtacagtggcatgatctcagctcactgtagcctttgcttcctgtgttcacatgattctcctgcctcagcctcccaagtagctgggactacaggcgcacataccatcatgcctggctaattttagtattttttggtacagatggggtttcgccatgttggtcaggctggtctcgatctcctgaccttaagcgatctccccgccttggcctccacatttcttctcaattatgtaataaaaagactaattcggaggtacactcgcataagaaagcagaacagcttaagcaaagagagtgttaccttgctgagggaaaagaaggaattaatttttattgccacctttgtgtcacatgctgtgtctccagcattatcgcccctagcccttacagcaaccctgtgggactggtgttgtcatcacctctgtttcaccgctgagatcacaggaagcttccgagtggaggctgagccagagctgtctggctctagtgcctgtgccattccactcacattggcttgcaacttggccctgactactgatgataaagcctgggagatagtatctgtgaagtacctagcttggtgcctggcacatacttagaaaatgttcctcccaacagcctcacccatcctcagtcaccttccacccttctgttggaagcatagcctccaccaataatttcttctcaaactatttttaacaggacctcggacagtgatccaccctaaagcaagaattattgcggaagccgggccaatagtgattggcgaagggaacctaatagaagaacaggcccttatcataaatgcgtaagactcttatacatactgtgaaccaagtaccatgggtaacggtttttcttaatttcagctgtctgtaagaaccttttcagctgacatccaggaggcctactattttagagctagagaagcattaagggtctttttcaacataagtaaatgagcaaaccaaataccatatgagggaaaagacttgtccaagatgagagagctgagtagctgcctagaatctttgacgctcggtctggtgatcttccccttacatgtggctatctcacccattccttaagcaaacatttcccgaacacttcaagcctccaagtgctgtgcccaccaccctgcagagttttttttttttttgattttttggttgtagctgaaatgttattactcatgcctaaacacgtgaatttaactcaaatatattttttcacatgttttgcacaggtgacacccagaattatagttgaaaaatgtggagtcttagaggcaatttttaaactgtaaagattaaaaataatgaaatactagaacatgtgcatgatctgagtgaactagactgtaatacgtatgaatttttcataaacataagttctttctagataaaattttgggaaggaattcaagcttatacctaatttatagcaaccatgtatggaatttgtaagaaagaccttgggaaaatatttaactgtcagaaaaagactgatttaatgcttacttaggatttaaaatacatttggcaccttcagtgtaagtcaattaacagcaactatattctgcagtaactcaactgtcagagataaagcaccatttaaaaatggcgtccacctcttagaacacaaacattttatcttccaaatatttcaactagctaactaatagcaataattattttatgtgaatatctgtttatgtttcacaatcccaaatgattattaagggtggaaaattttcaagttaggcatgattttggttctaattaacagcctaaaaagatagctagcatcttctttcctttgtcctggagaagacccactggactttgaatttaaaaaataaagtaggctgggcgtggtgcctcatgcctgtaatcccagcactttgggaggccgaggcgggcagatcacgaggtcaggagttcaagaccagcctgaccaatatggtgaaaccccgtctctactgaaaatacaaaaaaaaattagccgggcgtggtggcaccccaccttgtagtcccagctacttgggaggctgaggcaggagaatcgcttgaagctgggaggtggaggttgcagtgagccaagatcgtgccactgcactccagcttgggggacacagcaagactccgtctcaaaaaaaaataaaaaataaaaaaatcaaataaactaaggaaggctattcttttccacacaccaatgacttcttcacttttcagtagctctcttcaactcaaaatcaagccttctctagcacacaggatgaatgaatcacttgaattaagaaataacttacataggctgggcgtggtggctcatgtctgtaatctcagcacttggggaggccctagctggtggatcacctgagatcagttcgagaccagcctgggcaacatggtgaaaccccatctccacaaaaatacaaaaattagccaggcctagtggcacgtgcctgtagtcccagctactcgggaggctgaggcaggagaatctcttgaacccgggagacggaggttgcagtgatccaagatggtgccactgtaccagcctgggtgatagagtgagattccatatcaaaaaagaaagaaaaaaagaaataacttatatagtcatgtcttttaagcttgatgtaggtaaaattgaaagaattaacccaaattcgaaaatgggaagaaaattgcttattgtgttattgactttttggatgatttgtttcttctgtttacagttacccagataatatcactcctgacactgaagatccagaaccaaaacctatgatcattggcaccaataatgtgtttgaagttggctgttgtatcctttacaataatctaccataaataattcctggctctcctttagtacctaagtcttctcctgtagaaattgtaaataattcctggctctcctttagtacctaagtcttctcctgtagaaattgtaaaattgtcataatttatctatcaaacatacttacattcacaatatatattataattacatttttaaaagtaggtcatccaggctgggtgcggtggctcatgcctgtaaatcccagcactgtgggaggccgaagctggcggatcacttgaggccaggagttcaagaccagcctggccaacatggtgaaaccccatctctactattaaaaaaaaaaattacaagaattagctgggcacggtggtgcacgcctgaaattccagttacttgggaggctgaggcaagagaatcgcttgaactcgggaggcagaggttgcagtgagccaagattgtgccactgcactccagcctgggtgacagagcaagactccttctcaaaagagaataaaaataaaaataaataaaagtaggtcatctagctctttgaacagacttcttgaatagtatatattttaaaaatggtcccttctgttcctgtaaataagtcaatagagtaaaataagtatgccgtttttagacaaacgcagacacacacatatctttagctcagcactttgaaagaaaccacttcttttgctggtactacagcttgttgacaggtagcaatggctgagtgacagtaaacatagaagcagcaatgctggcttccttcttgattcaagaaccccagctttgtcagtgtggttcctctgtagttttaggtagacaatgcattgtctgattcaagaaaatggtgtgtaggggtgaaaatattccattattcatgtgttgtcttttttcctccctagaatgtctccagttcttttgcttagtttagtactctaaaaagatagtaaaatcagggcaggcaccgtggttcatgtccgtaatcccagcattttgggaggccgaggcgggcagatcacctgaggttgggagtttgaggccagcctgaccaacgtggagaaaccccgtctctactaaaaatacaaaattagccgggcgtgatggtacatgcctgtaatcccagctactcgggaggctgaggcaggagaatcacttgaacccaggaggcggagattgcggtgagctgagatcgcgccattgcaccccagcctgggcaatgagcgaaactccgtctcaaaaagattaaaaaaaaaaaaaaaaaaaagatagtaaaatcttatggtgtcagcaaaacatactatagtagaaaatatttagaaggaaaaatctaaatgttcaatgatagcaagatatttaaataaattgaactatgagcataaaaccactaggagcattaagcagtcatttaaagttatgtttttaaagattttttttttattttatcttttctgagacaggctcttgctctgtcacccaggctggcattgcagtggcacaatcatagcttactgcagcctcagctcccagactcaagcaatccttccatctcagcctcccaagtagctggaattataggtgcacaccaccgtgcccagctaattttatttttggtagagatggtgtctcactctgttgcccaggctggtccttgaacccctaggctcaagcaatcctcccaccttggcctcccagagtgctggggttacagatgtgagccaccctgcctggcctaaagattttaatagcgtggaataatgcttgcaaatttaagtgaactgaataagctataaaagtttatacagtttgattcccacttatatacaggaaattctatatatttatataaagatatatcaaacttttaacagtgtttaagtgattgggtgatggatagttttaattatcttgaaacaattatgaaaatattttactcataaaatcagggtataaggtgctcatttctttaaaaacacaagtcatttatttatacctagagatacttatgtttaaagattaaaccgttaccacagattgcccagagcaaagagttctggcaagggtgagcctgcatggcccatctgacacccctgtcctctgtcccagtgcaatgtaagtacatactgtgttagtggggactaaagatgaacatatttgtagtatttacctaactctggcttacagattcccaagccatgaagatgggagataataatgtcattgaatcaaaaggtaagctacattcagagtttcattgtcaaagcagtgacctcttttctctttgtggtgtcctgggaaacaacctaatagaaactgtggcaaggtgttgtgcttggaagtgggctacaatagctggcgaactaattgtttgccactaaggaacctaatctggttatgtggttatctggtaatgttaaatacattaaatttaaaatcagctatgtacaggattgaattaaaccataaactttaaatgaaagatttggaaaagatttctactaaatactagtctctgaaattttagttggttagtgttgttgtagaattaaagggggggaaaaatcaaagtttctgtagcagttgttttctttaatttcaggaatacttttccctagccaatcagaaacaaatatcatgtgcttgtaagtgggaccagacaggagattacctaaagtcactgtcactactgggaagcaacttcaagagcttgtcccaccaaggtccagaaaaaacctgaatgatgacaattctttagaatagtgggttatctttcttggtcctgagtggcacgaaagaaaatgcttctttttaaaataataaaattacactttttgttaatctacttaatgacttttattttaatttggattatcaattatcactattatcatcagcattttctatttattttatgcttactgtgtgtcaaacctgtgctcatcactttacatctgttatcacatttattccttaaactgtgaagtagagtggcctctttgttttatagatgaacttgagcttagagactttgcagcgactttcccaaggtcacacaaatagcagcagagctccattttgaattcatctgaccctggcttgtactgcctgcctctgtgttgtccatacaaactccaaactgatgtattttctttaacttttttcttgaggccagtttacatttttatacctaaatcaccttaagaaaaaaagtgttggaatcatttgatgtcttaagttgcagttctttctgtgtttttattgcagcatatgtaggcagaaatgtaatattgacaagtggctgcatcattggggcttgttgcaacctaaatacatttgaagtcatccctgagaatacggtgatctatggtgcagactgccttcgtcgggtgcagactgagcgaccgcaggtactagaacctctctttaaaaagagttctatctgctgattttcccaaaatacaatgtaattgtcttcatgaggcagcaggtacactatttaagaacataattaaaataaaacaaaagatgccagtctcagtgactcgtgcctggaattctagcactttgggaggccgaggcaggaggatgacttgagggcaggaatttaagagcagcctgggcaacatagtgagactctgtctctacaaacactagaaaaactaagccaggtgtggtggggcatgactatagtccagctactgaggaggctgaggtgggaagataattcttgagtgtgaggttaccatgagccatgatcatgccactgcactccagcctgagcaacagagaccccaactcaaaaaataaataaataaaaagaaaacaatgagaaacatcccgaaaaccaggatttaattgcagttcaatccctaaaaccaagatttaattgcagttcaattatttagtctttaggttaatatcaaaaatatatacaaggatgacaatgacaagtcagttatgagaaaagatccagaaatgttactcttggtctcatgcattgtcactgacaatgcataaacaaactgtacaagccatattgatttactcctaaaatatcagtcttcaaggttaaggaatgaccatactacatttatcctgtgcctctaactggggtgtgtctatttattgccatagcttcataataaacacagcttgtgaataagaaactgtgtttggatattttcctggcttgagaaattatctcctcctagaaattcagatcaagaataatgtagagtacatatttggagtttaatattagagtaggagatgaaaaagataggacatttgggcttcctttggacataagacatttgtattgcagtttcgagcctcattgcttggcacattcaatatatatttctttagttacctagcctccttttcctcccactaaagaaaatagtttcaagcactgtgcgaggccaaggcgggcggatcacttgagcccaggaaggagtttaagaccagcctgggcaacatcatgagaccccatctctacaaaaaataaaaaataattagttgggcatggtggcattcacctgtagtcccagctactttggaggctgaggtgggaggatcgcttgagcccaggaggtcagggctgcagtaagctgtttgtaccactgcactccagcctgggaaagaaaaaaaaaaaaaagaatagtttcaagacataactttgcttctgattcttagccatattttatcagaaatcaaaactccagttctttttgggttactctatttctgtaatgtttggcttcattattattattattattttaagcaagtattactctatagactaaaaaggaaataaggtcaaatccagtcatttgttttactttctacataacagcaaaaatgactgaagagtgggaaatgaagcttgtgttggggaagggagattagaattaagtgagcaagaatatctgaagctttatattttataatatgcctaaatttcactaatcataaggattatgtagaggtctttattcaaaataaagattccccagacttactgagtcacagtgctagggcaggggcctaaaaatctatatttttcacaagtaccgcagtgagttttacaatcaggaaaatctgggcagtactggtatatgaagagtgaagatcagacagatgtaaccaacaagtacacctcagctgtgtggctctgtaggtcacgtggaaaacaaaatactctgggtgttttacttatgtggtcttctgtaatcggaacttttaacttttcagaagccagggtgaaatctacaaaagcgagttttaaaactgatttctgtatatttttatataaatatataaaatctgttggctttttcttgtaaccaaacttagtatatgttccttataaattaaaaaaaaaaacaagcatgtaagcaaaaatgagtcaatgaaaagcacctgtaattccacaacttattaataaccattgctacctggaacttttttttttttttctttgagacagggtctggctctgtcacccaggctggagtgcagtggtgtaatcatggctcactgcagcctcaacctcctgggctcaaacaatccacctgcacccctgccgccctgcttccacctcagcctcctgagtagctatgactacaggggtgtgccaccacacacagctaatttttaaatttttttagtgacaagatctccctatgttgctcaggctgttctggaactcctgagctcaaatcatcctcctgtctgggcctcccaaagtgctgagattacaggcatgacccaccacgcctggttgctgtgtggtactcttgactttgctttctgccaatcggccttaattaccttatctttttagccccagacactacagctggatttcttgatgaaaatcttgccaaattaccaccacctaaagaagactatgaaaggaagctcaactccagtaaagaactaagaacagtgtataacatgaagataacattttgtctttgaccactgtcttttgaatgggcccacagtgtttatgtactcttaacaactcacagaataatacatgttcactttattttgtaaaattgggttgagaggaaactaatggagtttcattgtaactgtcctttgtaatttatataaatgtattattttcctatatccttggttcttttctgataatttacagatttagcttttcttttgttatataaactgctagccacaaattttagttatgtaaaaggctacccttgacaagaaaagacatactgtcatgtatttatattctagcatagactaaactgaataaaaatgctgataacaggacctttagtaagcatactttaatcagtttttctccttgaattaatcttttctcttaatttttattatgtactagttgtattaaagctaatgtgtttactttttcctcttgtggatttgtagctgtttaaaatttcaggtgaatttcagtagctattgaattaatttagacttcactttgtttttaagaaaagtacaattttttctttttggtaaaacaaaagtaatcagggaaagatgttttcagtagaatacaaattagtggcattcttgggtttctgaggacaatgaaactaaaagaaattttgaaattatacaaatttatgaaattattaatattttagcatagtgctaatcactaatcattgagctttattattctgttgtctatgtagtgagcaaaatgttgagaattttataattccaaatttttaaaataattcaagtgcataaatttactggaacatacttctcaacttttgaattagtagatattgactaatactaagatactaaaatactaagatattctctcaaaatttaatttttatttatttattttagagacaaggatctcactctattacctaggctggagtgcagtggcacagtctgctcacatggatcacttgacctcctcaaactcaagtgatcctcccgcctcagcctcttgagtagttgggactataggcataagccaccatgcctagcttttttattttttttaactttttgtggagacaggatctcgctgtgttgcccaggctggtctcaaactcctgactcaaaatttaatttttaattgtgaatagaaaaaaatatatttttgaatttctgaaactgacagtgcaaattagcgtaatcattcgaaattggaatgattttggtaagaatactcatgactaaacttggaaaactatactgtagcagatgaaacattgagcttttgaaaaggagaacataaataccctatttctgttaactgctatttattcatttttcaaccccctggtgatcagttcagaatgttgttgatcatggaaattttctagataaaagaaatgagaaattacaagacagtctttgaaattctatactggttctaatgtattctctttggacaggctctgatatgctaagtaaatggcctctccaaactacacaggtactatgtggggcagcagtgagataccttctaaggacttgataagaagaaaccaccagagagtctacacatagtgaggagagtctcaatgcttcccaggtacactgtaggttattacatgatattaactcatttgagaaaagaaaaccgaaattatcaactcaccaaaatggggtttgaagaaacaaaatatgacagtgtgtatacagtgttatccgtgaaaaggaagtcctgcatccaagagatgtgagtaattcagtgaccaaaagtgttctctacttcagttaggactagtttatcaagacccaaggtatgtggcttagggagaacataccttgagacttgccacttcttttggcactaattacaagcctaactgaaccatcttctgattgttgatatggccttttaagctattgttgttcaggaaaagggagaattctgcatgagggcaccaacatttcattctgcacatagtaaatttagagaaattctctggtttatatgtcagtctcatgtgaattttgtgtgtgtggttctgcccccaagtttgtcagtttagcctatgagtttctaaatattctgatgaaacatagtttctgattcttcaggatagagaaccaaagcccggacagattattgcaaacttcactctttggggcttctgcatagccaggctgtcagccttcttctagtggcactctatctcacttgagactacactcaaactgcatcccaaatattctagacaaataagctaagtggtaaggagaacccagacatccatgtgacatgaggtagtaactgggcagggaaaagagagaaaccattttatcaaatcatcttattgcaatctggcactagctcttcgggcaagatgatggatcttcaccagttgaacagtgtaaggtctagaaacagtgatgaaacttcacttcatccataagcacacactgtagtagttatgtatgctgtgtaacaaattacccccaaaactaaaacaacacacatcttattagctcactcagtttctgagaatcaagaatctgtgtgtggcttagctgatgctggggctgcagtattcatttccaagatggcacactaacatggttgttgcccgaaggcctcagttcatcatcacatgagcctctctacaaggctacctgggtgttctcttgacatggcagttggctttctccataatgagtgatcccagagaggatggaagccacaaggcctttcatgacccagtctctgaagttgcacacgatcatttccaatgaatttgatttgttagaagtgagtcactaagtccattctacactgaagggatggggaattaagctgtaccttttgaaggcaatagcatcaaagagttcatgctcatatttttattttttattttatttatttatttatttatttatttattttgagacagagtcttgctctgtcacccgggctgcagtgcagtggcacgatctcagcccactgcagcctctgcctcccaggttctaatgattctcctgcctcagcctcctgagtaactgggactacaggtgtgtgccaccatgcctggctaattttcgtatttttaatagacagggtttcaccattttgcccaggctggtctcgaactcctgacctcgggtgatccacctgcctcagcctcccaaagtgctgggattacaggcgtgagccactgtgcccagcccatgctcatatttttaaactccagcatgtatgtacacatccatttacatctgggtttctcccagtgcactatcagcatctctttagagagtctccacactgggaggaagatgactttgggaaggactgctgtatattaattgccatggcacatgacgtcatcaaaggtcatcttacccacttgaagccccattatgtagtgttttctgacatcaaatgtgtggtttttccaacaccagcaaccgattctccaacaccaactgaatgtccagcaattcagaacagttctggtgctatctggagttagcccagaccccacactcccataaaactacacccacttcatttgccagcatcaaatagggtacccaaactacccatacttctgcccaccccaactccaaattagggtattcccatgatccttcaggctcaataattctctagaatgactcagagaactcaggaaagtgtgtatttactactgcagatgtattacaagggtacaactcaggaacagctgaaagcaagaagtaccaaggccatgggatgggatggaatggcacagggtttccattccttctttgagcacgtcagcctcccagcacagcaccagcctggaagctttccaaatctaatcattcaggagtttttatgatccggtctgtagcccctctaacctccctggagtttgtgggtcagggctgagagttctgatcctctagccctatgttctcattagcatacaaaagacagtacattccggccaggcatggtgactcatgcctgcaatcccagcactttgggagattgaggtgggcagataacttgacgtcaggagttcaagaccagcctggctgacatggtgaaaccccatctctactaaaaatacaaaaattagccaggcatggtggtgggcacctgtaatcccaactacttgggaggctgaggcagaattgtttgaactcgggaggcagaggttgcagtgagccaagatggcaccactgcactccccctgagagcaagactccgtctcaagaaaaaaaaaaaaaaaaacccagtaatttccaagggtctgagaagctctgtgccagggaccagggacaaagaccaaatattttttattttgccacatctatcttcttagcaatttagattactttcccttaaatataacaaattccattaagcatcagtttaagttgaggcgtaacagaaattattattagcaaaaaccttgagagataagaatactaagcgggagaaataatagaagaactattttaaccctaatatactttgtcaagtctgacttttttaaaaatcgcatttattaagcttgcatagagctgactacatgccaagcactgttaaaagcagtttacgtgtaacttgttaattgcacattatttcctttaattgtcttaatcaggtaggtgatattactatccttattttgcagaaattgaggcacaaagaggttaagtaattgccagaggtccactcagctagtaagtggcattttggctccagagttcatgatcttaagcatattctctgttgctttattggaagactaaaccttttaagatagatattctataattcagtgggcttcctaaatgcaaatggagaaaacagatgtggattcacctttcctaaacgctttgcctctctttaaattcttcaactgagtgatcctctctgggatcactcatattctggaaaaagccaactgccatgtcaagagaacacccaggtagccttgtagagaggctcatgtgatgatgaactgaggccttcgggcaacaaccatgttagtgtgccatcttggaaatgaatactgcagccccagcatcagctaagccacatgcagattcctgattctcagaaactgagtgagctgggattacaggtgtgagccattgtgcccagtctgggtctgcttgttataactaattaactgtagtggtaatttgtggtggtgttttgttctgtttttttagtgtgtgtgtgttttactggtaaaagtaatacattaataatttcattttacacagtttaggaggtggggagaaaacacttctgattccatggccccacctcaagcaccaccatttgaatcgttttggggctaatttttaatgtgcaatccaaggtgaatgaagatctctcagacacatgcaccttaaagcttcataattctcatgtagacctgctgttttaacacaagagggcaccagtagacaggatagtccccccatagtgtctagcaaatgggtgctcttggagagttttatttatttatttttatttgaagacaggggctggctctgttacccaggctggaaaacacaactcactgcaccctcaacctcctgggctcaagcaatcctcctgcctcagcctcctgagaagctgggaccacaggcttgtgctaccaggcccagctaatttttaaatttttttttgtggagatggagtctccctatgtttcccaggatgatctcgaactcctgggctcaagttgtccacctgcctgggcctcccaaagtgctgggattacaggcatgagccatcgctctttctgacccattttaaggatactttagactttaatactttattaaacaaaactaggagcagttcctttcttgtctcctttaaagggtgttgtatttaaatattttagaacatttagctgggactaggttcatgacactaaacacatgcaaatggaggctcaggctttgagaagagaatcattgtcaggcccactagagacccagccaagaatggattgattgcccaagccttcattgtcagcatccctctccacagggtttcagcattgctcaccttcatgaaagtttggtgctaagtccctgaatttagactttcttttttcctttttaaaattttcagtgacagggactcaccatgttgaccaggctgctcttgaactcctggactcaagccaccctcctgcctcagcctcccagcgtgcttggggattacaggcatgagccaccatggcctgcctagattttccatttcttaaactaactcagctttcattagctacctatatggttcagacttttgagccagtctctgctctcggtgaaaaataatgccggatgttcagaacccaaatttcccctactatgaagtcgtctgctccttggtaggctaatcactgctctctctgagttgtatgctttccaaaaatcagttgtatttggccgggcatggtggctcatgcctgttatcccagcactttgggaggctgaggtgggcagatcacttgaggacagtccaagaccagcctgccaacatgatgaaaccccatctccactaaaaatacaaaagttagctgggcatggtagtgggcccctgtaatcccagctactcaggaggctgaggcaggagaattctttgagcctaggaggcgggggctgcagtaagccaagactgtgctgctgcactcctgcctgggcaacagagcaagactccatctcaaaaaaaaaaaaaaaaatcagttgtatttgttccaaaacttgtttttgcaagttgtacttaataacgatgtaatttaattcaatattaccaaaatcaaacaattatgagtgtgaagagagtaatctctatgaaaaaaagttgaaaacttgggaaagacctgataaaagacgtgttattaaagaaaaaaatgctgtggaattaggtgtgggtaaagcaaccgtgaatgtttgggagggagagaaaagtgtcaaaatataggactttgccttcattttgtttcacaagtgtcttgagtcctcattctactaaagctgaaattgataatgcttcttgctgtgctaatcaatgtcctctgtgcagcctgcatcagcaggcccacacgcaaagaaaaggtcttatcctgacatcaaaggagtgatgggtagataaacctgtttatattttaaattaaaaataaaattttgaagatatatataataattttatgaagccccatatagctgacttttttctttaaccaaccaactacagattctgactgcgtagttaggatggccgggtgcagtagctcacacctgtaatcccagcgctttgggaggctgaggtgggtggattgcttcagcccaggagtttgagaccagccagacctcatctctattaaaaaaagaagaagaagaagaagaagaagaagaatcagaatttctgcagtatagttccaggagctgccaaacagtggtataaggaaatgaattgcctgggcctcaacatatcctcagtgtcagtgacacatgtatactttcaaatgaataacctctttttatgaagattatactttggcatcccttatctgtaggctagctgtgcttgattttagtagaatagatttttaggacttaatcatcattaatgtatctgtattagtccgttttcacactgctgatgaagacataccggagaatgggcaatttacaaaagaaagaggttgactggacttacagttccacgtggctggaaggcctcacaatcatggcagaaggtgaaaggcatatctcacatggtggcagacaagaaaagagggcttgtgcagggaaactcccgtttttaaaaccatcggatcttgtgagactgagaccaagaccaactcactatcacaagaacagaacaggaaagagtcacccccatgattcaatcacctcccaccaggtttctcccacaacatgtgggaattgtgggagttgcaattcaagatgagatttaggtggagacacagccaaaccatatcagtatctacacttgtttgttcagagaacaatttcaagtctgtcagcttatcctgcaactgtgcctaaaatatgttcctttttacttaaggctacctggcactgctgtagatgtgtaatatattttgcttaaatgcttagcatgaaagggaagacttccacttttggttgttgtaacccgtgaactttcgccattatgttcagtagactttgtaatcagaaaaaaaagaatgaccatattgaatcccagatggcattctttttttttttttctttttttaagaaagggtctcactgtgtcactcaggatgaagtgcagtgtcactatcatggctcactgcagctttgacctcccaggttcacatgatccttccacgtcagcctcccaattagctgggactacaggcatgcacaaccatgtccagttcatttttaaatttttttttgtagagacgagatctccctatgttgcccagactgatctcgaactcctgggctcaagctatactcctgcattggcctcccaaagtgctgggattacaggtgtgagccacagcaccctgccccagatggcattctttacattctaactttatcataatgcaaatagaaacattaaaaagctctttactaagttataattattaaattttgtttgtcccacgtaaaatcaagtgcattttcagttttgaacactgaaaatgaagggtgaaatctctcatgttggaaatgatattttgctaaggctgccttcctctttttgcaagatatgtggccccttctgtatgtttaaagctctgcaccaaagaagagacatatgagatcaaggacaagcttctgtctttcatgtcttggtccatttaagctgctgtaacaaaatgccatagactgaggggcttaaacaatagaaatttatttctcacagttctggaggctgggaagtccaagatcaaggtgctggtagatttgatatctggtgaaggccatctttttactgtgccctcacatggcaaaaggggcaaacaatcttccttgggcctcttttataaggatgctaatcccattcatgagggcttcatcctcatgacctgatcatctcccaaaggccccaccttcctttttttttttttttttttttttttttgagatgaaatttcactcttgtcccccaggctggagtgcaacagtgcaatctcggctcactgcaacctccacctcccaggttcaagtgattatcctgcctcagcctcccaagtagctgggattacaggcatgtgccaccacacctggctaattttttgtatttttaggagagacggagtttcaccatgttggccaggctggtcttgaactcctgacctcaggtgatccacctgcctcggcctcccaaagtgctgagattacagatgtgagccaccgtgcctggcctagtccccactttctaataccaccatcatggggatggaatttcaaacataaatttgggggatgggacacagattcagaccatagcacatcactttcttcttcctaacagatcttcaattttgttcaactatccacccatccatggattgactttaatcagtccattccaatgaatatttggcctttctctgatccacaggtgcatgtataatttgcctaatacaagctaagggaagaacatatttcatagttgggggaggttttccttcttccactggatgtgaataggggaacatgctgcctgtttggaactggcagccaccttaccaccatgaggggaagcaacaaaatgcaaagatataaaaaatatagatgcttcaagacatggctgaacccaaacttagagcctagtccttgtagataatacattttctccctatttaagcgagagtgaactgcgttgtctgtgacttgcagaaattttgtgtcctgttacaaaatatcaaaaagttgcctcaattttctagtgtcctgctctactgatgcagtaagcatctgcctggtcccaacattgctggctgctgtagggatggttaactgaaaaggggcaagagcatattatacatgtacagtcacacactgcataacaacgtttcagtcaatgacagaccacatgtatgacagtggtctcataagattataatggagctgaaaaatgcttatcaccaagtgatgtcatagccattggaacatcatagtgcaacacattactcatgtgttgtggcaatgctggtgtaaacaaacctactgtgctgctagttgtatagaagtatagtagttatcattgtgttacaatcacctatagtattcagagcagtaatgtgcagtacagg

SEQ ID NO: 1265 - DNA, 1023 bp, Homo sapiens
caaccctgccaggctctccaatcgcatgtggaattatcgctctacccaggcggtggtgtcgatctacgttccaattggggccgtaccatggcggagaagactcaaaagagtgtgaagattgctcctggagcagttgtatgtgtagaaagtgaaatcagaggagatgtaactatcggacctcggacagtgatccaccctaaagcaagaattattgcggaagccgggccaatagtgattggcgaagggaacctaatagaagaacaggcccttatcataaatgcttacccagataatatcactcctgacactgaagatccagaaccaaaacctatgatcattggcaccaataatgtgtttgaagttggctgttattcccaagccatgaagatgggagataataatgtcattgaatcaaaagcatatgtaggcagaaatgtaatattgacaagtggctgcatcattggggcttgttgcaacctaaatacatttgaagtcatccctgagaatacggtgatctatggtgcagactgccttcgtcgggtgcagactgagcgaccgcagccccagacactacagctggatttcttgatgaaaatcttgccaaattaccaccacctaaagaagactatgaaaggaagctcaactccagtaaagaactaagaacagtgtataacatgaagataacattttgtctttgaccactgtcttttgaatgggcccacagtgtttatgtactcttaacaactcacagaataatacatgttcactttattttgtaaaattgggttgagaggaaactaatggagtttcattgtaactgtcctttgtaatttatataaatgtattattttcctatatccttggttcttttctgataatttacagatttagcttttcttttgttatataaactgctagccacaaattttagttatgtaaaaggctacccttgacaagaaaagacatactgtcatgtatttatattctagcatagactaaactgaataaaaatgctgataacag

SEQ ID NO: 1266 - protein, 190 aa, Homo sapiens
MAEKTQKSVKIAPGAVVCVESEIRGDVTIGPRTVIHPKARIIAEAGPIVIGEGNLIEEQALIINAYPDNITPDTEDPEPKPMIIGTNNVFEVGCYSQAMKMGDNNVIESKAYVGRNVILTSGCIIGACCNLNTFEVIPENTVIYGADCLRRVQTERPQPQTLQLDFLMKILPNYHHLKKTMKGSSTPVKN

SEQ ID NO: 1267 - DNA, 92647 bp, Mus musculus
  misc_feature (1)...(92647): n = A,T,C or G
ttacctttctaccaaggcaacattatatttcacctaagatacatgacattatgttattatatagttttcattgtcctttaagccagtagtttccaagtaagattactttggaagctgttcaaaatcatcttggcttcccttcttcctcttcaactttgggctcagtaggtcttaggttaacttggattttctcctgtacagatagatgtctgtgtgtttctgaaacacaacggttctagcctgacatgtaccattatcaggaccggtaatctctgtactattacattgtcacagagactgtggcaggcatatggcaattctgggactcttctgatggtgtgtattaatacacctggggattatctagcaaaatttacagtgcctagggacttagaaaagaaagctgagaaatgtaactgtactatgggtaccatgggtgtttgctcagtgactgtacaaatgaacattatctgaaaaatacagaaaaaaaactctatggggcagagtatctcatgtagtttttctaggaccagggaacctagttttctgcattctccttaattactctagagtcttgtgttgagtctgggtagtcatgctccttagggaagccctatcaccacactgaaagaaggccctgcacagctgactgagaaagccatgggaatgcctagcctggaagctatttgcaaatgatatgctgatatttttgaaagttgcatgtgctagaaaggagaggacagaaatgtagtctgtatctgtcaagccaggtgagtgggttgaagtgacaagaagtaactttacagtctctgaagttctcccagcacaggaggtgtagaagcagcatgggtatcagaaaggatataagatcttgacaggtagtgtgtgcaataattcttccagagtaaaaatccccacgctttgtgacacgcctgtttaatcatgaatgctgaacatgttcagtgcatctcacagcacctatcacagtgaaacattcgccccagagaaacaatacagaaataataatggtgtcattaaccctacagtttgaagatgaagcctataattctgtaaggaaaactgattgaccttgggcagctagtgtcttaatgtttctcaggtgattgtgaacttcaataaatggttcatgtaaatcctttacccggtgaatctggctgaaagaatagtcattaagtttatagtctgaaactacccggagaaattatttgggaaattagtattagtattttatatgtttttggtggtagtggttacagggcacacagagtctccctgtgtagcccaggctagtctggaactcactttgtggcccaagctggtcttcccaagtgctagaatggctggcatgagccactcacttgggatagccctaatagtttactttttctcatcccccagaactgaggaccaaactcaaggccttgcacttactaggcagtcagtctaccactgagctaaatccccaaccccctaaggcctaatattctaaccatgatgctttttaaaatttctgtatttgtgaatctgccttctcacatgtcaccatccgttcttcaccccacacttaccatctgcctctcagatagatgctaaatatagagggcaatatttatctgggactgctcaaaggaaaaatgtttgacatgagtgaaatacctctgattaatgtctaaagcataagcttttaattgttttgacttcaacaaaaaattgcttcaggctggggatgtgcagtggttgattggggtcagcatgttagaactatgggtttgatcctcagctccccaaaatgacctgaaagtactcagatgtcacagtctgcttcctttttaaacacagatcataaacaccagctatgtggggatcaactttgttctgtgtgtctgtaaataaataggtggtctttttctaattcaggtaactggcctttgttgttcttaattctataagtgaactttttttacacttaactacctttaaagtttttatggtttaatctattttggatttggaaaccagatattgaagcttgctaagaattatttgtgaaaacgatgaggcttggaatctatgtgaaaataaccttaggcacagggtgggagggtggtgtagtgtcagacttactaactgttcaagctgtctgttgtgtgcattaagcagttagttctggatactttctgtgtttgcaacatgtttgcaaattttcctaatacttttccttcatttctgtgtctgtatgtttgtgtgtgcatgcttctgagtctataagtaggtgtggaggccagaggtgagcgagcatcaagtcttcttccttatttttctccactgtattttcttagaacctgaagttcactaactagctagcctagctggccagcaagccccagagatactcccatctttacttccctagagcaccttcttgcctggcctgttttcattaattagttaattgattaattgttattggttatttttgttttgtctttatttaatttattaatttttgttgttttgttttaaacatgggtgcaggggatcaaactctgtttttatgcattgtggcaagcaccttaccctgaactcccttcccaaacctaggtgttgtttttttgaggcagaatttctctatgtagttcaaaactgatctggctagcactcacttactggtcccccaggctggccttgagtttccactgatcctctatctctacttctggagcgctagggttaaaagcctgtaccaccattctggtttagctttttgttttgttattgttgggttttgttgttttttttttttttagatttatttattatatcttaagtacactgtagctgacttcagacacaccagaagagggcatcagatttcattacgggtggtataagccaccatgtggttgctgggatttgaactcaggacctttggaagagcagtcagtgctcttaactgctgagccattgttgcttttattagtttatttctgtgtgtccatggtgatgggaaggtgtctatgggcacatatgtaaaggttggaggctgacaatttgtaatcttctacctgtcatttatgtaaaaagttttctctatctatagattaaggtttgaaatggctaataaatttaagtttttggcctttgattcctggactctaaataggggtgtgtgtctgtctgtctgtctgtctgtctgtctgtggtcagaactgaagaaggaagaaatatctcaacaagaagataggtactccagcctccccttgtgtcccctttttatagttgtgacagttgactctcagaaacgaagtccacctagcagcaagattagcaatgcatttatcttgctttgtaataagaatcttcgtaagtgtcataggcaacaagacagctaaaagctgggggttggagctcagtggagcattggcctggcatggatgagggccaagacttaatctccagttaggagtttgttagatgctattacagtgtgtgcattgcattgcaagtttatatccgattctgtgggtggttcctgataacaagttaaattgggtgattttaattttttttatttttattgctccttcccaaggaaatcatttggaaaactattaatgtcatttttctttgtttttgttttgtttaagttttgctccaattcaaaatttcatttcagaattacaaaataatttttaaaaaagaaagatcatctaatgttaacttttaataccccgaagttgcataattaaactttttattcattgttgagctatataattatttctcaattttctgtctttattctacagaatggtaaataaggctggccatctttggaaaggccattgatctgcctcatgtaaagtatgctcagctcctttccagtggtgtaagtatgcgatttcaactcttagtctgtcagctgcgttagtcatgataagtgactaggactgtgactcagatttgacagcaaatgcttttagaatccaaataattcttttaaatggcatttgtttctttatgtcttgggggtggttgttcagttgcttccgcctgtgtgtggaggtcaggacaggttggtgcagtgtggtaggtactctcccccttccatgtgggatcaaactccagtcatcagcttagcaacaagcatttttaccctctcagccatcttgtcagcccaagggcaaagaaacttttagaaaactcttcagatgatgtatctctttgacatggggataaacaagtatcatatggtgaggatgaggtttcaaacctgtgagcttttttctttttttttttcttttctttaatcattttttaacattgtgttttgcccttttttcatttaaacataaattgttcatatttattattttcctgaagttattttattttcattatgtatatgtatgtgtatatatatatgtacacacacacacacacacacacacacacgtgtatatgcatgcacaagcgcagttgcctgtggaagtcagaggcgtcaggtcgtccagaactgcagtttgttagctgtttcctgtgagtgccagggaccaagctcaggacttttacaagaacagcaagtgctcttaactgctgagcctcctctccagccccatatttattattttaactgtttaatagcctagaagcttgtgaggtagatgattaagtgttacagctctcgttgcattcttaggaataagtagaatatgaaaagcatgttctcttaaagcttgttttgtatgcaaactcttaaggacttctaagccatttctctctctcccctactgcagatggtaatgtggttctgcaggtgagccaatgtagttgctggctgttctttagagtcacgtcagagagctacaaatggagatggtgctgttgtttcaagagtgtttttgagctggaatatgaactgtaaccactagttcatatgaaataggcctccgaataaaagtattccgggaatttcagaaattagagaagataaagggcctattagctcattaagtgtatctttagtggctagtgcagagtgccttgagcctacgtaatttctaacatttggtagagtctgtttcacttaaatttcttctgttttggatgacagttctataatctaataagtaggcattaagatttgtattattattattgttatttagtttttttgttagagcccctcccccacccccacattgccgctgatttagtaaaaaggcttgggaagtgagccagatgacaggagttgtcttgaatctgctgagtgccctaggaaaggcactttatctttgagactttgccctccctacccagactcttgcttgctggcatgtctgctactgctttctttttttcctttccttttccatttctttttcttccttatcctcgtttgtttgtttttttttttttttttttttttttggagactggattcactgagtctaaaatagcctggagattgctttataccttaggtgagccttgaactcacatagagaggagtgcagtagttggtgcattgtatacacatatgatattgtcacaattttaaaaataattaattcaaattaaacagaaagcaaaacattaaaggatttactgccgaatgagaacagcagtgtaaggttttgggtcttgttgttgttgttgttgtttggtttttgagcactgatgctggagggcagtgtgggtcttcacaggtgaagtgtcaaagctttcaaagtgtctgtcaaacttggagttggtttaaacattttgaaggccaggagccgtagtcagcaattccctacagcgtctggggtggcttcttgtgacatccctgaaagaacggagagttctcacgtgggtcgctgttgactctgatctcccatatgcaggagtctggtgaaacttagggttctctggcctgtaatctcaggacttgggacagggaagcaaaatcagtgtgtgtctgaggccagcctgaactgttcacaggactccgtctcagaatgctgaagcagagcagagtgctgtaggcgatgggcagcagttctgctgtgtcttatagatgtgtttgatacttgtgggagtgtctgaaaccatgtcaaagctgcataacagattttcctccaaactgcacaaagtggaagtcagtcaatgctacttaaaaaaaaatactgaagtgtgattgacacgttggaatgtaatttttccacaaaatcctttattataagaagggcatttgcactatgatttctagtcatagactgttcttaggttttagtcaatttaaatttaccaaataatttgaattataaatcattttactctactgtgaagctcagttctctataaaacatttcttacttaatcttatgtgtcattttcttattttaaagttggtcactcttttgatggtaggaagtgctgcattttatatacatagtcagaagggtctggaatgttttgaatcatcctgcattggcaaaatgggttctgcctggtcattctgcacaaaaagataaaaacagcagagataatctggaagaaaatcttgtttgccaagaaaaccttaactattgatgctttaaaattcatgtcatttttgcccctgtgatttcaatgctaagtaattatttctgaatgcttagctagactttgctgttgtccatctccagattatcatttataaaggtatgtcctgagcctgtggcttatctagaaaggttttaggtattattgcaaaatacagttaatgtctcaagatgtactgtggtcttacagtatcaatttaggaattgagccataagtcctaactaaattgttcttttctagtttaatttttgcctctgttatttgagtgttacaattctcacattattttcaattacttttagctggagcctgcattcaaattagtaattaaaagcagaaactgtcccttatcctttgagtgatctctgtgcatgagaaaagtaatttagtccttccatgttatcatcttttgctgtaaaaggattgctggcattatggtgctaggtgaccgttataggtcatctgctgctgcacttttatgatgctgtgcttacaccagataagttatgagagatacaaatagaaaccggcataatatagctcatcatgtgtattgatgcacattgattgacacatgagagcttccaatcatttgtgtgtgtatgtgagtgtgtgtgtgtgtatgtgtgtgtttcttggtgacatactgtgtcttctgtgtcatgtgctcaggatgcccttatctttctcttctaagttgtcatttggtcctggcaactatgaccactccttttgtctccttggcagaaggggctgctcttggtacaaattatagactgccatttaaatatagtaagaacatatgcttagaaatgactagatgttctggacaatcaaagtaataggtggcctctattccctctttatgagtttagaataaaagtggtttccaattgttgaattatgtaaatggtataaagtatttcagatactgtgaagttaatagacagtgtcgtgtcatagaggagggcttgaagaatggcacatgacttattgtctgctctgactgaacagggtagaaaaatatggttaactttgttgcacatggataaaacaatccttaatttaggcatctaagggaagaacagtttgtgaaatgtcttgattggatgaaaactgaagataccaaaacagaccttttacttattttcaagggaaagtaattatggagatgaaaaataattaggaggagtaactggaatttgccaagccagtacattactttgtttggcaattgctttaaaaaaaaatggaggcagagagtacttgaattaatttgattttaggacaggtctcactaagttatgggatgaccttgaactcaatctgctggccagatgcactgtcaaagttgttatctctgtgccatcaggctggctttagactttctgaaatacacaaaagtattctaagcctaaacttctttaacagtttataataaaacagtaaaataaaacagaatgactcgtatctaccacaggattgcagtgaggggtagacggggttatactgtatgacgttctcacccggtttctgggtaaaagtgactgctcagttgggtttccaattgagggtagcagagggatgaagaaatagtaagcgctccagcagggttagggggctggcctagagcacaataaaggataaggaaatctcttggcctctgttcctcctagcaatcgcttattgcaagggtactctgtcacttatcagatctctcactagaaaatacaaattaaactagagatgattatcactttcaaaaatcctgaattcaaaagtcagatttcagaagctagagaaatggctcagcagttaagagcacttgctgtgtttgcaaaggacccaggtcagggcctcagcttcgtatggcatcttagaaactgtaacttcagatccaggacaccctcttatggaactgcgtgcatgtgggtgcccatgtgtacatgcagattaacactcagacatacagaataataaagataaacacacaaatctttttaaaagtcaacttttattagaaagcgattcaaggggagaaccttttaatgatgcagctaatgcagtggctctcagccttcctactgctctaatacagttccccatgttgcagtgacccccaaccgttacattcttttcattgctacttcttagctgtaattttgctgctgttgtgagttgtaatgtaaatatctgtgttttctgatggtcttaggtgactcctttaaagggtcatctgacctccaaagggatcacactccacaggttgaaaactactggactaatggctcgaacaaaatagtaattaatctttctctaagaaaacattttttgctgtgctatagtgtgctagttaaggtggaaacatgtggaaccaattttgagacatgaacagctccagttgctgtgcacacctgggggatccttttagagagcatgcagcttatgagagtgctaaggataagaagcagtgcttgatgtcttatatgtactgttcgtaatctccactgaagtatttgtattatcactagtattcacttacacgcggccaagaaaaatgtttgttattgaatggcctaagagttcttggtcagtttttttgcaggtatttgggaaagcgattcctattatgctactacacaataatatacttcaagactgaagaaaagaaaaacccaaaccctgtacattttcacatggtctgggcctgatgccctgatgtacttcacccgacgagttgatattttttgcataattaatgttttgctcccaaattttggttgattaccaaaacaagtttcattctattataagttgggttttatgttataactgatgcacttctactaaactcaggatttgtagcaatccacatcatgacaaaaaaaaatctatcagaacttgtcatttttaatttttgttgagtatatctgtgtgtgtgtctgtgttactaagatgtgtatgaatgcatgtggatgccaggagtgtacataatgtgtatttgccgggtgctctccacttcattttttgagacagggtctctcactgaaccccctgatgatgagcttcgctgactagcttgcctggctggtcagcagggcctacaggctctcttgtctctacctctccagtgctgggatgcctagcgtatgctgctgttcccagcctttgcattggtataagaggttgagcttaggcacccctgcttacataacaagcatgacagttgactgagccatcttcctatcccttataattttatattcagtcaacagagctcatgcagagttcaggcctcttcttttgaggattcttaatgatgaaatgttttttgtttttttttttagtttataataaaagcttttcatttttttcgtccttcttttccctccagtttgctggaaaccatgtctcactacacagatgaacccagatttaccatagaacagatagacctgctccagcgtcttcggcgtaccgggatgaccaaacatgaaatccttcatgcattagaaactttggaccgtcttgatcaagagcatagtgataaatttggaaggaggtccagctacgggggaagctcatatgggaacagtaccaacaacgttccagcatcttcctctacagccacagcttccacgcagacccagcactcgggaatgtccccatcacccagcaacagttacgatacctccccactgccttgcactaccaatcaaaatgggagggagaacaatgatcgattgtccacatccaatgggaagatgtcaccatctcgctaccatgcaaacagcatgggtcagaggtcatatagctttgaggcctcagaagaggacctagatgtagatgataaagtggaggaattaatgaggttagtatgttgtctattcagaatccccccaggcatgtatattttctaagactgtttttaattattttatttcagccgcttactaataagaacaatgacttttccctcccttctttggaaatgaaagtgaaacttcaaattatggttttagttcagattttttatttcctctctgcttcagtctttttgctgtgtgatcaagcttttctagtctcttgatttgtccaagagctttctctatttatggctttagcagacagttcctgacagaagttcatttaatccaatccagtccccaatctttcgttgtaaatactttttctgagtggtaagataaatttaccatgatacagagtacatgcactcttcctttttttcccttgcagcatttcaatcagtgcaacagtttgagcagctattgggtcagaagtagttttctgtaagaaacatagatatatagcaccctgcccctaagaagctgaagttttgattttaacaatagatgcaatgcccacatgcacttcatacatcatcagttatcaagtaagcgtgttcacctagagtttaaactcaaagaaatgaaggccactttcaaccacagtggccaggactttgtaccaggcctgcttcatggtgagggtaatagacactgtgttttccatcttgtgtctagaactagaaattttccttagcacatggtggcggctcagcatgttagctgagtagataaatttggcctaagccataagggtattctattttgaataagaatttggagctagtgagatgattcggtgaatagagatgcttgctgccaagttagaggacctgagttccacccctggaaccaacaaagtggaagaaaagaatcaattcccagaaagttgtcctctgactacaagcatgcaatgccacaggtacatggcacacatacagatgtgtacatatatgtatatatgtacaatgaattatttttaattttttgaaataaaaagtatgctaattatagttagagaaacaggaaaaggtatcaaaaaggcgtgtctttactctgattaagagtataagccaggtatgctcacatgcccgtaactccaacctttgggggactgggacaggaagattgatggcagttcaaggacttagagagcgtgaacctttccagacagcatcaaaaggaaaacagcacagatgaggcagactgacaaacatagcaataccttaggatgccacacccatcctcacagcttcacgttctgtactaaatggttagaattgggaggtgttcccagacctttacaaacagaaatgacaaaacattgttttcaatagagttatgctgttgtgtaaaaaggaagccttgggctggggagatggacttactgcttaaaggtacttgtttttgtagagaacctgagtttgattgccagcacccacatggtagttcacaatcatccataactctcgttttagggaatccaaagccctcttctgacctctgtaacaccaagcatgtatgttgtgcacacacatatgtgcaagcaaaatactcatgtacataaaataatcttaaatttagaaaaaaaaagatgagagcctgcagataagttggttacagttaatagtgaacagaattatagacttatgagaagtcaaaacaaaggttacaactgagttataaccggtcttgaagattttctgacatcaagacagaatgatgggggctttgacactgctgtgtgaagatccattctgcggctcctctgccatgagacagccttaaacacatgggcatgagtgttttcagggaagagttgctacgtatggagttctgggctacagggaccgtggggtccgtgtactgagaagcatcacacctcagccggtttttagccctctgaagttcaagagactgatgtggtttggttcatcctcagctgtaacactggagccaaggctctgctgttgctggtgactttcttggtgtgaagcttgaacccagagctttatcttccactgagtcacacccttggccgttgctggtgtttggagcttagcatatatcattttccagcttaaaaaagagagccatttgggcaaatgagccacttttcattgaaatttcatgagtttttaattatctccgagtagagaagatagcaagatagcatttatttgttcaggtactagcttgtgttatttgtgcacattccttggatacaggctcacaggtatagtgtgtgttttagttgtgtgctcttaattgttgtgtagttgctaggacaccttcttaatccctttctctgcttcttgctcagaacagctctcgtagtgacatttagtcaactaggatcctccagacctctggtcctcctggtcccccacagttgggtttccatcaacccatctttgctcatgtgtgcccctctgtacctttgtcaagtttgcagaggatattccttcctagggcacagagagaagttagttgctcatgtgacatttgcagtctctacagctatgctgggtggttgatcagagaaactgaggttcatgaaaactagtaatttgctcaagaaagtttgattatcgggcaactgagcctaaattatatcccatgtctttgttattattatgttgatgatacattttatcactgtaattacttgtgcttatagatttaagaaagttttagtaaaggtagttaatagaattcttcaagagaatgtgaaaggccttccttactgggcttgcttgccattgccattctccttcctcaacatacctgctacttcagatcagtcacttagcaaacaaggaggtttaaaacagtagctcttcctgagtattctgtgtccatctagtgatacactgtccttgctgcttacttaacactggtgacatgacagtgacctggaactggtgggctctgatagaaagcatggatacccaagtgccttcttgcctcatttgttgagtaaaatctacctctgacacccagtcccaacctctgcaggcactccactgtgagacatgttttgcagattttataatccagtcaggctgtattacaatatataatttgaaggtgtgtaatgaagttatgtgtgtgtgtgtgtatgtgtatacgtgcatgcatgcgtgtgtgcgcacatgcgtgcagctacatcaggttataattgtacccttgatcatttgttagagtcagaaattatcttttctagtttgcattgggatcaaaaaaggaggaataagcaagccacactagcatataaatttccagtaaatggttgaatgtgccactttaggagggactgaaagccaacaatgaagactcattttatattagggcatcttaaaaggcctattagtatgtaagtgtatgcataggaatgtgtgtctgcatctgcagatataataggatatatcagtgttttcctgtggtcgtttatgtaatatgagagaatgtaaatgaggcttattagaattagtaatgctgcacattaaaataaagtctagcatccttgagccacgatgttttaaaattcaaaatttgtgagtactgctgtgtcacaagtgaaaaattccatagaagcacatattcctaggcacagagttatttaaaatactgtcccaaggtacatctagtctcactgaatacgttatgtaaaacgtaattgagatttgtgtttccattgtgttctgtccctaagatattttactataaatatgaaaacagtcccaaatttaaaaaagaaaatctgaaaaggcttctggtctgatgttcctcaagtggggctcacagcctgtgtatacttgacaggcaggatgtttacgctccctaagaaggtaacgccactgcgtgatggtgctcccatccacagtctgcatatacaacagctctccctttaaagttctctcttaaaattgttcccagggagaaagtcgtgtctttcaaatgtgaaacacactgctttggcttggtcttggggtgactttgagctagctcctttacaacatccagagtactaagggcgcgttaacttagggagtatgagtcatcttaaagcaaatcattttaaaataggagccctttaatatgctttcttccagaaaacaaatcagtgtcattttgaatcaacacaaaaaaacctttccatcctgatttggaaaacataaacatacttgaaaataagaatttaaagctgttatataaattatctagatccgtgtttccattttatagcctttaatctctaaaaaaaaattttcactcattaaacaaattaagttgtgtgaaaacttgatgctgattatgatagtcactgtgctaaaggactttccaggcagtaggagagatggcatgcttaggaacatgaagtgtatagagcattgtgtgcttagtacaatcgaggtgttaagagttagcctacaaatgagatctctttgtaaaccatgatgatcagggagaatggttctcaatagaaggcagttgtcttttataaaagtagtaaggaagccaggtgtggtggtaccctctggaatccaagtacttgggaggtggaggcaggaggatccctgtgggttcaagaccaccgttgactacatagcaaggccctgcttcaaaataaaacaaaggcagagagcacggtagtggtgccacttagagcacagcactcctgaggctgagaaaagaaaatctttagttcaaagtcatcctgggttaatggtaagacttctgcctcataatcctgttcttacatatgtgcgtttcatacatacaaacatacaaattttaaaagtgatttgttggaggctgaagaaatggctcaggagttaagggcactggctgctcctctagaggatgttggttcaatttccagcacccacatgggagctcacaactgtctgcaactccagttccagggatctgtctatccctccaggcatacatgtggtgcacacatcagtgagtgctggcaaaccatccatacaagtataataaaatagatatttttaaagtgatttatcaaaaaaacactcctgatggatttttctgtttttattaggaaggataatagtggagagttaaactagtttaaaaacaaaggcagtgggcttggcagtgccggttagcgctctgtcctgctgtaggtccgtcagatgagcacactggcaggaatctgaaaagaggagcaggggaagcggcctgcacttcaagtgcctatcgtggccaaggggctgcttgtgctaattcactaagacttccgcagtggacacgtgagatatttggggggaggggaagaagggactcaatccctttaggcaaatattcaagttttcagcaaagggaagaaatatgaaatagaagaggagagagccatatttgtgtaagctgtgttttatgctatcaaatgggtgattccatagctggaatagcaattaaggaaaaagcaaagaagataaacagccaagtgagcctgataggatggaactggacagtgaaggtgaatgcaaatacctagtgaacccaagcagacgggcagtctcgtaaagtgacttgacttgagagtgttttgttcatgcatggttctttgaagtacctggtctaagatgcacatttagattgatgtatgtcttacagttacagttgatcatgtgtttcttctttgctttggtcctgactgactagtgtatagaaataatttgtgtttatatgatacatttacttacagtttcagaactttctacttaggggaaatatcttttgcatatattatatgcactatgtgtgtatatatatttatatcatttagtttttattccattatttggaggaacatttcaaaggccttttttgtcagtgctagagattgaaccttggggcttttgcatactagggaagcataccgccactgagctgtatccataactcttaaaacacttggaaatttggagagaattgggggaccagtgggaatggagaggaggaggagaggaccaacaggagtagggaagagggagaggggaccagtgggagtggaaggggtggggatgggagggtcatggcaggcaaatgaatggatcacagtgtattatacacatctgtgaaaatgccatagtaagaccctttattttacacaattaatgcacactaattatagaagtgaaagcccttgaaaggagtgtgttaatgttcttgttttaccggatggtgtaactagagcacaacttaatgttagctggctttccctcacatgttttttgtcttttaaggagtggacaggctggagattgagaccaggggattttatgatgctggccaggcatcatttagtcctttagctacaccccataattgtttttcaaaaagtgcctagggtaaagcagtaaagaatgtttgtgcatacacatgcatgtgcatttttaaatttattgtggatgctttaaagactacataagagtgtattctttgaggtggtgaataggttgctgctttctaaacactagagactctttctgtcttgctgcagtcctttaataatgccatactgcaaggcagtgagtgattcacgaactggttacatagttgagtgtttgttatctattctgtatgatttagtgtctgttctaggtgcatttgatttaaaataagttgatttaattttgattttaaatcattagtcaagaaaataccatttgctctttttgtctacaaaagtacatttttaaatttaatctgaacaattattctcaagtatagtttcattttccaagatcatttggtatgttgaaatgcaatactttatataaaaattttcaacttaattttatagtcacctcaggaagcaaatgatttagtttgtgaacaaaagccatctgaaatagatactgctaaagttgtctcttgctcataattggtatagatacagtcattttcataatgatgtagtcagtatgtagataggaatctaaatcagtatgaaaattttaaaatattccattaggcagctaattttttattttctttgaaaccttttgattagaatttccaaccaatcactcgggatctattgtagagctacatattggatactcactagcccatctctattcttttcccaaattccccacagcaggaacatgcccctaaggattatactgtgcctgctgcacaagaatgagaaactaagttcacatcttcagcacccacattaaaaagtcaggcagtggtggtgtgtttagccctgaggagatccctacagctcattggccagcaaactggtgagctctgggcgcaaagacaaacacaaacacaaacacgacatgcacaggtaaaaactcaccacaggaaacacggcatccctcaccagagtgtattattaccctttctagtgaaggggctgaaagacctggtctaaattaaatcacaagttattattatattttgctaggatatacttttgtttctgctccagtctacagcaagacatgaacccctattaaatttgtgattcatttacaaaacaagttttaatggcttgtgattcctttgtctcagatcaagggtgagcagggttttactctgaatacctagtggttaacagttagccttgctgagaggtaaaattgagggtataatatagataatctatacaagagggaaaccaggcatgcagcacacagctgtaatcccagcactcaggaagctgagactacaagaaatccaaggccagcatggactcatagactgtgtctcggaaaaatgaaagagtgaaaaatggctgtggctgtttttgacaatatctgacatggagcttgtactctaagcacttaggaggcagcggtggaagggtgccttgcgtttgaaccccacatgggctcaatagttccaggccagcctagcctacaagagtgagtccctctctcaaaaaatgaaaaaagaattcaatatggaattgtaataattgaatatcatttgaggggttatatacagtatttgtaagaataaaaggaaggatggtgttttgtttgcaaaggtccatcagaaaaagattattagttcatgctttataggagaacaggtggcagcttgacttgctgaggcctttaatctcttcaccatgtttagacgattagcaatcacaattccatgtcagttttcatcttgaacaagaatcatgttctttaaggactctaatttttatttaagtatttttttattttggtgaaagaatgagtcatgtgctttgtcattcttaaggatgtctggactctgaaaatgtgctatttaaataagtaataggctgagagtatttattactgaatacttttctttttagtgttaactattctgtgtatttattatatgtaatagaaaattaatagacacttttaatatgaaactaatattttaaaccattctacattcttttcattttttcttatacagaagagagggagaggaagcagctaattgtaataaacatattaccatgctaataacttcactcatgagaatggtattgatttttgccccggaagcatttccaaggtttccagatgggtgtcagttctacagtaccttccttaacctgcagacccacagtctccgtacagctgatttttcactgcctttgcttttcatttttccagggcttctatgttttcattccctataatgaggccatacacactgcacattgaattattcacagcatgcagttcccggtccccccacatgagacttgtatccacagtggcattcactgaggtgtctgtctgatggtgtgatgtttcaggactggagtatttggtgtttcttggtttgttgtaatttcatattatcacccaagtttagtctgtttccctttgatttttgtgtccttcctttctgtgtcctccccacctctctgcttcacctttcttttagcaaagatgaggatttctaccttcaacatacattgttggtcttgtcttctgtttttgttaggagggacagcagtgtgataaaagaggaaatcaaagcctttcttgccaatcggaggatttcccaagcagttgttgcacaggtaacaggtaagagccgcagagccctttattctagaatcctgtctctaccgtctctgccgtctgtgcagatgttagactatcgcttgtatttccatgctgcagccctgtcagcttggcatggtgacagaagcctggggtttaaaccagggcctctgggatcagagacatgttccagtgagctttcaagaaacttgtgctagtaaaatttgtaacattagtaataataataattagtagtgataatcccgattttgtaattgaaaggggaatgacatttccttttgattatggcagagcctatgacacaccatcagctgctgtctgttcaatatttttaaaagcgtcacagttctctaaattaaatctaggattttaccaataaaaatggctcttgaggaaaaagtaggttgggagggattttcctttttagtttggggggtttgtcatcatttgggctttggttttgttgttgtttgttgcttttatgtttttgtttggtttggtttttttcccttgggacagggttgcatgcagtccacgctagcctcaaactcactccatggctgataacaaccttgagctcctgatccttttgcagccacctccaaagtgctgggatgtgtgcaccgccatcgcctactgaaagttgtcttttgaatgaccatttctgtgtgaaaccttcctcacacccctcctgagaagataagagtcaccagtgtcttctctttgttctctatacccatccattctccacccagcccagacctcacctacatgtggtgtgtatgtgtccttctctacccagattgcatcttaaaaatggaggccctgagtgtgagtgagtcatcgttgggttggggtgctcttccttagtccttaagctcttagaggaaccacgagttctttccagtccaattccacttgctgtgttgttacccagtctatgatgacagttacagtaattgccaccgccaccaccacttttagcatgcggctgcaaacttaagcctttgggtatttcaaccccctgcctcagtttttgtacttttgtggttacatgctggtatctgagccatagtagctctttcagctctgcacatgatcttagccaaaaggccgagaagcgatcttccagctctgatgttccttcggtggtccaaacactggtacatactgaagtgaatgttaagaggttatgcctgctcattaatttgataaaattgtaacttgaaagctaaaagtattaaattttatccctatacctaatgtcagccaaccctttaagatacatacatgtatatatctcttactaataattcatttttataaatgatgcctttgttgctcgtaaaagacttttagacatgtcctttaatgtagaagtcttaatggtaaggaaaggtgtgaatttaattatttaagtctttaggtatttgccagtaggatggatgagataaattatttaacttcaataaactaaagtacagtgtgtaacacactataagggtaaattgtgcaggctttactgaaactcacagtgtagtagattatgccatgatgggatgttgtctttgcatctttgctttagtttctcagactacaatcaacatgtgttctgatttgcaacatatagagggacagccagacaaatctgtaacatgatagaacaaaattgcaaagttgaatatttctgagagttgaatatattaaaatttgaaacatcttatacttacatttgttttagtgtgtacatgcatatatatgtatgttggggtgaaaggttttttttttttttccttcctattgtgtgttccagggattaaaactcaggtcctaatccttggcagcaaatgcctttgcccactgagccatcttgtcagcccaggaagttctataatgtatcccctatgcccatttcttattgccaaattctattatgtatcttcacggctgaatttaactacttttagttttgagactcctgcccatttgcatctttatgcattcctccttagcacacctcattctattagggtgctacctggcattagcgtagtgactcaccttaggtttaatcctcagagggtctgtcactgcacacgtggaaaacttcacacccacctgcctggtagagctggctgaggcatacaggagctgattgggtttagctcaaactacacatcaagaggcacaccaaaggtctgattctgggatgtttgcctgttcaaccatcacatacatttttttgtgtttaagaaagtttgagttttttgtttgtttgtttgattttgttttactctacaaagcaagagagtgaggaaattaaaagcaggctaatttattttttatctattggctagctcactgagttgtttttctcatgtattatgaattagtcacatttgtgccccaccctgttcagccaggaacctagcagaaacagtcattctcatgtcttggaagaacaataagttagtgattgaccattacctagatatccttttctgtcgttctacagcagattctttgaaaatcatttgagtttgactctagtatgtgagatcaaccataagataaaaatcagaacggatggcgcctaaccacagaaaatgctaaataagaaagtgtagcaaggtgccaaattacgacacatgtgctgttccagaatcaaatgcagaggctgctttttatagatgtggagggcttctataataagataaacaagaagtgcaggggtggggtctgtataaataatatcctgctgataggagaaatgacagtgtaaacaggatataataacagtgcctgctgaatttccagcatgttatttgtagattccgtcacagttgcagctgctcccaccatgggtagatttttacctctgtgagaggtcggccaagattctagcttttcactaacaatgatagggtgttgagcatagccttggctttagtaataaacatgtattttatatttactctcagcaaaaatgtttccttaggctgttcaagcattcctaaaacaaacaaataaaaatataatgatctctgggaaaaagtggggatactcagaaaaaaatgagtaaatagtcaaaggttggtgagagcttatcatccaaagagatatactaattagtgttgtgtcttcttaaagaaataagaaaaaaatgttagcatcagaatttaaagaactttattacagttgtgttgaattgctagggtacagtgagaagccagcagacactgggattccattctttctgacatccactcattgtgtgacccacaccctcactttcattataaaatgtaggagtgtgaccaaatgattgttctcttagtccatgtaacgaaatgctataaactgagttgagtagtgtagtatacaaacatacacatgtatttctcacagttctaaggcaggttccatgtctgggaaccacttgcttttctggctcgtatgctcctttttctttcttgctgtgtcttcacatggtggaaagggtgaagggtcttccaggccccttagggtgctaatcctattcatgaaggtctgcccatgtgacaaccccctcccaaagatccccacatgtgaacatcaccatcttaaagacaaagctttcaacaaaaggcatagatgttcacattatagcagctccatttttttctgcttgtccagttctagtctacttttaaactacaactacatttgacacttggaccatcttgcttctaatctttttacttccaactgtattcaaatcacttcccttgttacttttctctaaaatggagaataataataatatatatgcatcagttgttttgccaaaaaaaaaaaaaaaaaaaaacccaaccagtattgctgtctttcttaatcagagaactttagaccaggtgttataaaccaactaagatatcagtttaaaagctaaactttattctttagaacagtgtttggttcacaacaacattgaacaaaaatttgagaaacttccaaaatacctcctggtccacagggcctactcagtttcctataattgtcacctcccacagtggcacatttttggcagtcagtgaccctatgctgatatgtcattgggaactagcattcctagctggcagtaggcccccttttggtagtgcacatgctatagggtcaaacaggatacacccacaattacaatgtgacctcacagccctcagaagttttctgtgctctgcttgtctgctttgctcttcccagttcttgcaaccatggatctttgccaaagtgtcttagcattggagtcaagtcgtgatagttgtgatagcttccggctgggttcttttagttactaactgcattgaaggttcctctgtgttgcttgctcaatgcctagctcaggcactcctcttctttgactgctgagtaacatctccttgtctacactctgtcagttccctaaaagtggacatgttaccttcaaacttggtgaactatgaagataattgttattaaaaaatagaatttatatctaaattagaatagcagtgtaggtagagcatatatcagactgtggaattgccctgttataatagtcagaaagaattcatttgctcatttgacaaggctttatggggatttggctggctttaagtagatatccagtttgaaagctgtctgctatctgtcctcacaataagcaggcttgtagatgggcagtctgactgtaagtaaatgtttggagctgtgtgtagttcctcttttcagaggcttccccctctctgtctacaggctctctgtaccagtgttattagtgttttgttagtgtatttgggacttctcttggcttccaggtcctgcagactgttttcttatgtcttcttcaaattctgggcacggtcctttaagccagcacatgagggtacactgtttcctcccaggatggaacacacctcttccatgtgatgcccatattttctctggtacaaagagttcctgaggaggcttgttttaaactagctctctgtagttactataatgtatgtgtgaagccccctgggcttctataatctcacatgaagtgcatagagttgtaagtgtccatgtgaaagttaggttggctgccaaccttagagtgagaaccatgtttcctacttgaacttaaagcagaacccacattaaaccaattcacagacccagaaggcttgccagtgacagccaagaacgatacacaggtgtgctgtccaggccagtctcagcagttttcggatctcttttcacctaagattgaaaaaccagcatacaaacaaccccgtgcctaaaatgtaatgtcccttgtcaggtatgttattctctccagagcatgatctgctcttccttaccattgggaatagtaatatgacgtggtgaggtgggagcagcatggctcagcaaggctgtgttccccaagcctaatgactttgagttccatctgtggagctcactggacggaaggggagagctggctcctcaaagttgttctctgatttccacatgcatgctatggtatgtacctcacatacacatggagtaaataaacatgtcattttttctttaaaggtaggtctggtagcatacctgtaatcccagcactaagaaggtagaggccattgtgtcaagaattcagaattatccttggttaaactcaagatcagcatgaacagtgtgatgccaggccataaacaaacaataaatgcataaagggacaatatctacttacggggatgttctaggaagaaagccaggagaccgaaagacagtcacagacagatgtgtggacagtgttctgcctttgaacatgttcaccttaaagtgcctgtctatccaaaataacattgctatagacttgtcgctattatttatgagaaattcttagaaaccgccattttttaattctgtatttaaaagacagggagtttgctatgtcatcctggctgacctggtattcactgtgtagctcagcatgtctttcctcagccttctaaatgatgtgactttatagtgctactgtggtattttgtaaaacaatctttaaatttagtgttttgagtttgagtccttttaaaaactaaaatatgctattttcttaaaggtatttgatttcttttgacaggttttatttttcttttttaacagaaagattgccttttgcacctaatttcttccactgcttagatgacttttgaaggctgttacactagtttgccatgattttgtccaggagataccatgtctttgaagtatttgggtgtaatattaagactaatctctcttagattttgttgatctctgtattcaggctctggtttggccttgtcattgcgcagatggctgatgtgagttctagagccattctgctctagaatgcatacacactcaaggccaaacctccttttagagagtttttatttttagctgtaattgatgtgacacttaccaagtgctagatgctatgctaactgctttatataattgagaaacaggtgtgaagtcccacagttacagataagaaaaccaaggcgaggacctggcctctcattcactgcagtcagagttcttaagcataggcaggtcagtgtggagagagtgcatgtagagggccaagggtataattagagctgtgcagggcctgggtgcagaataagttttgtgtagtaattacctgctttctagagcaaggtttctccgagtaatttatccagttccatatccaggaaaggcttgaaccaccattttgaatcttggctttgcttaattctcactagcattcagtgcccatttatggagctaggctactcaagactaaatatgttaaccacatttttgatagtcctcaatatataacatgaacttgtagaaagaataaatttaaaaatatattatttccacctttctttaattttttcaaaccttatttttagtgatggttcttaaatgctttaaccttccttgtagcctaccacccgccagaggtagtgggaaagaaaggatatgtgggaagtggacctgtttagaaacattctttggagcaactcccatctgtgttgcctggagatcggtggttcagttcacaggttagcaggccgcttgatccgctcacaaacacttcatggaaacaccagcaacccagtttggtagagttgggttagcaacagcggtgacacgacctaccagagagagccaggctttagccttggcacgagtcagcagcaaggaagatgccaggggaagttctctgctgtgcccctctcagggattcgaaaattagcaaagtcgtgagactcacaagcatcttgcagctagctctagaagcaagccttggagagcaactatgcagtgtaaggtggaccaatacatgggtgttgtttagcaaagaatctttcatcacatgtcctttcacgtgattgctttagcagaacatcctctctcctctgtctgcttcagtaaagtgttccttcactagtctgccttagtctttcacctgtgtccacttcaggaaaacacgccctctcctccacgtgtttatcccagcaaactaccatctaacacaattgactcttaagtttccacttcacccactccaccctccctttttgatgggggcttcactaataccagggctggatttgagctcctgtgcaaaggctgtaagcatgtgttcttcctcctgcattaagttaattttctacagtagagaattatattcctgagggatggatttcagaggagggtatggtattaaagctcttgtccttctgttattttttttctgttgtctttcccagaacagataaatactattttctttagagatattttatacatttataagcaaataaatatatgtgtaaatcttttctctttttgtgccaattgtatgtatgtgtatatatatatacatacatatatatatatatatacacacacacacatatacatacatacacacacgtacatacatatagagtgttagctgtcttgcttttaatttcgaaattatcctgtattagtatgtaaggaatatgatcacatttattaagcaaaagctgtggtttaccatcttctagatagcttaattttaactggctgttaatatttactactttgatgattttgcctaccttttcagtacagtaaatgttaactaaacacttatttgatacattgactacaatgtccatgtatcacaaagataaggtttctacttagacacacacacacacacacacacacacacacacacacgggagtaaatcatcagatccttaatgcatgctagacaagtgctgtcccagagttatggcagttccagtctataattgattgactttattctttaaaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggctttttgtttttccttatgaagatgagaattgtcctttcaaagtctataaagaagtgtgatggaatttagatgcttatgtttaatctgttgattgcttttagtaggatgtccatttttattatgttaattctactcatctatgagcatgggagatttttccatcttctgatatcttcctcaatttttttcttcagaggcttgtaagtttttatcatacaagtctttcacttgattgattaggagttaccccaaggtattttatattacttgtagctattgtaaagggtgttgtttccttgatttctttctcagtccatttgtatataggaaggctactgatttgtctgcttgtttatttaatctgaaaccactgtactgaaggtgtttatcagctgtaggagttcccctggtagaattatttgggtcttttattacatactatcatatcatctgcaaataacaataccttgatttcttcctttctgatttatattctttgaccccctctggttgttttattgctctcactggaacttcaagtatttatattgaataaatatggagagagtagacaggcttgtccctattttagttgaatttcttttagtttctctccattttatttgatattgtctatgtgcttgctgtaattccctttttatatgtaccttgtattccttagctctccaagacttttatcctgaatgggtattgaattttgtcaaaggttttttttcaacatctactgagatggtcacgtgtttttggtttctttctttctttctttctttctttctttctttctttcttccttcctttctttctttctgtttgtttctatagtaagttacaatgactgattttttcttatattgaaccatctctgactctctgggatgaagtctgattggtcatgtagataatcttttttctgtattcttagattcaatttgagagtattttactgaattctttttgttgttgttattgttggttggagtttgtgtgtgtgtgttgagagtattttactgagttctttttgttgttggtttggagtttgtgtgtgtatgtgtgtgtggttgttgtttacatctgtgttcataagggaaatcggtctgtaattctctttcttagttgaatctttatgtggtttgggtgtcagggtcactatgacctcataaaatgaatttgtcattgttccttccatttctattgtgaaataatttaaggagtattgtccctattttggaagtctgtagaattctgtgccaaaactgtcctgcactgagcttttttttgattgggagacttgtaattgctgcttctatttccttaggggttataggtcttttaagttgtttatatgatcttaactttggcaagtggtatcaagagaattatccatttcttttagattttttaattttgtagagtataggtttttaaagcatgactttgtaattccttggatttctttggtgtctgttgatatgttctactttctgtttctgattttgttaatttggatattctcttcatgcattttaattagtttagatactgaacagtttgtctatcttgttgattttcacaaaacaaaacaaaaaccaactcattgattctttgtattgttctctgtttctattgtattgatttcaagccctcggtttgataatttccttctgcctactcctcttgtgtttgtttgtttgtttgtttgtttgtttttgttgtagagctgtcaggtgtgctgttagattgttaatatgagatttctctaatttctctatgacggcactttgtgctatgaacttaacctcttagcgtcactttcattgtgtcccataagtttgagtattttctgtagtcattttcattgaattctagaaagtctttaatttgttttttatttttttatttcaatcttgactcagttttcatttgtaagggtccaaaaatcactgaagcaagaccccagactcagatagtattcaaaaacaaagagcagttattctgcagaaacatctagcatgcaagagtcaccattgttcagaatggcaacccagatagagacattcgagtccttttataacaggactgcttaattgcttctgagataacagcagacttctaaaacttagggcacattccaaggggttacagaagccattaattggaggtcataaagaagacataaaccacagaaccccaggtgcaaaaacaggagataagatattgactgggtttatttaaacaagacttcaaagatggcttagttttagtcttaaactttccatgaccctgcaagttagtaacaaatggtgaaagttaagataattgttcctagtatatgcaagtagacattctctgttacaacagagaataataagaaattctcttattcagtttatgactgaatttatgtgcagactcacagtgagctttttaccatgtgaacatctgctctgagagtcctataagaactgagaacaaaaggcagagaaaagtccccctctcctttcctccctgacaccaaaattcccaagccccaaaattcctgtaggctgctttctctaacttccccactgtgtcactttgaggtgccaaggagaggctgcaccttccagccttaaagtgacttagtcagatggattagctgagagagcaagtaccttactttgcaagtggcttgtggcctaatttctgggtggagataaatggaatatgaaaaatgaacttctcacattcagtagagagttgttcagtttccatgagtttgtaatctttctgtagtttctgttattgttgttgttgttgttgttgaaaaagtctaatatgtgcagggggtatttcgggatttctgtattgttgaggcttgctttgtggcccagtatatggtcacttttggagaatgttctgtgaggtacggagataaatgtatattaatttgtatttgggtgaaatgttctgtagatatctgataggtccatttggcttataatgtctcttagctccagtatttctctgtttagtttttatctagatggcttgtctgttgatgagacagagtgttgaagtcttccactatcagtttaggagggtcagtgtgtgatttagggcttagtaatgtttcttttacatttgaggatgcccttgcatttggggtgtagatgttaagaactgaaacatcttcgtgtatttttcctttggtaagtatgaagtattcttccctgtctctcttgactggtttgaaatctctattttgttaaatattcgaacggcagcaccaacttgccttgtaggtccatttgcttggaaagtctttttccaaccctttactctgaggtaatgtcatcattgatgttaaggtgtatttcttgtatgcagtagaaggnnnnnnnnnnnnnnnnnnnnaatagatattgtttaaatttgattttattatggaatatattgttttctccatctatggtaataaaaagttttgctaggtctaggctgcatctgtggtctcttagagtctgtaggacatctgtctaggccctgctggcttttggagtctccatggagagactggttgtaattctaataggtctgcttttatatattacttgttcctttttcctttcagcttttagtattttttctttgttcagtataattagtgttttgattattatatggcgaggggactttcttttcaagtccagtctattttgtgttctgtatgcttcttctatctttataggcatttcctgcctcaggttaaatattttttctactatgattttgttaaaaatatcttctggggctttaagctggaattcttctccttcctctatttctatttttcttagatttggtcttttcatagtgtcccagatttccctggatgttttgtgtcgggaatttttcagacttaacatttttattgtccagtatatgtatttcatctatcatatcttcagtgcctaagatttgggcctccacttcttttgcttctgtagttcctgttcacttactagatttttcattgccagaattccctcaatttgtgttttcgttattctgtttccgttttcaggaactgttttgttttcttcaagtgttctccccaccctgcttggccttcttcctccatttttttttgtttgtcttttcctggatttttaaaggagtttcttcatttcctctttgaggacttctatcttcctcataaccttggttttaaagtcctctcttgtgcttcagctgtgttgggatactcagagctcactacgcaggatccttgggctatggtgggaggtacttactggctgttgcggattgtgttatgaacaatgcctccaggcattgggtttgaggaggagattataggtccaggggctggtttctgagattgtctttactggatggtattttgttccttggtttgtttccctctggtctggtggccagtgtggcctgtgtggcctgtggttgagcaggtgtctctgcccaagttgggggctgggacaccaggatggaaagaagtgggggttggggatatatatgggtggacccacgggagggcagcttacctggagttctggtggccagtgtggactctgggtgaggaggccttgaatatatagggtttttttttttttttttaaatctgttctgtcagcttctgtcttcttttgtagtgtttaattcattaagctttaatgtgattagggtaagcatgatttatatcttgtgcctttttagttttttttttttttttttttcgagacagggtttctctgtgtagccccggctatcctggaactcactctgtcgaccaggctggccttgaactcaaaaattcgcctgcctctgcctcccaagtactgggattaaaggcgtgtgccaccacacccagcccaccattttagtttttattgcttcctccttttgttaaggggatactttctagtatacaaatttaaaccccttgttatttgttattatagtttgagttgttcttttgacagttgtactaaggattactcttaacatgttaataataatttagcccagattaatatcaacttaatttcaaaacaactttgctcttacatatagcttcattttttcatgttttgtgatattgttgtcatatacattgcatactaattaatacatgtgttcattaacatacaatatgtaattatatgttacacttgccttttcaacagaatagtaccaggtacttagagactaaaaacataccattgtcttttctatttatgtatgtggcttctttcttctgtgttggtctgctgtcacttgctccaccacagcagcagcaggaggggatgacagcaaagctgctcacctcccagagccaggaagcagggagaccagaggggatgtagacattccagtgtgccccagtcttccaagcaggcctgacctctcagaagccatcagttatgggtgttttgagatgcatcccataacacccctccttttctgtcttcagtgtattcaagctcctgtcttctgcgctttcattataccctaggaagtccttatttcagagactccctgtggcactgccttgcattcctcaggcagtgttctaagtatccttcccatggcttctcagaggaacctactctcagccctagtgagcacaccttgtacataatccttcttttccctctcttacttttacttcttatctttgattttaaagcatttttattacagttttgcttattttgcatgcatgggtggaggcacatgtatgctgtagcttatgggtggagatcagaaggcatcttgtgggaattggtctctccttccaccatatctgttgaacttaggctctctgacttggtggcacctctatgtgctgagacatctcaccggttctgttttaggggaaggagtattgctttatggtacttgtaggtgtgaaattttgagttaacatacatgatgatcactaggcaccttaaaaatgttaagattttttcatcaaaattcccgtgattttagccattattttctcaaaatcttctttatttacgttggtgtgtcctaagagtctcacctgtatttggcatgtgtggtggtatcccatgtgtttatgaagctttgctttgtagtactccttcttgtcttctgttcccataagtcatctcagctgacctttgcaatgcggtgatgaatgcttctgcgacttcttatttgctatggaaccctaccagcaaacttttcgtttcatttatacttttgtactccaaaatttctgtctagttcttccatataattgtctctgttgatagtttttataggataagccatttttctcatccttttctgtagctttttagacggttcctatgttgagtaagtctgctatcccagttactgtaaggacacatcttcctgtggttgtattgtgtttgttatggtgtgttgtttggctgtttgatcgattgcaggcagtgtctcgctctgtagcctcagctggctttgaacgcttgctactctttctccctcagcctcctgaggattcgggcctgagtcaccatgactagcttccaggccaattttgattgattcttctttttaaagacatatttactaatagtgtgtgtgtgtgtggggggggggtgatgatgtgatgtgcaccctcatggaggcctgttgttggatccctggaactggagttccaggtgatcgagagctgccgtgtaggtgctgcatggtgagcccttgatagtttgcacagccttgaaaagggtgactttgagagcatacttgtcagtgcctttatagaagttgtcttgctttcctttcacagaggcatgccatcggtagagattcttgctgtgcccttcccactcactttactgcagctgcacagatcctgaaggaacagtgaccccaatttatctctgtaaatgtattgtcctccaaatatgtaacggatacagaccctcaagtggataaggcctggctaacccagcaccagtcaacttgaactagtaagaagaactccatgtgagatagtgccaacaagaattaagctgaaaatgcaaaaattatgtatagactgaaatcagaaccaagaaagggcaggaagagaactatattttgagtcataccatgatcacacacatgcacatttttcaaaactcattgtatacatatgagaataaacctttgtagaatatacctcagtttacaacaaatatatagggcttcaaagtcagaaaattggggaatgagaaaatcttgaatccatttaaacctagccctgagtaagttgtggtggagactctgggtcaggaccaaatgaaagtgaaactaaaaatcagaagttaatgtgaagattacagtaaagacagaggtcccagagcgagtgagtgtgtgtggcttcctcatctgttgctgcataaaattttatcccagaatttattagcatcttgaaacataagcctctagtattccagacaatatacatcagaaatgcagaagcagctttgccaggtcagttaagctttagcttaaaaactaaatctaactccctcttccagcctccatggacatcaggcacacacacgtgtggacatacatcattcatacacacaacagaaaatgtaaaaagaatagtcaataaaaagtcaccgtgaagctggtccaatgactcagctctaaccccagcactcaggaggctgagggagaaggagcagcaagcgttcaaagccagctcaggctacagagtgagacatgcctgccatggagcaaacagcacaagacagagctagaggtctcctgaggttgctgtctcctgggttaagagaggaattggatgaacattgtgcatggtggagaaagtcagtctcttactatgtgtatgctctttaaaagtttatgtgttacatgtattgggaaggtcttatgcatccataccaaacaaacaagaatgattctaaggtaataaataagaaagtggtggaaaaaaagtattttcttatgtgtgttcaacatacttgaatttttatagagaatatataattagaatataattataatgtggcactcaaaagcactaaaataggaagcttaagtgtgggagacaagcttgaggcacatagtgacttccaggccagccagggctatctagtgagactctggctcaaatataacaaaacatatctaaacatagctctgattgaggtagaaaattgctaaaggactttgaaaattgctgaacgttcataaggattttgtattttgtagttctgagatggcctgttggggccatcagagtcgttacggttgttcaggtaaaagaggctgaacaggggagtgatgactagaagaaagagctttggtaaaaatgcaagctttaggggagggagtgggtgagaggttaagctgagctaactcctataggaagatgagcagatgaggggggaggataatggattaggcttactgtgttggtctatgagaaattctcattaaagttgcctagccagtggtttccaagaacaggctgtgccctgagagtctcttgcatttacatgacattttaaatcattgttgataattacgatgatcaaagaaagaggcttaaatatggaatcccagtggccactaatgagtagaaagctaacatagcacctggagccaaaatgatcatgctctggaggggctgtgtccctcattccaaggtgaagagccagtaggttgtggcaggaaacaaaacatggagaggaatccagagtccagtgttgagatttagaaggctgggttctagttgagagccctctagtggaggaagcgtggtgtgtaaactccagagaggagtcagtaaagctgacgttcacaagacattatggatgccagctaaagactacctccaaccactttggatataaggggcttactttctcactggaaagaaattaagcagggcttagttttagtcggtgtatgtaaattatatgaaactttgcctttgcttctgccctacaagaggtagaaaagaggtttttgaagatctgaaacttttcccaagaatttcttccacagcagggaagagactatctggaattttctcccaagggaagtagcagagctggcagacagtgcagagaagcttcgaggacctgaatgtcaagtcccacagagctcccagagcagccgcgattgtgggtcaaggaccctagaggaaagtcatttctgagtgtgacatttgctgtttattcaactgttttgcaatgcctcttctggaaatggcttggttaactggttcattttctgcatttattgtccgaatccaaggtgagtcaggaagacagcctgtattgcctgctcctccctttgtttcattgcattcattattatacagagagaaatgtgtgtgacatttttaagtccgtcacatgcttacctcagagtaaaattgcagacaaaaagcagaagtggacttctttttataagtcttcatttactttaattgcactgtttctaaaagaacgaacagaaactaaaatattcagtgtcaaaagccaggcattaaaacatttatagaaagattgagaaagttttagtggtagaaatgtagggaaaatttacatttatagtgtgcatctgtaagcttttgatatatttagatataaatgtaatacagggcatataaagttatattcataaaagcatatactttatgtatcaagggcatcttcccatattaacatatgttaattaaatatatagtattaaatatatataatctttgagttttaaaaaatttgtggggacctttttaaatatgtatagtaggtgacaactcaatgactttcataaagtatagatatccacattaccaccttccgtatcagtaaagaacatcactggccactacataaaccatcatccttgacctttttcctgcatgggtaccagtatgctgatttacatcctgatgtatagtgtggtgtatggcttttgtatgtttttggctttagggaagcagcgttgtttctgtgaggtctgcccatatactgtacatatactactagtttatcctcttcctgttgctatggcagtctgcagtagaagacacagataccataatatatgcattctgcatttgatggccatttaagttttggaaccagggaattctctgggtaatgctcatttctgaagcttcttgtgcatgtcttttgagtatgtgtgtgctgggtaatcacgcactcctgtggtatgtatacctcaagttcagtgtttatggatcctgtccatttgcttctggaaatagccctgctatgtgtgaatcccatgttcttgctaatactaagtattactgagttattgttgttagattagttttgagagttttgtagcttttaaaacatattaaatttagtcaagctgtggtggcacacatctttagttccagtactcaggaggcagaggcagttggatctctgagttcaaggccagcctggtctacatcataagttccaagaaagccagggttacacagagaaaccttttctcaaaaaataaacaatataacaaaacaaagaaaacatttaaagcatgccagtttctgctatgggaatatgctgtaacttgatgtcctctggatgggctttgctacctgcaacacagcatgtacagctctcatggctgatgggcactgtgttctaacatgagggtgatttaatattggagaacgctaacagatctcagacatactttttcttagtatatatttttaaacttgtctgtttttttacctatgtggtaacagaaggaaaattcaaatacagtttgacttcatggtgctgaatgatcatttcgtcattcttttttaaaattaaagccgggcgtggtggcgcacgcctttaatcccagcactagggaggcagaggcaggtggatctctgagttcgaggccagcctggtctacagagtgagttccaggacagccagggctatacggagaaaccctgtctcaaaaccaaaaaatataaaaataaaattaaataaataaataaataaataaataaaatttatttgtgagatgactcagtgggtaaaagcacctgacaccaagcctgacaacctgtgtccagttcctgaaactcaggttgtcctgtgcgtgtgcacctcccccccccccatgtacgttaagaagaaaagtgaaagtgtttactcagagaactttctgttgtcatctttcttttacctcctcctgccatgttttctcttgtcatctttttggtttttaaagatttatctatttatttactgttagtacactgtagctgtcttcagacacgccagaagagggcatcaaatctccttacggatggttgtgagccaccgtgtagttgctgggatttgaactcaggaccttccaaagagctgtctgtgctcttcactgctgagccatctctccagccctcttttcatcttctaataggagctgctaagtatctggaaccctgaagccttgcgtttagttaaaatgtgataatgtcatggtagttctgccttctgttgagcacaatcgctttacgcaactgtttgtacagtggtgtttggtagtgtccagttgccacagtgggtgtcttaatcctttggagcagtggttctcaaccttcctagtgctgcaactctttaatacagttccacatgctgtggtcaccctccccacacaccgtaaaattattttgttgctacttcataactgtaactttgcttctgttatgaatcataatgtaaatatctgatctgcaggatatctgatatgtgacttccaaagggacaggatttctttgtgtagcccaggctgtcccagaactctctctagattaggcaggcttcaaactcaagagatctgcctgcttctgcctcctgagaactgggattaaaggcgtgttaccaccactgcctggcgtgctctggagactttaagatgtaataaactctttatcatagtcaaatgatattttggaaatgccttctttattttttttcctggtttctctgcttttgccagttgtatattgggatttcaagactatactgacaagaatgagcatgtggttttctaagggttagtatcgtcttttgactttcctatgtgcagatcatgcacatccctaagtaactgctgacaagaaacgattgaccacagcgcagagctgctactgtgcactttgttctgtgtggaaggcaaagtcaactccagaaactgttcttcgttactgggctttcttcagaggtcatgttgcaacctaagtctgccaactcttgcttctctctactaatggagatgagtctaaaatgcttaaaagaattagcaagtagccagaaaccgaattgaagacagtgttttcaatgacccctcctttcctagcccctaaatctttttattagtgtcattaatgagaaatagaactgctgactagatttttccctctcaaagtgtctgtttcggcatctcatgttttcaaagcagccggagcctgttgatcgtacaagtaatgttacttgggctcttctcattatttcatgttgatggactcagcttgcagattgattttagaaggcactataacatctttgttgataaaatgtctgatttctcacaggtcatttttacacatgtcagtatgatcaggctagtgtcaaggagctttccaagttacagcctctcccacagtcatgtaaataatcacagagtaactaacccagcagagcctctttaacttgactatgatgtcagtgccccatcaagagctgtttttctttctctgtaggaatcagtcagagtcgaatctctcactggctgctgcagcagggatcagatctgagtgagcagaagaaaagggcgttctaccgatggtatcaacttgagaagacaaaccctggtaagtgtccttgtcacttattgtgccgaaagagaaaagcaaagctatgtcagtgagcccatgtgctaagttgttcaggaaactggcttcatgctttactattttccttcatgcaagtaggcaagtgggaagcctaagccctggttgtaattatgttgaggtttctgttagcaaggggctcgctcacttcttctcagctgccttttggtttccaggttcggtgattttcctaggcaccatatggaagagtggccacggcatcagtggctggcccctttgtcttcaactgtaggtgcacacataaaaattgtgcttttttttcccattttttcttttagaaaacattatgttaattggtatgtatttaatatttttattgagttcaacctgtactgttccaatgatctcttctaatgcttttgtgtttttaatgcttgtgacttgggtaataagtatattttagaattttaaggtgaagccattcacatagcttctgggagcagcattagattaaaaaatagatgaaatcttaagagaaaagatcaccagtcttgatgtctggagttgccaagaataggcatcatttcttccaaaatacttgtaacaagtgatagatcaagaaaaatatgacgtgatgagagtgtctgtctcgggctgaacagtgcacaggttatgatgtagtgatccttgttggtataacatttatgtctaggtgcagtgcacaaagcctgcaggcacactaggtgaggtgttgcatgcagcagcattgaccctgagctgcaagtacacagtactgcattcaagtgctttgtgggggctcgggagtagggggggttgctggtttgtttcttttctcaacccaaaaggccctggtaagacaaagcaaaattgtagcaatctgtataaaagaaagaaatgtctaaaccgagcctggtggcacacacctttaatcccagcactccagaggcagaggcaggtggaggcaggcagatttctgagttcgaggccagcctggtctacagagtgagttccaggactcccagggatacacagaggaaccctgtctcaaaaaaccaaaaagtctagactctattctcccctgttttctcttttgaagtgttacagatatatagacatttaaaaagaccagtaaggtatccagctattttcatttaattttcttagatacaacaattgtgaacatttttgctgttcactaatattttttaagatttatttggggctggagagatggctcagtggttaagagcactgactgctcttccagaagtcctgagttcaattcccagcaaccacatggtggctcacaaccatctgtaatgggatctgatgccctcttctggtgtgtctgaagacagctacagtatactcatagaaataaaataaaaatttaaaaaaaggagcttagataagaataaaattaaaaaaaaaaagcttacaacaagctatgtctctcacacagagcatgaacaatctgaatactataaaaaagggcactgttcctttaagaagcagttccaatacccaaggagaaagcaccttctgtattgcctatacagtgagagtcagaattaagggctccattagattcagggtgagtgtttttgtcagaaagagtgcatagattttttttttttttttttttttagggatctctgtcataatgacatcaatttacattgagatgcaacaaaaatgaaatggattgatagagaaatgtgtggtaggaataaggaaatagcagtacaagtacaattttgctgtatattttccttggtgaaaatacagtgtgaacagcaagaggtccgtgttgccgtgcgccatagagcatgtcacgtggtggcactgctcatgtccatgcttgatggcgctgttaaggtggagacaatacctttgctttgcattttgaggagtctgtgtggcggtaaatactctgtcctgtgttaggcagtctcagctttccttgaagatagttgctcagtcagttcttccagggagatttataaaacaaaatgagataatcttatcactccttcaacatggatcggctgacattttgcctccatatttttctaacagtgtctaaaagcataagcagagctcttgaagaagtgcctctgttcatgttactgttaatgttccaggcagcactgttgggggggggggggctgcagccccagtgccacggggattcgtgttttcaggcagccacgtttcagaaaaaacctgaaaattcacagcaatgatgggtgttagcacctgtcacgtcagtgcttaattttcattttgaaaattgaaacatggccactccctgtttacctcttgtccacattctttagagatcagtaggtgttttacacttataacacagtttcccaccaactccatttcaagtgctcagaggtctgctgcttccatatgagaccagcacaattctacgatattcttgaagcagtttgtcagactggatgctaggtagtctcctgaagatgagtttccttctcctgtgactcatccaaagccagtaatttgcaaagctagctagatgaagaaggaaggagacttggagtgtggtgtgcttcagagacacacagcctgatagggagggttccgctagctctgtgaggaactgtgctttcctgaggatttggtacctaggacagaactcgcatagagatcaatggttgttgagctgaactcccacactggggtttagggctgtactccagcttggggcagggtggaagctgtcgacataattacttcactggaaacagcaaagagccgccacagcatttttaggctcactggggactcctactaggaatctagcttgcaaccttggaatgattttagttttgtttttaatcttacttcccaattaaatgtatgtaggaacctgagctagacccacccagctccgagggacattgaaggaagttggcgtgtaggacacccagtgggaagcacaggaaaagactaaggctcactgggagcggccctctgcacaggcaggctctcttgtcaaggatgagttccccatttgcagacattggcttcccgtacaagttgcatcgctgtctcctgtttaaaaccccagtctatactcatttccttccattttttttctgtatattttacaagcagttaaaaaagaaaaaaaggatgttggtagtgtcaaatggtagttctgttgtatttatactaattgaatcttacccatcagtaagattttctgtcctttcacctttaagaggtaatgtggcataggattcttcctggatgtgttggtgcacctttgttgactttaaaacagcctttggttctgtctaaagaatggtggtgtttctccttctgtgggtactttggagttgctgtaatctttgaatacagtgtagtgcctcaggttcttttctgtctgccttttaaatggttgcttagagtgccttatgttcttctttacaagtcagtagaatcacctcatcaagaagtggttaagttctctacaaggaaatatcgtagagcattgtagttatgttttgtatgaattatatttgcatgcagtgaaacagcatacagaagtttaaaatataagatatgagacaatttatactacattattattggtatccagggtatacacacacaaacacacacacacacacagagtttagacttctgtacgtataaaaactgttggggattctagtttagatcagctctgaagggggatgctgttggtttggggagacatagaaagacttaattatttaacctctgggtcttttgtttgtttgtttgtttgttttgcagtgcttaggatcaaatccaggaccttgtgcattcaaggcaggcattttaccgttgaataacccttttgtggctttctgaattttagacactgttgtactgtgtttgaaaaaatacatatgatgtgtacgaaaggaaggaaagagagagagagagagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcttctggagtgtctgaagacagctacagtgttcttacatataataaataaataaatctttaaaaaaaaaaagaatacttacaggatttaaaattattcagtttcagctttctatatataagtagacttgatttctttcaaggtcactatgtcactaccttattgtcctggggttttatcccccttttctcactttctttttttccttcctttctaaccaactttattttaatctaaattcctttcttataggaagtctagacaatacagaatttttttatatatttattttttaaatacaactttttaaaaagatttatttatttattttatgtgagtatatcactgtcattagacacaccagaagagggcatcagaccccattacagatggttgtgagccactatgtggttgttgggattttaactcaggacctctggaagagcagtcagtgcttttaaccgccgagccatctctccagcctctgcagaatatttttaaagattgatattattaacagtaaatcccaatatcaaaaagggatttctcttgtacatcggcagtctgcttcctttagcctcttaggagtctgctctctgttaacttgcatgcctgcctgagaacatgccagagctctagcagcccacactggagcccactgctcttgtgttctcttctcccccatccctctactttgaacctctccatcccttcaccagggcaaatgtgggggtaagagaacccatggccttttctattctgtgtctgcctccatcttgacctgctgtgatgttaacttggatgttttggatgcttttcttttcggaacaaaatttatatacttttaaataggtaaatttttatcctagactcttcctgtgtgctgtcatccttgcttgctctggtaaaaaataggaaagactttgaaccaggtactgattatttggataaagtaaactttttatttatttgtttattgatttatttgattgagtggtttgccagcatgtatttttgtgtaccgtttgcaagtctagtacccagagagaccagaagaggccatcagatctcctggaactgaaattatagtggtgacctgctcgggaggttgtggaaactaaacctgggtgctctgggagcacaaccagggctagtaactgctgagtccccaaacccttttcataaaggcattggccatgacatacgaaatgtaaactcactggtgataatggaacagatttaagccttgatacaaaagattcatgcccctgactgcatgtaaaggcttaaaaacttatatcataaattaggatttcaaagttaccataaacaaagatacagcagatgacaagtgagaaaatgattgcagctatgtgactaataattgatgttgcatctgccctcagttaaaatctatagcacaatagaaaaaggatcagaaactaacaaaagtcagactgacaatagcagaatagaagcaaacagaaaaggtgctcattccactattagtattttatcttaaagggattttttttctgccaaattggtgcacttgaataagtactaagcttagtgtttgggaggatgaaacaacaactggacatggttgtgatgacctatattaattatctgctgtgatacaaaccatgctgtatttttgtaggttagcacaacaaagatttatttcctgtttctaaagatgaggaatccaggagaaacatcctcatgagctttagtcaagctgtcagtcagggctgcagtcacgggaactggacggtccattcacatggatgttggctatccctattccttactgcataatggccagagacagcagttcctcaagaaccccagcatctattctcacctagcaactcctctcttgagcaagtgatctgacaaagaaaccaaagaaagatgcccttgtgtttgagttcttaggagacttgctttcactgccacatgctgttgatcacagtcatgagtacagagtaggaaagcactgcacaaggcacagctaccaggagtcaaggaaggacccatggagcctttggattctggctacccacatgcctttgttgagagtatatgcctgggtatttatttctctctgtaaaatagctatagaagtatctacatgatgtagtattctgtgggttaaatgtgcaaggtagcttctccctccactgccgggccttcggggagaatggcagaagcacctggagatcaggggagcatccttcacttttgcagccttgctatagggttagcatgtgtagtttatctgacttcttaaaggacagctaagccagcatccacagagatgcagacagagggtacaaagctccctgtgatctagtttggactttgtccgtgtcttaggatggcttattgtgaaactttatcttctgactgccctgggcagttatggttgtgagagatgacactgttaaatcagcattacatataaaaagaaacttttatactggatttattttgaatataaaattaatgaaatttgagtatggattggctgtgtaatatctgcagggaggttggaaaattaaagatgaagtgaatctgagatattttagcttgccatttgaagaagagatttactagtaagggagaaacagaaagattgtatgtttgaaaaggacaatctaggcttaaaccattggtctacatccaagaaaatacaaataaagatgttgcctttaagaagagggtttagctaggcccacattttgcatacctttagttccagctacctgggatgctaaagcagaaggaactattgaagtcaggagttacaggctagcctaagcaacatagtacaaccctgtctcagaaagggtttacatggagggggggaggaaggggggatatatgtgtattaaaatagagatattatccatggtgttacctgatgatatgatagaaaacagttcttatcatgaacaaaaatgtgttcactgtgtgagagtaacatgtattcatatatacataaaccccttgaatctaacctgtctttccaggacatatcattaagagttttgagtagtcagacatagtgaagcatgcccatactccaatacttgagaggtggaagcaggagttctgggctactttactccttgtctaaaaagaaaggagaaaagtttacattaaactgtagtccgagggaacgtcctgaagactttaatcagaagagcgatatcactgtaattatgtttggaaagactgaattgatcagtgtatgtagtaaccgaggagcggaggcagagcctctggggaagcgttgcagtctctcttccgatctgcagtctctcttccgatctgtgagctaagtccacacaagcctgagacaatggcttctctggtttgtgtctagtctcaagtccagagcaagccacagaaaaaggcatgttatagatgaaaaactagtgaattataacttcctgaagctttttgagaaaagctagtctaaattagtaaactctctcagattgaagttgttatagttgagaagtgaaagaatatgggattttaatttttttgttttttgttttttcgagacagggtttctctgtgtagtcctggttgtcctggaactcaccttgtagaccaggctagccttgaactcagaaacctgcctgcctttgcctcacaagtgctgggattaaaggcgcgagccaccactgccctgctgaatatgggattattagtaggcagtagacctataaagactgaatcctgctcactgaaggcttgtaaaatgtcatcttatttcctttgctgctgtattagatgacattttgctttttgagacagtgtctcatgtagctgaggctagccttaataactctgatccctctgcctctgacttctaagtggtgggattaaagatgtacaccacatctggcctagtatagggatttcaaaaaaggcttaaggggaaagtccagtccttcaggaggtaggtctcatgctttgtatgcagtgcactaaaggaactgagggacacatgaaagcagatgggaaggtgacaggtgtggtgactctcatgggcttttcaaaaaagagacttttacttcttcaggattttcctttggccattttttatcttgcgtgtatgtctgtgaactatgtgtgttcagagccaggagaggccagaagagggcattggatcccttagaactggagttacagatggttgttggctgtcatttaggtgctgggcattgaacccaggacctctggaagaaaaatcagtgctcctaaccacgaagccacctttccaactcctttatcatgctttttaaaataagaatattaaatatcttgtttcagtggacaaaggaaagctcgtactcggctcgttgtcttgttttcatggtatcttcataatactgattttttttttaattgcgagatatttgctaaaaaaaaatgtcttgtttattccaggggctacgctaagtatgagacctgcccccattccaatagaggaccctgaatggagacaaacacctcccccagtctccgccacacctggaaccttccggcttcgacgagggagtagatttacctggagaaaggagtgcctagctgtcatggaaaggtaggtttcctagtattgtggaacacttggcagtccagtttcatttctaaaagataatctgaagtccagattctagctctgcgggtgttgtgaaatactaggactgtgttggtgaggtaagagagctcacaaagctggagctagcgtctgtcagctgagtttacagcttcactttgtcctctgctgttgttgtttctgctgttgttgtttttgagataaggtttttctgtgtagtcctggctctcttggaactcactctgtacaccaggttggcctcaaactcacagagatcctcctgcctctgcctctctaatgtggggattagggcatacacccccaccacccagcttaaagatagtatttataaatgtatatctttccatgatcctgaagagcctctgtgcagcttgatcctcctgtgttgaacagtagaggagagctctgagattcactttcctgcagaagacggtcagtctctgaatggattcccaaaggttacaaactacatgtaatcgaatctgatctgtgtctggtttcagtacttttgacagcttcattttttccccatctaacatggtataaatacatgcttataacatatttagtatatgttctacagtagaactgtcctttaaggagcccccactttgcagcataagtgatatatacaggattctgatttgttggggatgttgacagcaacagagtttattcttacctaatccaaccacaagtgtagcatcctggacggaacatttgatggagatttagaagtcccagaaacctgatcaggctctgatcaagtcagagaccaaaactgtatccttcttgtcttcaaaatgaaaatgtcagtagccgacaatatgttacccagggtgtctgctttctctttcccctgtttcccagtgcattgacctcactgcctgaggaaggacaggctttgcagtgctggaggtcagatggtgtacgtgaggtgaataggtagccacgatggaactgtcagttatccattgctgtgaggtgctctccctcactcttatctgtagctaagaggagaccatattctcagtaataagccagtgtcttcctgactgaccagagtataaggggaagacttcagtgttctggaggtctgattgcactctgctccatttccctcttctgtgaagtttaattctttccaaaagtttgtttcaaatttccacatagcagatgagaatcaaaacaatgcctaacttaaatgagtcacaacattgtatatttctctctggtaacagaatacattttgatatttctttgtgcctagtgtgggttttaattataccaataatgcagtcagttaatttttttcactaatattccaaagtgcatttatcacataaagttggtacgagaaaggattaaccattgagaatatgcaaatagtaaatgatactgtgcaaataatagaaagcacatgactcctgatggactttagagtggaacctaagactctggctggggctccatttacttctgagttttctttcatagaattgcactggctaatttttagtcaaaaggatgcacaacattttatccttttataaggttcctatttagttctaacgtatttttaaccttaattttaatttaatatcttcaccctaggactcggtattttctggcttcgtttcatcttacctggcacagctagagaaggtgtggctcaggcctgactgatcagaaatgctgaaagcctttcaaagcaccgagtagcaattgtctagatgatctgcaccctccaaaaatggagctttgtattcacagaagtggaacatgaagtcacctgccttagagtagcatcatgctttttggcatagactgaatgtttggataaatacatatgcccagccaagtaagccttattcaaatatgctagcataggataaacgtccaaaactatcccattcctcactccatacagcaagatgaatttcaaatcaatcagagaagtgaacttacatacatagaagaaaacataagttatcctttcatatcctggaagtgggagacatgtttcctaacggagtctcataatccaaaagcagacgtgaagtaatggataaatataggtggaaagaacttctggggtaaaactaacaaagtggaaaggtttcacccttaacatagagagagagctcataagtaaggtaggaccaacagttggacagaaagagtgacgaaagggaccaggacaaaagtactgcaaaggcttcctgagcacaggtaaagttccaagatgatggttgctattctcccttgtttccgctgttcttgagactcagtccactcagccctgggagtccccagctcatggcaggcctcctggaccagtctccacgtgtaaatcactgcatcccagcaaaaacacttactctgaatcaagagtgagttgaattaaaattctattgaggtcccatccttcacctgtcacactggcaaacaatttggcaaagttttctcctgattaggctccgcagaagtggcattttcatccatttctgtggaaatgcaaaacagcagctcctatggaagagagccggggtatgtctgggcagttacctatgatttgccttttagagccacactcctgtttctactgacagaaatacaaaataatatcagaatcctgggagaagcctgaatgtatctgtagcggtctgggtaaataagtacagaaaatgaaaaggccactgagaaggccgagcgggtaagcacctgctgtgaagcctgatgtcccaaggtcaatccctgggacccacgtgaacgtggaaggagagaggcatcgctgcatgttgtcatatctccacacacaaatgtacatgtacttaggagaaacaacctcattgagatagagcccacttgtttaatgccttgaatgtacctatagtcacgtaagtgtcaccacatttacttttacaatactgtcactgtgccctcagaaccttgggatctaatggaaaccactctcttttcctcccatccatcttagttctatataaccattagtctgtgtgtaaatgtgtctgctctggacattgtactattatgagtgactcataggaggccagattagaaggctgtcagagtaacctgtgcctgagtgaggagagctggatgatagtaaaaagacaacgggatagcataaataaaaaggcataactatcagaagggagtgtgaggaaagacagtataactagctgtaggaggagcatggaaggacaacagcagagaacatagaaggagcttagcttggtgatggtcaggcatccactgaggacagtgtctgtaccactggacagacatccagtgtcagcatctccagacaccagttcttatgtttctaaactgaagattgaagtgtaatgatagagtaaaagaagataaactcagagttagacaaggtttgatactggctccccagccaacccgtatgtgaatcattaggaacttagcaccttggtaagttgagatttgagggtgaatggagatgatgcgtgtaatgaaatagtgggatgttcttgttgagagtgtttgtcttcagagtaagctgttccagtgtcaggtaggaagttacctgaggtgtctttcagaaagtgcactggacatgggaacaccatcagtgagttatttacagctcaaggaacaggtacagcctcgtctggttacatctttcaacttacacagtttctgcatttttttgcaattgattgtagctagaaaaacaaacaaacaaacaaacttaaaaccctgctaatttatctcattttattttttttaaagatttatttattattattactatatctaagtacactgtagctgtcttcagatgcaccagaagagggcatcagatctcattacagatggttgtgagccaccatgtggttgctgggatttgaactcaggacctttggaagagcagtcggtgctcttaaccactgagccatctctccagcccaatttatctcattttaaattaatgatctcgaaccccagagagatttttaattctgtcaggtactcatactatatcttcctggttcaccctttctgctttctttaaattattttacacttcatttttcctctaaaaactatcttcctttttttgtggtgaccttgcttcacatttgagtgagaaaaataaaacacttacaggagagtgtccacaaactacagcctgctaacatgtatgtgcagagacaagggtgtgtgcagtttccccagtaccttaccacatccaaagcaccgcaaggatgcatttccccaggacttatcagtgtgtggcttattgtagatagtcatattcatatatataaaatgttgtgagtgttgctttttttttccttttctgaccttattgcattctctgtcctgtgtacttcacttttccagtactgactcctcgaatcattgattattacaaggggcaatattatgtggttctatttatagaaaatatccagagtaatcaaatttgtagaaaaagaacatatttggcactggcccagaccaggaaagatagaggtctgggggccaggaaaccgctgaagagcacactgcttttacgcttttataaatatactaaaatcacattttagatatgtaaattgatccacatgtgagtcatactttaacaaaacttcacataaagaaggaaggcgttgtttagtccgccatcaggagcacccctgtttaccctgcacatttggtcttgtttcctgtttagtacagtattttttgttttaaagatttgtctattttaatggagagtttagaagacattgttggataatctttgattagttacttattaaagttttgctatatattaccaaaaagctaggtttaggtatatatatctacaagatggaaaacatacatttgataggcctatatctgcagatagtgtgagatgaaaactgggactttccaaaaccttccccttcactcattcagtcaacccccttccggtaatagggcagtgttggggggagagagattagaaacagctttcggtggaagaagaggtcgtgtaagctggacttgatttctggaggcttggagcctaggaggcaggccccagtatactctccctatatgcctttcaggatctggccatggtgtgccttgggaaataggtgtgtcttggatctgtggctagaacacagagaatgaggcctggctactgttcctactcctgtttcatatcaaaggaagaaaatagaagtttctaaaccacaccacaggttctttaacccagttaagaaaaatggggaaaaaagcaacaaccttggggaagccttgaccaggctcagcagtaactgtgagagtgcctggcagtatcaggtggacgtggtgaccacctggagccatggaataagacagttacttactgctgctatttgtagtccagtgagtgaatgactgtccaggaaggtacagaggaatgcatctgtgcaggttttgtttttcttatggaccagtttacctgtaatatgtttttgttcttgggttgtttccgtcatgttcatcttctgtaagtaatggagaacaaaaataaaacccaccagtaaacatagaaccatgaaattataaggaaaatgaattttggctttttgacctttgaaatcaacaaaataactctaagaagttaatttaaaatacttgctccagaagccaaggaattagcgtggaaaacaagcctgagagtaagtgtctccttcccccaaaattcaagtatccaaaaataggttcttggaataactgctgtcgtgagcgaaaatagcattgcagccacagtattatggcaaacacaaattaaatcaaagctctaaacttggtgtccctgcccttaacctgacgtgcgtataatctacatttgagacgtgtctgacacacagatgcattttacagggggtattattgcctcctgggagaattagtatggaagagatgaatcggcttctcaagcatgtttctagaatgttgtttgagggttctgtattttcattcccttggtctttagcattttggaattcttcccaggacagtttgttagtgtaaggttatggtatcagtctcgtgcctgtctctttttacttatagtttcagtgaattcttcaccaggcgggttctggagagtagcgtgtgcagagactagtgtggcaggctagcatgtctgggtgccatgagcagactaaccctggggagccgtcacccctgagaatgagctcagtcagagctctgttttcctgcctgtcctcatagtcagcttgtgagcggtcctctcaaagtcagtgtttacagatgcatggtaatgaactatcaagagtgttaaggtctgaagtgacaaagacttcatcgttcaccttgcacttcatgtagattcttagaattactaatttttttattaaatgagaaaactacaaactcgtgacttactacttagaaaaaattgacttctcttatttttggttttgttcctaaaactttattataatcacaaagaatatttcatcttcttcattattgttttgttgctgaattgagttagcctgctgaagggagtatctcttaagctcccagatctcagaggcaagttagtaacaccaagaaaaaaatgagtgtgttttttagatttttacatttaagtgtgattgctttttagcaagtggccccatcaataacggtgaatttattaagtggcatgctgcagcgaaggatgatcctggcttagtaaacttgagggaatgtaaatgagatgatggggagcagacggagcagttgtgttatcatgacaaagtgtaaggcaggctgagtcatggcagctccaacctgtcatcccagcacgcaggaggctgaagcaggaggaacacttaaaaagagtgtgcaggagccctgaaagcttaccaagttcaggctagcctaggcggctgagggagactatctcaaaaaccagtagtgacagtacgggtaataaagcaaaagatgtgcgtgcagaaagatgaaggtagaggggcatgataaaatttaaattatttgctttaaatgttgagtttatatttttgtattcttttctttttctttggtatctgatgatctagcaattaggaacacatactaaatatgttctaggtatccataggcaggtcacttgctacaaaatgactattgtaagaccatggggctggagagatggctcagcagttgagagcttctgtttcagaggactgaggttctattctcatctcccaaatggtggctcacacctgtctataactccatgccagggggagccaccctcttctggcctctgcagcactgggaatgcatatagtacacaggcatacatgtaggcaaaacacccacactccataaaaataagtgaaaaaaaattaaaacatgatgatagctatttgtaggagtacagtgatttcgtgactattaaatgctacgtgtttaatagctggcattcttcctttcactacatggtcaagataaaaaaagaaattagagccaatgagatggctcagtgattgaagtccccttccaccaagcctgacaacctaagtgtggtctctggtactcaaatagcaaaaggagagggccaactcatgcaggttgacctctgacctccacacataccttcctcctaaaatcaatcaatcaatcaatctaaattacaataataatataaattaataactttcaggatgattttattcaacagaaattttctgaagtggtcactttaaccagttgaagtctgctgtgcctttcttctaaaatcaaaacaatgcaaacagaacatgtgtccctacgagttgttctaggtgcttgtcaagctgagacaagatcacctgagtaatcttataggtagcttgggagacttcatcccttgtttttgtttgtttgttttttgtttttttttttggggggggggtgcggggagaagatgtcactgttcactcttctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagtgtttttgttttgttttttttcccaagcccgtgactcaagatcaggggttgagaggggattgatttataggacagcataggaatttaaattttgaaactggttaaaaagtctttccatacttcctttctaaagtcagagcctgacatggaagggagtaacttgacaatccagccatgctaaatcttgtacaaatcttctgattctgctcccatattataaagggacattgttatttataaaaattgcaaaatttggttttcttgacaacctggtgttaaggtaaggtgcgttgttgggatagaattataaacaataccattgccagaaagaattatcccccatctgcccagtgtattttactcggcatttcagtggcatgttttatttgttccgggcaagcattttattagactcggcaggcaaagaagctgcatggcactaggcgcgaaggctgatgcttcccaggctaatgagaatgtgactgaatgagtaggtaaggagagcccacagcctcagtatggttaggctctgttagtccacgtcttctccagacgagccaggctcggaggagacacagaacagtataggatcttttgattttcttcaaaatcttaaggccgttatgtcaatccaaaggttagtactagtgaaggatttaagcttacccccgctgaagtgactcagagccctctcctttccattgcttcagtgttgtctttccattgcttcagtgttccttgtgctgtgctggcagggttgagctcctgacctcctgactaaagcgcatgccctctgcctccccgacatagttttgccatcagctcggcttcctttccccccttcctgatgtcagcactggttgagaataggaaatgctgggggggataaactataaattttgaaattgataggtactggaggctgaattttaaaatgagtttctcctctcccatacccttgtggaattactcgagtggaacgtaatgagctgctcctcctgtgcctctgcaaggagaaggaagttcttagcatttacatgagacagcaggagcctggacatgacctcatttcaatccattagactatttgaggaaaaacaacaaaactttgccacttattgacaagtaaagctatcccaatccatttctcatagccaataagaagatgaactgtccttaaatgcattttaaaattggcaaattatacttcctagttcctttctggtcaaacagaaatagctgaaagagaaattatcatgatgcttttgaggtggattaaaagtctccctttctcttgtggatgctctggcagcagttgttatttttaacaaacagtgatgcacccctatttctctagtccctgacagttaagtagactagaaagcctgtgctccacatgaccttctgtagccattgtctacaaagaaacagcacagttaggtgactcttggtaccatgagagtcatcgtgaggtatgacggcttcatcagaacatgaactttagatgtgtaaacactggcacgaatggaggtcagcttgtgactaactgaaaactgtgggagacaagtgagtcttttcttcttaggattcaaatattccaggtattactttgtatccatcctgtggtagatactaggagaacacacacacacatacacacacacacacacacacacacgcacacacacacacacactgtatactaggggatcaaaggcgatcttggctcttcttacagtatgggaatgagtgttagaacctaagatcacagctttcatggggcttgctgtggcagtggcaggagatagacttgggagtaagtgttctacttgcttgtcttttggttgaagaagcttaaatatcctgatgagtttctttttttttttttttaagatttcttcctttctttctttctttctttctttctttctttctttctttctttctttctttctttctttctctctctcttttgtatatgagtacactgtagctgtacagatggttgtgagccttcatgtggttgttgggaactgaatttaaggacctctgctcgctctggtctatcctgcttgctcagttcctgctcattctggcccaaagatgtatttttttttttataaataggtacactgtagctgtcttcagacgaaccaaaagaggccatcagatctcattatgagtggttgtgaaccaccatatggttgctgggatttgaactcaggaccttcagaagagtagtcagtactcttaccccctgagccatctcaccagccccctgctgagtttcatacaaaatgtatgtcctctttaaactgtacttggaaacctatgtaccatagaaaccctgaatatgatatagtgcctcactcagattattctgttgtgttgctttggtaacatgccatacattaacagttcaggttagggaaggagaggttgctccctcttgcagaagacctgggtttgagtcccagctcacagccaacactaactccatctctgggagatctaatgccctcttctgacctctgctggcactacacacatacatgtaaaataagatttaaaaagtgtatttctccaaagcccagacttcatttctaactctcttgagattgtcatatagccatcatccttaggcagacttgtcaccaaaatagccttactgtttagttttctcttggaagtttattaaacctgtacatagtggctgaacagcctttcagcatatgttctgtcagatagtatcagaaactaatttcacttttgtttgtttgtttgtctgtttgtttgagatatgatcttacagtagcccaggctgtcctggaactaactggtatgtagaccagaatggcctcagaatcagagagttctgtcttcctctgcttccttagagctaggatttttttttaagatttatttattattattatatctaagtacactgtagctgtcttcagatgcatgtgaaccaccatgtggttgctgggatttgaactcaggacctttggaagagcagtcagtgctcttaaccactgagccatctctccagcccctagagctaggatttaaggagtacttcacaattccttgctttttattgttgtttttaagaaaaggtttttttgtttgtttttgttttgcggggagaggggagggcattgttttgagataaggttctctatgacttaccctgtagaaggccagtaaaggccattacctaccttctgatagtttggctatcactgaaaatggtcacaaaccattgagaagtgaaaagctaagcttcaggaagtgccaggataaccagagaccagtacaccctgattcttcacgagatcttggccaaaagcagagactttattgccaccataattctaagagtttacttacttggtttgctatttatgaattttttaaaaaaattgattcccctggaaaaccagttctcattttaggctcacacattattcttttagtaggaatgtcctttttgcaaaaacttgccattgaccctaaggaaaaaaaaaaaaaaccatttagggaacaatgagttgatcaatcctcttttgttgatctttctattatgatacattattggggggcagagtgtgaggaacttaattctctatcaccttccagttctctctgacaaacatgattcctattagtaaaaccggacagaaggcaaaaggtgcagctaccgcctggctgcagctgaagcagattgcaagaggaactcgccagcctggatgcccaagagtttgtgaactttccaaaatgttactgtctgctgatttaacttgtgtaacactcacatttggtggttcctctagaaagttcgtggaccagcagacccaaacaccacccttacacactctattctttattgttaaaatggagcatgggccagatgcttggtgatgtcatgagagtcagtcaagctgcttgtcttagtcaagtgcagcttcttagttgtctgtctgtctgtctctctttctctctctctctctatctatctttttaacaagagcacaaatctacttttattcatttactctccattagtttaaatccgggatgggtacagcatcacacagattctgtgtccagtgacctttgcaggaaggttgcttcggattttggcttgaaccatataccaccactgttccatgggcccgagttacttttccccagatcgctctggttttgtttggtttgcctccaggagacactgtattgttttttgctttatacacataagcacatcttttgcctaagtagaacataaatgccttcaattctaagaggagccctgtgctctctttggttccggagaccttgcttgaagccagccaacatggccttgcaccacagccttcctgacatacttaagtcctgttcccagcaggccccaaaaatctgcccccaaagtttagcagcagaaacgacctcacggccaccttgtttttctttactgtagtgggaacctgcccagtgtactgtttgctctgttccattgtgtttcctgagagctccagaagagcctccatctctaatgaactgaatgtaaaacatcccttgggtttatgtgtttgaaaccgtgggcccaaacttctggtggtgttttggaacgccgtggaactgttagaaaatgtaaatgaagaaaataactaataaaaaattaaaaaagaaagaaagaaaatggggcctagctggaggaaaggaatttcttggggatgggtcttgaagtttataacctggcctggcttccctcctcttttttgactggtctgctaaaatgtgagcaagcacctaatgccttccccaccatgctctgcagtatccctcaaaccatgagccagggtcaattcttcctcacttaaattgcctcttccagacaactgaggaccagcaaagaggagagtaaccaatgtctttcattcctggctgtcaaggagcaggtggccaaccaaaaacgggcatctcaccatcctgataaggaattagttggaagcctataacctatagtgtttgcagaggtattgctgcatgtaggttaagcgaaccccactgtagatctaggctgttatgtatagtgaggctgtactccagagtttatttaatcctctgctgctcagggaagaaaggtgggtcagtattgtagttgtcccctgggtaatcatggttcctttttcaaggaagtgaagcccttgtgtgagatgcagctctggacctacagttctctttctctggcactgtcaggagctctcgtgagattggcaggaccttaagccacttggttgtctttggggatttgcattgcatatcttaaatgaagtcagaagcagtagcctatctttagccaacagtggccattcctgttaggcctttaagccaatgaactgtgtcaggatacctgaactgcgtgcgggctgtggccttgaggagggcagttctttgtcctttctgactccatctatggagttcatgccttactacaggtggaaggggctgacctcatgatgtttccatacaactcaaaggtttttgattccttgccagggtctgctctgcagtctgtctaaatccacaatggtctgtgctgtgggcttccatatgaatttatgaatgaggatttgaaaagtcatctttttgtgtttttagtctgtccacaggccagtactaattcttctgtttaaaactcctttcacaagcttttctgttctgaagttttaagaagatgctgccaagctgtgaaaacatactgcttcctctggaacagaactcatttatattttagcttttctcttcacgtacaccttttaaaaggttgatgtggggagagctgttatttattttattctgcccatagaattcaaaatgagctcatcggtaaaaaggcattagtgcaggatggcttctgcttatcaaactctagtgcgtttatgaaacacactctgaaatgttgctgaaggtgcacagcgagctaaggaacgttattatttagtaataattatgtaaacttgcacttctctcacatcataaggtggcaaactttcttttgaaatattgggtttttcattataaagctactatatggttagtgtgtaaaatgtgaggaaatacaggaagatgtagaatagaagtgagctctcatgctcgctctcggtggtcatcaacacttaccgtgttttcagttgtatgtctgtgtgttatatacaaaccttttcaagcagcagagactaataccagctgtgtaattctgtattaactatcattatatgacttttaaaatataattttattatgaatactaccatgagaatatgctgtagtttatggatatttatctgtctttctatttctaggcctgacttcatctaagatcagatgaattcaggaagttttggccacagtggcctaactgcttagttgactatgcttccatatgcttccaggttgtacccatgatgatgggtgaatacgtggagaagcaagtaggctgatttgacagagacctgcttacttgcttgtttgttgtttagttctcttgcttacttgttttgagagagaaattcactgtatggcccaggctagcctggaatgacattttcctgccttagcctcccgagtgctgggattataggtgtgagcagccccacctggcttcagctccaagctcactatgtggctgaatatgacctggaactcacatcttctaccccacctggtgagggcagggttaccaaccacgcccggctcactctgcttttgttgttaggcattttatttcaattttcatttatctttattcttttaaatagtaagagatagataataataagagcaagataattacagtgttaagttttctaactggctactatttatatacaagaaattctgatcatttaaatggtttgtgtgtatttaccatgtacagtaagatttttcactcctgttagcattttttaatgtgctttgacatttcataaatgtatataataccctttgatcatcttccatgccctattggcatattctgctcctcccctactgttcctttccgtctccacgccctctgtctacttccgtgcattatctctagtggtttcttctttttctttaatttttattgttacatgtgtatgaacatataaatatataaatacaaactgctgaatttatacattgctcatatgtatatttttagggctgaccagtggtattggctaaccattttagggacttgtccctggataagactggttctctccatttcagcagtcactggtaattgatagcttctcgtctagggatgaggccttgtgagatctcccccattgttggcatgtcaactggtgttgtcattgcttaggtcttgtttgtgcagccataatgttgagatttcacaggttcagcttccatgtcatatatagaggatataatctcaaagcagacatcttggtcctttgtggcattgaaatcctcacacttgctttgtccttgatgtttcctgagtcataaatataagggctgtggtacagatgtatcagttggggctgaggacccaattaaatgttctctgcattttgagcagttggggctttctgtaatagtctctatctcctggaaaaaaaaaaaaaaagcttctttatgaggaatgaaagctacctttatctgtgggtataagaataagtattgggaatgctgccataggttataggttctgtgggctcaccagccacaagtagttgacattagctgacatgaattttgtcccctcaaatggtccataaggacaactagacagctattggttaccactaacatataagggccactggtgcacctttgaggatatcttgccatgttggtcattgctgtggctcataggtgtcttagctgggcaggactattgattgcttttctatcttggcagtctgcccaccactttccagtactatgatacctagaccacagggaggatgattctgggtcctgtctccagagtccagagcatcctcagcaataggaatttacctttagattctgggaagcaactaagggcaacagcaatagcctgtattattttggaagttgcttaagatcactgagcaacaactttaaaaggatgtttctcatgcttggtaggagggtttgtgttagtctctggctcttggaggggaacattatcaacccccacaggttatattttacacacacacacacacacatataccttctttcatgtacatataacgtatgtaattataggtaaacataaataatgatgcctccatttctctccctcagcactgcctttaccccaccgtataaaaacaaacctaagaaatgaagacattttaattgttttattgctaaagatcatttcacacatagatgctctcaaataggaggtaggacgattaaactccatagcatgtaggctagcttaatgttaatgttttctgaagaaatccacatggaattatgggtagtaggaagcagtcccgaaagctatttctagataactaaaagagagaaagtgcagctctcttctgcagaggtagcctgcaggaggacagagcgacgtgccgtgcatgcggctctatcccctcctgtggttggtctctgtttttttctgcattctcaagatacaaagcagaatattcagtggctgcagtgatttaggagttactggaacaacagtgcttcaggagcagctccttttgttcttagcttctggcttctcatttcctgtacattctcttcccgtttttacccttcatcatacagcagtcatgtgatctccctatgggaagctgtgcactggtcgcttagctgacagtgtcctttgtgacgtgcagtgtcctcagagtttgccgtctctttatgttgctatcctcaggcatgtgctacatttctttctcttttgtacattccagagcgtctagggctgtaagcatttccaatagaaagaagaatgaagttctagggtttgattttgtgtctcctttagaaactagcagccaagctctcctaccttagaaatgtttattgggttttgtttgtttgtttgtttgttttttacaaaaagcaaataagcaacaacaaaaaaatctaaaaattaaagtgccagaaggcgaataatgtctcatgctacagacagaactgtctaaggctgtgtgagtacccctggacgggtcctgcctcttctgtctctatgccttcatggcttctccttagctattgccacagctacacacacgacttctgtgtccatcaccacaggaaatgctgctctacaaaacaactttgacccttagatctccctgctttgaaccacagcaccaagatccttaaaaagttggttcctctcttcacaacatgggctcagtcttttccactttgatccgctgcccctgtcaagcactgcacatacagggtgtgttgggctccctcccaatttcagtgtcaggggctccttaggattcctttactctgcctctcattatttccctatgcccaaatccctgtcctgaaagctctcactcttttcttgagaccctgttctgccgtcagctctcgtctgctatagtagtgcttttgtgcctacagtactggggttgttcccttacagttctgtatttacctcggtctgctgtgaccacacccggaagttctctctggttcatccttgccacccctgatagtcagctatatagtagaaactagggtttgttacagggtgattaaaggcgtgattaagaaagtacagaattgcctatttgctgacttccttgatagtccagcttggttgcatatagtttaaaagaaacaccgttctgatgtaactgtagtcatctatgtctccactgctaaaaccaccaaacatacctgaagcagacaccatggagcacgctgggaccctgaagctgtctctgcgggaactgctggtgctggttcctccagaagccttgcttagagcctctgctttcgttcaccagactcctctttacgttccttcttccatttctttattcacacatctcttgagtaaacagatacacacttgttagtctctaccatgaccagccagactccttctgtgaataactggaaaactggccattttttttctttgacacttccctttctctaagcagcattccctctcaccaagcgcataaggcttttgttgcactagtcactatggtgcgatcctaggcaggtcctgaagttttggacatctatcctttgtcagatgttttctctgattctctccactctattgccacctagctgtctttttgttttctgttgtgcatccaattagatgaccatacagttttgtccttcacactatgggaggaaggttttaatttgttttgtttttcttatatctgtggtcaccagagtgtcggacaatgcaggtctgataaaatgagttagagaagcttcttcctcctgagcttttggggtaatttcagaagaactcgtgttaattctttaaacgttagctagagctcagcagtgaggctgagcggaacagttcttaatcataaaacagtaggggctggtctgcactggctgctcctctagggggcccaggttcatttcctagcgcccacctgaccactcacaaccatctgtaactctagttccaggggtccacggccctcttctgacttctgcaggcactgcacacatgtgagtcacaaacacacccgtaggcaaacattcatggatataattttatttaaaaaaaccaaaaaaaaaacagattttttttttaaacagaaaaaaaaatcactttcaccgggtgtggtggcacacacctttaatcccagcacttggaaggcagaggcaaaaaaaaaaaaaaaaaaaaaaagactaaatactcttgatttgggagaagttcctggggtcttctttactccgaccttcattgtataaaagtaaagcctggaaatacagagtaagtgtaaacactaaaacttggactcaaaagaagacattatgctatgaataactgaaaattttcaatttagcatccaaagccagtatggctttttcctattagtcactgcagtcacaacagtaatgccttctacctggtcccaatccactttagaacataaattgtttgcagatttatattaatcgtcaaactagttcttaattatttcagtgtttccctaaggtctttttattataaaaatgatgtctgttcatttcaaaaactctgtggagacttccatgaagtagattgtgagagtcagtcatgtcacagtgtcaccagcattttatttcctgctctgtatcatccatcttgctcctcagagataaaggctctgacagccgtgagttctgacgttgggctgagcagtccaggcctgcagtcgcagcatttgtgagacgactgaggttgagtctgacttgcaccctagctagcttcaggaagaggagcgggtcaagatggaagaactgtgaggtaggacagatgagtcctgtaggactcaccagggaaagaaaactcctgccccgggaaatggaccagatttgcactggaagaaggcaaaaggcaaatattctgccaggaaataggcataggcctcttacctaagtgccagtgaccacagagactggggaagggtctaagcatccatagtaaacctttgaaactgtttgaacaggatataacctaaagaaatgagtcaagaatattaaccacatacttcagggcccgtcgtgggctttcaggtcatttggctaaaatgttataaggtgtactggccacagagttgtcgcttaaatggaatcttaggttttagcagccagtgtattccatcaggtctagcaaagtcttgattgtaaggcatgccttattgtgcacgccattcaattttcagatactaccagttaggaaatgtgtcctgatttcacagatcacaataatgaagaaatgtgcatcataaaatcagtgaaagaagattattacactggtgcagaaaaaagctgagaacggcaagaaaaatgagagagaatgagcaggagaggggacacaatcaaggacaaggagagaagttgaccttggaaaggagggtgatttatgttttctcagttatgagaaaggaaatgaataatggtccggagaagtttagcagctcagaagctaaaaaaatctagcaaacagcaaaggcaaggtcatctgcagaaagagtgacggtggtggctttaagggctgagacttcagagtgaaaaggtttcagcagatcgggcatgaaagaatttcctccagaaaggaaggggctagttcagattgcagaggaacgaaaccacttggccacgttttgtggtgttgaggagcacatctcatcctgagaaggattggagtaaaaggcaggtgctgcctgcagtgcgggagatgggcagggcaggaacggggaacagaaaactcattaggcgggttcttcttggaaagtttggcttgtctgccatttgggtgagaagtaagggacatagctagaggtaatagacagatatttatgttttatttagaagaagagaaacaatttcaggattagtgattgcagagatgaagaactaattcagaacttaaggccatggaagtagaatttggaggaataagtttgaagatgtcatcttcctaaagcataggtgggttctgtctgtttggaaaaccctcaggctctccactgatgtcagctgttggccttcattcttagaggacattgagtccattgcaggcttgtcctttgaagaagtgatagagaccagcactgatcccattccatcgcatcatctgtgaagcccaagtgcttaacacattctgctctgcttcattctgctcattctcatggcctcacctgccatctttacagttgccagtcctgaaggcctacctcaggcttctctgtgacatctttccagactcctcccacaaccctgaagacacagaactgtccacagatgctaagcatttcaccacaaggacacttgcatatatttctttctcaagtacattgtgagttccttgatgccagaaaccaattttttttctttacccacaataccaagcacatattatgtaattcgtatctacttggtgaatttgaggtaaatgaggcaattgggtgacaaataagatgttagtgtgattctggttacttactgagtctgctccaggtgaagcgatgggtctaccatggcctaacagaaagttagttcaagcaaacatggggcccagacagcaaggacatggagcatctgtgagagtggtggcttggtagcatcttagagtgaacactggtacccaaggatcatgcaggagaaaatacctacactgtggaaaacagccagggaccatgtagagcatggttgtgaagcttatgttttagaaaagacgatggagaagcgaggcagcacagactgaagtgaaggtctgccatccataaggagacaacgagagaggaaagcagggtcaggttgggtgtcttaggaggggaggggccctggggcatctgtgcaatgggtggtctttgccagtgctggtaggtgtggtaagggaacaagactggttttcaggaaagggacaccctggaataaatggtcattactagaatgcagtgaagatcaggctcaagccataagcggtttctttttaagttcatagatgtcagaaaaagcactaataatgagcattctgttcccacgttacattttatgcatctgatggtctaacaacagatttagtgggcctcgtattgctaagcctactattgaatcacagtagtatctacttctttcagaaatgaaatgtgcaagtatcccactgagcccttgctcagctgtgagtggtcagtgttctccatctagtgtgcatcttcttcggttgctcatgtattccggcacgcatgccatcaggaatcttttaattcttggcatttggcttgtgtgttagtctgtggattgtttttctctcttaggaataggctataagcattcattcaggtcagtggacagagtgctaacttatttttctcctagttgttttcaaatagctttgtgtcaatacagatgccccataatttgttctgtcatcccctcttggaggataattgagtaatttccatattttttgctactacaaaagaaaaaaagtgaccaaaaaagaaaaggttgtgttgacaccagtcttcagtagcgtggctcttgtggctctgtgacttgagtcatgtataataaaatatcatatacatagcagagctgaccttacccctttcttccctgccttccttgccttccctgttcttagccttccctcctatcattcctcttggtttccccagtcagtttgatttctgaggtcatgtcatacatgcattcataattttatatatctatataaaataaataaatgagagtgggcacggtattttcttcctaagactagcttaattcagttaacatgatcatcgccaggtggatccttaaaaagaataacttatctcagaggaatcttaatgaagtaccgcagcatggagccaccagtcacaattagtaatttcagtgaagtggaaggcaggtctcttacttacatcagcttcctctcaagtacaagtgggcacataggtggtagttaccgtattgaacacagtagagaatgtttctgtcagaaagctcttctgaacttcctggcatacgccagagttgtctcaaagaagacgtatttaatgagtacgttttaaagtagatgtgtctttgtcggttgcccctacagttacttcaatgagaaccagtacccagatgaagcaaagagagaagaaattgccaatgcttgcaatgcagtcatacagaagccaggtaaggtatgagctcagctgtggtcagtggtctggacagtcacctcgtaatgcaggtcccagcccagtgttcttcacagagcacttctgatgttaccatggcatgagtcaagtgctcatagacaatgactctccataagatttgaagccttgaatttttttaattatggatttgtattagtaaaagttagcataaatttatcaattctgaagtaatcataaagtgtgaaattttaagcaagttttgttaataaaaatacataaatccagtttttcaaagttgctctaaaattgtatgctctgtgagaaagctctttgcgattggattctgtctgcttcctacattggatcgacctctgcctagctaagggaaacatggtggctcccttttaaagtctcctgggcgagtccacagccactctactatttcctgtgtatcttatccctgtgcatttcagagacttggcacaagaacccattcaattaaaacagccagctggtttctactttaccatttgttttgctgggttaaagactgtgtgaatctcagttttatgaagtgaagaggggccaatcccctttatttagaagactgactttcgccatatctaccctacaccctcagaggagtccataccatgtgtatacaggcctacagtcccagtgcagggatttcctctggaaaacacatacagattataagcttaaaacatgaagacagacaggagaaagtctggagagatggctcagcagttaagagcactgactgctcttctgaaggtcctgagttcaattcccagcaaccacatggtgactcataaccatctgtaatgggatctgatgccctcttctggtgtgtctgaagacagctacaaacaaacaaacaaacaaacaaacaaacaaatatttttaaaaaaagaagacaggagaagaggagatgctgcaaatgtctgctctccataagaattaactgtggtggccaagaagaccataaatctgaaatctaatctgagtggtaccttgtgtcccagaacagtcacaaccatgtgtggacttggccattagccttcaaagcaacaggtatcatataccttctataaggtagaacatatatcttaagcatgaggacactaagatagtcattttctgttatctgtacacttctttaaagaataacattcctctcagctggctgtgcacacctttaaccccagcactcagacgccagagacaggcagatctctgtgaattccaggccagtctgatctattaaagttccaggnnnnnnnnnnnnnnnnnnnnnnnnnnnnnnnnnnnnnnnnnnnnnnnnnnnnnnnnnnnnnnnnnnnnnncaatgatacttctagtgtgttcttggtactaagcagtggtagaaaaagttataccccatcttgttattttggcaataaatagaatcaaaagcaactttcagcagaaacgtatttcttaaggacggttcattattggatccaaggtacagattatctgaattttgttgcatgcattcacaggcaaaaagctgtctgacctggaacgagttacctctctgaaagtatataattggtttgctaatcgacggaaggagatcaagagaagagccaatatcggtaatgtatcagagagactgctttctctcctgagaaggttagaagtgcactaagagtggccggttaggagctgcaagtctgaatgatcgcaacccttaggcctaacaacagataccatcgcttctcatggttgcatttttaatagcacagtcgtgctatctacactattttatttatattttaagaatgacttttttattatttataaagactgttcttcttaatattctagaatgtagaattaacccctaaacagtgggttacttgtgtggctcatattaaagatttctgtgtggtcttaagagaagaattgtgaatctcccagcctgctggttactggtacaacctagacctccacactgagaaacatccaatcagtagctggaatggaaaagattcagcgaacgagaagcatggaaaaagcagcaataaagggcatttcctgaatgtgccatgggtttagtcattcccagtgtgtggttattgctatacactgtggtatagaccataaacaaatagttgcattggcaatgataacgtagtaagtaaagctagaggacggaagtcaatgtgaaagtgccttagggaaaatatgtgttcaactaacaaagaagaaaatcctattcaaaactgtaggaaaagcatgagatcagaatggatgggctcggagtagaagtttcctttaagcttctgcaggtgtatttcggggctgggatagcacggtgagaggaaggacctggttgtgatgtccagcaccacgagaagtatgactgcatttcatttgtgaatatacttcttacttgcccttccaattctcagatgctttgcactaccccaccagctattaacatagtaagtttatgaagtacccagcagtccggttggtactttaaccaggttggtagtgtaatgtgcatagtagctggacctctaccctaagctacagagttgaatttctcccatttaaagatgactagagacttaattgtgttctgatttcctcaccataaaaatcatggtgcagccattatagcaaggcagcagataatttagggatctatttgcttttttcgaagaagcagcaatcctggagagtcatgggatagatgtacagagtccaggaggccattccaacagtgacgatgtggacgggaacgactactccgagcaggtgggcggctgggctgtggctttccggttggggggtggaggggcagtggcaactcaagtctacgggtggttgtatggggaggttgggggagcagcccggtgtccctccactctgctcatgtgtctagttagattttcatgcggttggaaaggaatatggtaagattctgttgtcctgttaaatctgtgagtaatctctatccacccctatgggtttattgtcacacaacaggacacttggcaagcacgcaatggggaggaggaggagggaagaagttcagagggaggcagagaagcagagaaggtagaagaagagaggaggatctgacccaaacaagcaagttacaacacttaccacacacacagtgtttgagacgcacttaggggcatgcgggcagctgtgccggggcctaccacggaccatgaaggcacaacaaaggccccgcccacctcagccccattacactgggaaccctcttgcccagaggagtggttaaccagattcatcttgtcataatacaatacctgcatgctttctcatctcatcctggtgtgctctgcattgcttggggaaagtgtatttaattgtagccactgcatggaataagtcaaattgggggatttttttccccccaccctcaaacatgttgacagatttcattagaatattgcataggatcaaatttcatttccatttgggaaagtcaaagaacacacgggtcctttccctagactctttcttctggtggttaccttgtcctcagatgccatggtcttcattctcttgcttttcattgcctccatgtatccactactccagcagggcttgtgactctctgcagcttccttcttaaatcccagaggctaatgtctaaaagccagaatgacacagtggcacccatgtgtcccagcaggttatccccccaccccccaagagactcagctgtcccagcacagctccacccttggatcgggaaagtgctagttctctctggaaacactcctgttatttgtcagcaaaccacatagatggatcatttccatctttttttgcagatgccctgagggcagcacatcacatgctttttcccccaagggactttctctttccaaagctctttggtacagagttccctgaagctgtgacaggtgagaaacgtcccttacctgtgatggtcttcagtgcccagcacacctgcgaggacagctgccttcattcctcggttgtctggctttgctgggtttggtttggggcttgcagtcagtctctcttgcctccgcctgggagtgctggggtcataggcatgtgtccctatgcgcagcggcagctttgctgtttactgtgtgtcgcttagggggtgagagcctcacttcactctgagtcaggcactgcacttgcgacttgtgtgactaaggacctgtccctgatctgtaaggtacaagtgcttgttctactattcctcctctgctgttctcagcagggaactccctggatcctaggagccactcagtagctttgtggatttaggcgtgtgctcggttgggttcagtgattactagtgtatctctggcaaacagaaaaatccagactattagcttattttagtcacttcaggtttgatcagcactagcaaattttgatagaataaatactgtgtgataaggaacaaaacaaatcatttaagtcctttttatttgttgagtcacaaaaacatgaaaagtctctggacctgtgtccattcagtgtctacttaaatacagttcacctccaccatgagatgcactcagccattttctccacagattgctctgccccccgcacggcacccccgcatgcctttttgtgagcttgagatggttaccagccgacaaataacgctcctttcttatctccgcacatctaggatgacagcaccagccatagtgaccaccaagatcccatctcgctagctgtggagatggcggccgtcaaccacactatcttggcattggcccggcagggagccaatgaaatcaagacagaggccctggatgatgactgatcagggagttaaacagttaacttagtttagacgtagcaccttagcagactttcctcggtccttaacatgtgttcttacagtataacttacagtttcttgtatgtcaggtagccattagggtcttgttctgtgaagatggcatggtgccctcagcctttgcatatactctctcagtattaaaattccagtaagtaagaagcaaacaaacacacttccctctcccagcccctgaggctaaaaaagaaaaatctcgctgctccgttttagcattccaagaaagtgcttccaggtatttagataaccctcagttctcaaatattaggctctgtgtaaaatcttgggtacctttagattcatgtaacactaggctgtacccccatctgtccctgccctaagactgataggatgcaagctgaggtagtggcacagggccgacagacaccatctgggaagtgtccatggagcggagcacaaggaacactagcgcccgcctcggcgtgagactcactgattcagctgcaataagccgtgcctcctagtcacagtggccaggctctacttctttgggtgctgtgttaagaatgtcattggaatcccaagctcagatcttggttaatgctaacatgcccaacacagacatccttctctcttacgagctgtgtgacctagtagataatatactgccttctgcctttgggaccacgattctaaaacaaaaaggacaaaaaccaagttctgaaaagcaaagcccagcttgagagcgagagcagtagggaaaagcgagagctgaatgtcggatggatgctgagcccagttctcagagccgctatacattccacagcgcgatgccagcgcctgcccgggaaagtgttggaattaccttggaagttgcttggccttctgtcggtgccccctccctgctaccaaaaaggatagagctgaggtcctgagtgagtgaaagagcaggcttggtgcccgtcacctgaagcccacccagagtcattaggactcttgctggggactgtggcaacttgactgtcacacatggaggtccttgcctagctaggggcagaaaaagcaggggacatttaccacctacagcaggatgtctttgctgtcttctctttatctgtccttgtggaggtgtgaaagctatattgctacaggcaatttatttaataattggaagccatattgataatggatgtggtgatatttgtagtttaatctactttaagtggcagtaactaatggaatttttttccttgatcatatatgtagcacttttgttactttttaaagatatttatatttgataaatctttttttcattttgagaactcaaaataccaaacagtgaacttgcgttatagagtcaccctgtggtcaccttgtcatctagtagcaaaatgatgaactattcatgcatcaaagaaaattacatctgctggccttgtgtgaaaatgatctcctggagccctgattaaatagcacactgtcactgtgggtaagaagaaccagccttcagtgaattggtgcagtgtgtgctgagaggctgagcgttccctgcctcctcccattttccctctgttgcgtctgaagaagccttgcgtagagggcggtgtggggtgagcctgcgagcgggcttccatctttttgtccatgcctgacccaatctctaagatagaaagtagatgccatctcctcacccctgcttcctcaccaagtgtgtccgaccctcctcgcttcccctgtgcgctgaccagatactcgatatccgcagggcttagctggtcttgctgaggcactgaccagatactcgatatccgcagggcttagctggtcttgctgaggcacacgctgtctggactaccccttaggtataagtcttggttacaggggtgtgaggaatcacctcatctttgaggagctgaggatgctaccccaccttcgtctgtgaccttgaaggacactaggtagggcttggccctgttcctatcagtagatttcagggggaaatgtatgcattttttcccagctctgagacgtgaagtaaaatggagccatcttctcttactgtattacttgaaccacaaatttaagagtagcatttcttattctcaggaacgagtcccccgcacctacttagaatctcgcatggtttctttgattcgtttgtctgtctgtttcacttaagagattgcattacctttctttctctccttccttttgtttacttagaaggaatattcctattatgtctatccattttggttgagttttgtctgcttattctcagttgaatcagaaagaacaggaggggggggggaacgtatttttctgacaagccacatccatgatttatcatgagattatgatgattgacagcttctttagggtgcggctgctcctgtctctcttgttctctcttgccgtcttaaaggaacaggctccagctgttaagacagctccagtctctaagggaactctgactacagccgaagagcagagtgttctgtcatcctagggccttttagagaaagcagtgcaacaggataccaagccctggctggtacaggcagtgccagccctgtgtggcagtgtggtggtactggaaaagtacaggtaccatggaggctggctctgtgctgagctagctagaaagtctgtcacatgcccacagactcacagccttacagggaacctgcgctgtctcacctacagcaggagtttgcttctttgggatcaaggttcaaaaactaccatcagtcggttttccctggggtcaccaggtttgattctacttttgagtcctgttccctcaactcttggaatggccacagaacatccgcagtcagactcatccatcctttgtgcttcttgctcaccctgtctgctctcatctccttctgtatttcttgtggtcccggagctcttttagattgtatcttctcgaccagtgactactggaagcaggagaggaggggagcaggcgctcatacatggactgtggtgatgtttatttaagaattactgttgctggataggaaggaaggggagcaggcatttgtagactgtgtgatggtgtttatttaagaattactgttgctggataagaagagaggggagcaggtgttcatagaatgtgctgtgacgtttatttaagaattactgttgctggataggaaggtaatttcccaccttctggttccttacatggcgggcggcctgttaacaaaggaccatcttaagatattcctgcctacctgagacagtcgccaggaagggcagtgcattgctctcctgtgtgactatccagggccctcagacccaggagacagtcattcacagcaggcatgtttatgtttgtgttgaacgccccatagggcaggttacaggaggagaaaacctgggctgggaaggcagacagcccgtgttcctttcgctccagctcactaggtgaccttagaaagacgagggcattggaagcctgctccagagctctggttcctaggatgtttgtcactctcagccacacccattatttttggatcagacatctgggaatgtttttactttatgggaacggcacatggaaagctgatatagtggtctgcgttctctctggctttaggaactcttgctttaaactccttggagatgagtcgtcaggcacaggctacagcagatgctgttccggtgggatgctccagcactctgtccatccacatggcttctcttccttccattctgtgtctcagcactgcatctttgtctcgagctgacatcactggacattttctctcctctgagcaccggcttagtgggtagtgttagtccactctgaatacggaccctcgaggttccatctaccaagcctgttacctttatctacacagtgaaaagcatcccgtcccatggtggcttctctcttctgtgttccctccaagtcctctctccctggtctcaagaaggtcgtggttagatgcagcactccatctaaccagctctgctctggccctgagctttcttcctcttctgctcagagaacagcctgcattttcctctatgagcctcaccaagttcttaggcaataacttcttaggtggtggcctcctgctcagcggttctctgctcctgcatgagcatccgtctctccacctctgtaacgtcatcctcttgctatgattattagctatgttttactactgtatttattgacgctgtactgagactagccgattccacgtacagcgttactgagccgaatttatttttgtaagatttcccaagtgaaggttgggcacatggaccggttctgctgtgtgtgtgagtggagctgggtggggataaactggggcaggggcatgtgctgtgttacattgcagatgtgtttactcaggattgggccaccagttgtcagccatactggatttaacaaactgcactgctgctgtgaacaccctttccgtttgtctcctttttcgtttgttacactgtaacagtgagcacggagcaacaggggaaggcttgcagggaggcagccacacatggccatagctttcttaggctttcatggtagcatgtagtcagaacaggtgctgtgtcctacatagagaccttcattacactcctccatttcaaagatggcccatcacttaagaagagtgactttcttgctgcactagggaactgacatacgaaggccatagggaaggctttcaggcccaggcccgtcacatcatcaagccagtgttctggttgcaaaagcgcgtctcttatagcataccttctaaaagatttttctcagtgccatttgtttctaaacttaaggggagacactacttcttatggcagcatacaggactgacgtgcttaagacgaagctttatgcatattgatggactggtagaagctgaagtttggacattgagaggtgtctgtagacacttcattacaccatgtgtgtggagggggaagtaatggagagaaaaaagtcagcagcccaagccacccaaacccttacaacactagtcttcctccttaaccaagagaggacaagactgacagaaggctgaaagaaggttcagcttgcccacctagcggttgccttgggatccccgatatatatgtccccaaactgctttatcattcttggcgcccaggcagaactaaagctcactcactgctcctactccgatgaggtgtgagagtggctgccttccactgctggggcttccctcttgtctttgctagggagcaggggaactacgctgccatcctgggcttacagaccctctctgcggccagtcttcaagctgtatagctccagcactgttgttggggagtttgatgccccacttagaacgcccaggaggccagctcccctgactgcatgtccgtcgtttctctctttaaataagactggctccatacagccataattaactcacaaattcacgatggtgtgctgtgatcaaatgaaggtttggcagaatctttcttcaaattgtagccatggtaattgaggggggtggcatagaatgaatatataaaagtataatggcaattgttccgaatgactgagtgtcctcctgacatgtaattagctgttttagcagggtgtagattggcatggtcataattaagaggatttctgtcctttatgtgattgagaatagcagagcccatcctcgttccctttgagcactaatgctcctgagaacatttggaacaacagctcagtaaaccaaaataatgatatgggattcatctcccacccgagtgagagagcactgggaagcatttcgggtccagaatggaaggctttgcttattgctggatctgacttccaaattctcttaaacctcttgtgtccagtttcatcttattctactttgaccagaaactagtcaatatctcaaactgaggcagcctctggcagagcctcctgacccccatcctttcctggggacacttgctgcttaactgggctacctgggattttcagacttctccttggtaacttgattatttccactgccgtgaccatcagacagtatttgccacacggaagtctgcagttgagtagggttttcctcgtgggacatgacgagatcaggcacacatcgacctcctacaggaatgcgtggacttgggctccagggtgtgcaccccagcttgctcacatctaccatgttcagccatcacaagtccctagagctattctgctgtcaggatgggttcctggttcttctgaagtcatgtactctgtcccccacttcatttttctttatgcatctgtgccttcaggcaggtgtcatataatcttcacagcctgtagagtcctcctaactaggagctgcagaactcactagccactctccagcggatgcttagtttggactttttcttttttttctagtcatcctttgcaggagccttgattcaattagagcgtcagaagggtccaccgggatgccagcagctaccagtgctaagtggccttttataagttcttctgcccatgaggctcaagactcaggtgaggttaacttgagttcaagagccctgtctttttcaggctggacactgtgggattagttagtagccaaaagtgtgtgtgtgtgtgtctgtgtgtgtgtctgtgtgtgtgtcttcactctttctatagaaggtgtccctcctcacccagaacactaaccaaccaagatgctggttccagctcagttgtgtggaaaggctgaggttgagtatacgcctagagaggtctagagagccctcttcctcagcacacagacacatatggagaggtaaggaagagtttctgttcctggggatgcttcagtttgattcctcccagatacctacagtgaaatgtacagcagatgcctgtgtcaggaaggtggcctgggaggatggccattactgctgcctctgtaagttaccttgtggcccctccccatgcccgcaggtcagaggtgtggtccttgggacttgtcagccttgatgtggatgaccggacttacagcgcttcttacttttccagctgctgagcaactgctatgtccattagaggtcagggccgccttctgatcccgttctgaaaagtcactggtggagctaattttgtgacttgtgtgacatgtactgcacatcagcagcatgttatggtcacctgtgagcactcacaggaatggaattggcgtgtagccataagttcccaagcttatctgctccagtgctcaagggggccactctgattaaacacaccctgcataccacagataccccacctcaaaacacaaaactagccctcaagtcaaggacagtgtaggtggtacttgcctgggaatagctttgttccctccctccctccctccctccctccttccctccctcccagaaaaaccccagaagtgattgttgtaagaatctagatgctggtatctgagaatgtgtagtcttactctgctgaggtcactgccaacccacttgctgttctcaggcacacagggtcactcctgtgccacagccacttccattcttgtctctgcagctgcatcctcagacagcacatcactgtggggtgttgctctccagccctcaccacctgccctgcagtggcttccccaaagcctgctcttttcagttcttccggtgcttagctccagggactttgaggcaccctgcttgagttccagggggtttgtgttgaatccgcctacgaaccctgctgtccctctaccatagacaggaaggagagcactgtggagctcaaggctctggctctctggtgttacgtgactctgccatggcttcctttgctccttatcgacactgacaggcccttaagtagatgtttcttcaaatttacacgtagaataaaagtttttaatatccagagtccaagaatggagcaagctgcctcagagttaatgtggccatttaatgactactggtcagtgacaccagactagggacatcttccaaatgacctgctacactccttcatccagccccacacacacacaccacacacacacacacacacacacacacacacacacacacaccatcatcatcatcaccatcatttctagttccttttcttacaaaattaggttctctgagagttggccaggtcactgtccccttttgatctgtcacatcatgggtagcctaaagcccaagagaagtaagcgcacctgaggaggaaggctgaaggactgggcagcctggcttgtggggctgctgatgctgtgtgacactggctgaccaacgaggccttaacaatggcttcattttgccccaaacgccttggtttgaagaaaaaaagagtatgggtgcctttcattttggtataatcaagattttgcatctttgttggtagccaaaggtgccatggaaattgagtgatgaaatcagtgcctgtcacctcccagggctcaagacagaccggtcccagggacttgtgtgaaggtttgttgctcctgcgaggactttgcttcccggcacctccaggttgaatctctccagtcttgtttgtagcatccttagcctagaaacccctcccattttgctttactggaattaagagcccagcctaaacctgtgaggccatctgtccactccaaggctctccgaggccattagactagaaaaccaaatggcattagagctgtatgaatgcaaacagcagccactccctgatgtttcctgggccccatctgcaggcttgaggggtgggtgtgtgtgtgtgtgtgtgtgtgtgtgtgtgtgtgtgtgtgtgcgcgtcatgtgtgctgagtggaggtgagcacttgtggctgctttcagaaagcatccccttatcatttgccttgatgcctacattgactctactgaaagcagtggggatctcatcactcatctctgaaaatgggcaccagaaaaacaaaaccaaagttctcagggtgggtagagctctttctttccaagcactggccattctggcaagctttctcctttatgctctttggttctaccacagttccactctgaaagctctcttctttcttagtggttcctcacaatgaccctaaacagtgtgtcagggcagtctgtacctcactaggtgcagatcagggaccacggatgccaaactggctcctgagccaccacataagttcactggctgcaaggtgccaacactgtggcagttgtctgccctggaagagcctacagccttctccaatctccccatgggctcagcctctcctccatggccatggttaggttgggtctgcagtactttctagagcaaacttctcatttatgtttaagtgcctaagcaagttatagacctctgggacctgcctgagagtcggcctgtgccctgtccttcccaccatgcacctcgcctcaggacaggtgtgatgcacatccctgctccccaacccagtgtccctgccattctgcaggcagagtggtcaccagggcaggcaaggggagagggctggctttgtcactgtttcctttgttccttctgttgatgtgactatgaccttgggtcagaggaagttttaaggaatctacttagctagggctcggtggctactgagtgaagaacaggagtgagtcgcctctgagcagagttctaagagagccagcaggcagggatcatgactgaaaaacctgtgcgtactggagccctgaccgcatccacagcccagatgacgaggagccggaggccatcagcagtagagtcgtagtaagatccaatgtgcattctttaaaatgagtgagagactgtttcttttgaggaataattaaagtgtgagctagatctgggccttttatttgcatgaggtatagaacaggtcatggactgctgtgctcagttggtacaacagtgacaagtagaaaggaacaatctattacgcaggcaccttattttcattgatccaggatttttgttcagacagtggagtaatgcaaacactgggtgcttgcatgtaacaggtgcagatgaccctgcctcacctagagaggggaacacagtagggtgaatggccaagtagtggcaaaagggaggcagtggcacatgcaaaacccatgctgcccctgaggaatgtgtcaccctctagatgcagtgtccatggtctacctaccaagcacctctccggcccggtgtaattgaggaatgtcaaccggatgcaaattgagggacgacagctttgagtcagagcatcgggga

SEQ ID NO: 1268 - DNA, 1381 bp, Mus musculus
tttgctggaaaccatgtctcactacacagatgaacccagatttaccatagaacagatagacctgctccagcgtcttcggcgtaccgggatgaccaaacatgaaatccttcatgcattagaaactttggaccgtcttgatcaagagcatagtgataaatttggaaggaggtccagctacgggggaagctcatatgggaacagtaccaacaacgttccagcatcttcctctacagccacagcttccacgcagacccagcactcgggaatgtccccatcacccagcaacagttacgatacctccccactgccttgcactaccaatcaaaatgggagggagaacaatgatcgattgtccacatccaatgggaagatgtcaccatctcgctaccatgcaaacagcatgggtcagaggtcatatagctttgaggcctcagaagaggacctagatgtagatgataaagtggaggaattaatgaggagggacagcagtgtgataaaagaggaaatcaaagcctttcttgccaatcggaggatttcccaagcagttgttgcacaggtaacaggaatcagtcagagtcgaatctctcactggctgctgcagcagggatcagatctgagtgagcagaagaaaagggcgttctaccgatggtatcaacttgagaagacaaaccctggggctacgctaagtatgagacctgcccccattccaatagaggaccctgaatggagacaaacacctcccccagtctccgccacacctggaaccttccggcttcgacgagggagtagatttacctggagaaaggagtgcctagctgtcatggaaagttacttcaatgagaaccagtacccagatgaagcaaagagagaagaaattgccaatgcttgcaatgcagtcatacagaagccagaagcagcaatcctggagagtcatgggatagatgtacagagtccaggaggccattccaacagtgacgatgtggacgggaacgactactccgagcaggatgacagcaccagccatagtgaccaccaagatcccatctcgctagctgtggagatggcggccgtcaaccacactatcttggcattggcccggcagggagccaatgaaatcaagacagaggccctggatgatgactgatcagggagttaaacagttaacttagtttagacgtagcaccttagcagactttcctcggtccttaacatgtgttcttacagtataacttacagtttcttgtatgtcaggtagccattagggtcttgttctgtgaagatggcatggtgccctcagcctttgcatatactctctcagtattaaaattccagtaagtaagaagcaaacaaacacacttccctctcccagcccctgaggcta

SEQ ID NO: 1269 - protein, 380 aa, Mus musculus
LLETMSHYTDEPRFTIEQIDLLQRLRRTGMTKHEILHALETLDRLDQEHSDKFGRRSSYGGSSYGNSTNNVPASSSTATASTQTQHSGMSPSPSNSYDTSPLPCTTNQNGRENNDRLSTSNGKMSPSRYHANSMGQRSYSFEASEEDLDVDDKVEELMRRDSSVIKEEIKAFLANRRISQAVVAQVTGISQSRISHWLLQQGSDLSEQKKRAFYRWYQLEKTNPGATLSMRPAPIPIEDPEWRQTPPPVSATPGTFRLRRGSRFTWRKECLAVMESYFNENQYPDEAKREEIANACNAVIQKPEAAILESHGIDVQSPGGHSNSDDVDGNDYSEQDDSTSHSDHQDPISLAVEMAAVNHTILALARQGANEIKTEALDDD

SEQ ID NO: 1270 - DNA, 101505 bp, Homo sapiens
  misc_feature (1)...(101505): n = A,T,C or G
taagtactattttttcttttgacttttaaaaatgagccaccgtgcctggcctggatttttgttatgaagaacaatcctcttttttgtcacagtgtattgttatgttggtcataatttcttttgtggtttcttctttgatccaagggttatttatgattatcttgtagtttataagtagttatttttgtacatttttccctagattgtttggattatatatatgaaattaaaccttttgttttaccgtgtttgtgatcaattatggtaatggacatagggaaaaaaaaacttctttgttagaaggtttacaaagtatctttttatctttaaaattatgtttattgataatatatcaaatttctgttttttaaattttctccaactatatttgttcattctaaaaggtatactgaaataactcatgtttatactttaaaaaaaaattattaaagtagttatgatttttgctttattacctctcatgttatttggtctttgtgtttgtaactcttatatcttggtcataaactgtatattttataattgtatacttattctctttttcttttttttttctttttttttttttttttttttttttttttttttttttttggagacggagtcttgctctgtcgccaggctggagtgcagtggtgtgatcttggctcactgcaacctctgcctcccggattcaagcgattctcctgcctcagactcctgagcagctgggactacaggtgcatgccaccacgcccaactaatttttgtgtttttggtagagacggggtttcaccatgttggccaggatggtctcgatctcttgacctcatgatctgtctgccttggcctcccaaagtgctgggattacaggcatgagccaccaggcccagcctctctttttcttttataggttgcttgttttctatggccaggtgcttgaatgtgatccagcatccataaatttatatccctaatgccttttaatataaagtttttattataatgttctacttttttattgtgttgaaatatgcataacataaaatctaccattttaacgtatatagttcagtggcattaaatacatacagtatacagcagtcaccaccatccatttccagaacattttcatcctcacagattgaaactctgtacccttaaataataacttctcattattccttgcccattttacccaccatgctactttctgtctctgtgaatttgactactctaggtacctcatgtaaatggaatcatataatatttgaccttttgtgattgggttgtttcgcttagcatcatgtcttcaagtttcattcatgtttttgtgtcagagtttccttccttttaaaggctgggacaatattctgtttgtatatatatcacatttcatttatccatttatctgccagtggacatttgggttattcccacatttggcttttgtgaataatgctgctgtgaacacagcctgattccacttcttttggatagatatccaaaagtggaatcgctggatcatatggtaattctgtatttagttttttgaggaactgccatactgttttccatagtggcttcaccattttgcatttcagccagcaatatacaaggattccattttctccacattattgccacacttgttattttatgtttatttttataaataataggcattcgaatgggtgtcattttattttgtttttttttttttcttttttcttttttttttttttgagacagggactcatcatgttgcccaaactagccttgaacgtgttgcccaaactagccttgaactcctggcctcaagtaatcctcctgcctcaacctcctaagtagctgggattacaggtgtgagccattgcactcagtgtggatgtgatcttaatacccatttttatttagttcctgatctgtttttaaaataacttgaaaacatctgtcaattagaaaaaaataatctgtctcctctgccagaagagctttatgaaattgagagaattcataacatcttgtttgcttggtcttctgtttttagaacattcctttttttgtagaatattttaagcccatttatgtctgaaatataactgacataattcagtgtcttatggttacataaatttgtatcagtgacttaatctgttttcctgtctgtgaaatgagggtctttgatgataacttcctagcatggaagttgtcaaaggatcccctctagaaggggagcctgaccttttttctgtattcatggtgcatgctacatgctaaacatgctacatgtaaacgtgctgcatggttctcatgattacagaataaaggtcaggatccccttctagatcatctactcctcacacatactgtgttaaaggccagcaacacaagcctactaattccctaaataaatctcataatttcttttcactgttccctcttcctggaatctttcctccactgattctcacctccctctacaccttgatgttgtggaagtcttattctaatcctcaaataacagccagatttcactctaagaaatcttcctagttctctctaacctgaattagtttctggattgttactcatataaacgttgtatttttggtctttttttttgtattatattttttatttgagaggggtgtgtctataatttttgtccctagtctctattctccccacctcccgccatttaatgaactcctaagctcctctactgttgggaccatatcttactcatatttagttcttgtgtctatgccagggcaagcaggtgcctcatatattttaactgaatttgagcaggtagtgaaaaatgtgtttgtggcccaggctagagtgtgatggtgcgatctcggttcactgcaaccgccgcctcccaggttcaagtgattcttctgcctcagtttcccaagtagctgggattacaggcatgtgccaccacccccggctaattttgtatttttagtacagttggggtttcgccatgttggtcaggctggtctcgaactcctgacttcaggtgatccacccgcctcagcctcctaaagtgctgggattacaggcatgagccaccacgcctggcctgtttttaagtcaacaagaaaattatctacaacaggaacttcattagtgctacagtttagaatatacaaatatgaaaggtttctaactttaccttgtacattttgcatatatcattagtcattgttggacactttggccatgcttaatataattcagtactgaatatgtatttcaatgtgagagtttttgacatcaacatttttaacttttgtctaatttataatcttagagttaatggaaatcagtgcctctataactatggttttaaccagctaataagttgtcttcatgatctttagcttctaaacaatgaatagtagataccattttttgttaagatctgtgtctgaattgaaagggatcaaagtgtatggtgaataaagcagtagaatgcaaatcagaagatataatatttaacatgattagctagtgttaactcttgctgtccatcagttacataattaaaatttttattcagcacttgattaacataaatgtttctcaattttctatctttgttctacagaatggtagataacgcagatcatctctggaaaggatattgatccgcctcatgtaaagtatgcttagttcctttccagtggtgtaagtatcaagtcctttttgatttttatcttcacaatcattttagtaaagttaagatgtcactatgattatgatccagatttgacaacagacgtttgtagagttgaaaagcttttttagaaaatgaatcaaatgttatacctatttgacattaaggtgaataagtgtcatgatcatgtggtgagaaatgaatttttaaatctatcagccttctcttaccatttctgttttcaactttgaattttaacattaattttaaattgaatataaaattaattattatttttaactgcttaaagcttagaagcatccaagatagatgactaacagttcaagagagctaatattagattccttgtgacaagcagactactggaagcatacatcttcatgttgccttttgtgtaaaaactcctagcaccttaaccattttcctttacctgctgggggcatgatgatgtagttaagcctattagctgatgtgctagcctttctttggagtcaggcagaaaatacaaattgagatagtggtattgtgttgagagtgtttttgtgctaggatatgaactataaccaccagttcatattaaataggcctttgaataaaagtattccgggaatttcagatattagagaagacagagtatctattagctcattaagtgcatctttagagtcgaatgcagagtgcctttagcataagtattttctaaaatttgatggagtctccactttgcttaaattccttccgttttggttgacagttctataatacagtaagtaaacattaagagagattttccttattatttaggcttttcattatagttcccccacccccaccccagtagattctatgatatagtgaaaagtttctggaacagacctagaagatgtgaactgtagcccgactttctgctaagtagctatatccttgggaaggcacttcacctctttgggccttagtttccctccccactttttaaaaaaatttatttgctaatggctattttcaatctatcagccttctctgttaccatttctattttcaactttgaattttgacattaattttaaattgaatataaaattacttattatttttaactgctcaaagcctagaagtttctgagatagatggctaagcattcaggagagttaagacgtctaatggctattgaaaatagtaagatgtctaatagttactgaaatgaatgtaagcatcatgaagccatgaatttttgcctgatttgttccttgttgtgtcctctgtgccttgcacaggatctgttacatagtaggcattcaataaatgttacttaaatgaatgatttttgtctaagtgatctccagttttctcattccacacctaacttatatctccctttataaatgtgcatgtttgtacttggatttttgtcacatatggtagaaataagatgatcaaagtatgatttcatgaatcacagtgtttattgccatacaaagagaattttttcttgggttcacagtacttaaagatggggagagtaacatagacagacttcacagggaatacactcaatagatgaggtacattaaccacattatgaatgtgttccaaagctattaaagtgtctttgctcaattatgatgaaaggaggtctctgtgttcaagtgaaggctaaaggtggaggtgtacctttacatgagcagttcttgggagaggctggcttgaccaccatagctgagatctgagaccacaaggaaggcccctcagtgctagaaaatgctggcctgcaaggtataaaagctttgaggcctgttgcagcctgagctctctggttttggagaagctgctgacagagagtagccctgccacagcctaagctcccaaagtgtctgttaagctcttgagtgtatatgtattttgaagtccagtagttgtgacagtaactcacatatgcagtttgacatgaggtgacattcctgagaggatggagagttctctctctgataaaaatattgtgattgaccctagagtgtgttaaattagcatgcagtaaatatcatgtatgcaaaacaaaactaacctattttgcctagtcattctagataataaaaataaagacagcagaattgagctgaagaaaaagctgttatccaataaaattttactgttggtgctttacaagtaagatagtaatgtcctttttacctctgtgatttcaagattaattatttgtgaatgctttaatcttctttgctctacatgtttgtagaatttagcttatgaaagtatattctagacctcatgccttatccaagaagggtttaggtacatattcaagtcaggataaaatgtattgtgaaaagttattattatggtcttatggtatgatattttcttagaatatcagtttatgaactgagccataattcctgaatttaattgttcttttatgccttaaacactgtctgttattacagtggtgaaattcttctcacatcattttcaattattgttggcctgagtctgcattcagattagtaatttaaagtgaaagatgttccttatcctctgaacaatccttgtgcataagaaaattaattcaattcttacatgttatctttttctgttataaaagaattgctggtatcatggacttagatgacctttgtaggtcatttactgccataaattcgtgattatatgcttaaactaggtaaattatgagaaataaaattgtgaaatgccggagtatatgcctttgtttatattaatacacattggaacattattctcaatatccaggagagcttctagactcagcgttttctcagtaaaatattgtatcttcagtgtcacatgcatgctttgatcctgtttgttatgctcttaatcactttgctttgtagtgatcatatgaatgatcattctagcaattgtggatcattttgctttaggttatatttgcattaggaaactctcagtgcagggcacagacatctaatttgaacaaggtgatacataaagggaaatgtattctctgatgaaacaaaacagcaagaagagcagggatatatcaggggcttagggattattggaacaagggatgtgagtgctgcagagctttctccatcgctctgttccacgtttcttggtatgtctgcttcttcctcccatgaactagctgcttccatataatgaggaatttaccagactaatatcttcctgcaactgaacacagttatggtgactgttcatctttcccctcgtctgactagaaaattatggggagagcaaggtttggctttcttctgtgctcaccccactggccagaaggtggggtattacgagtgatagcccaagaacatgtgcttggaaagaatgaggtgttctaagcagacaaagtaaataggtggcctattgtttctccttttatgacttggaataaaagtggttctaatagtcaatgaatctgaaatgacacaaaatattagattgtttcatatgctgtgaaatctttagttttgacaattctaattcaagtgttaggatggatacttttcagtaataagtgaaattcatacaatttacttttgctttatgctaatacagagtgctgctccatacaaggaatggtttgaagaactgtatatagataactaactgctctgatatgaatactataggaaaatactatgattggggatttttgtccatataataaaacagttattgaagtcatctaaagtaagatcactttatgaaatactttgataacatgaagactgaaaatagcaacaaacaggtctacttcattttcaagggaaaataataatgtttatgtttaatttttttcattacaaaatattgtgggggaacttaggccatcaagaaagaatataataatcatgaaaataggtctttttaaaatcatggctaacttgttacaagtgagtattggaagaaatcagaccctaacatttgtaggtgtagagcagatactgtggcccatgggcacaaatggcctgcaacatgtttaggtccacagaatgtgtgtgtttggttttgttttattttaatgagcttgttttaaaaaccaggaagatttcatctacagttctagatttttccctacttatttttaaaaggatttgaaagataaaacaatcagtgaaatggaatagactatccaaaggtaatgcagattcatatggaaattgtgtatatgataaaggcagcatttcacatcggaggagaagacagatattcagtaaaaacatacgacatctagctgtccatttgggatgaaataaagccccaattttttatacttgttaagtcaataaaaattctagatggagcaaggattttaaatgtagaaaactattactaggacccctaggttcatcagtaattagaatagttttatctaaatggctttaaatgagacttaaaggagtagaatagcctgtgtgccaaatcatatgtttccagttaagtcctgcaatgtattgtaaaggagaatgatgtgtgcttttggagtcaataagatctaggcttaaatctttttcctactgtttactcagattttttgtgaagtacaaaactacactgagctttagtttcctcaacaatcaatccatcaacataaaatgaaatgaataaagaacatctaccatggggagttgctgtgagaattggatgagattatgttatgtgaaattcgtacccagttcctgcctagaagtgactgttaataaagttttcatgtagaaggacaaagaaacagtgagaccttcaatagctataggacactggcccagagcagatgtttgtttgagaaagatgaagaaatttcttgacatctgtttccatctgcaaacacttattgagagcctactgcatgccatgcattatatttggcactagaacaataaatatcaaaatagaagagattacaactttaaaaaatcttgaatggaaaactcaggtcttataagaaaggaattcaaggccgagcatggtggctcacacctgtaatcccagcactttgggaggccgaggcgggcgaatcacctgaggtcaggagtttgagatcagcctggccaacatgttgaaaccccatctctactaaaaatataaaagtagccaggcttggtggcaggtgcctgtaatcccagctactcaggaggttgaggcaggagaatcgcttgcacccaggaggtggaggttgcagtgagccaagactgcgccactgcactccagcctggttgacaagagcaaaactctgtatccaaaacaacaacaacaacaacaacaaagggattcaagcagtgagaatttttatagtatttgactactcccttaatattgttactcaccctaagaaaacattttctgatgtgctgtagtatcttgtgctagttaaaggaaacatgtaaaagtaatttcctaagaaaaatgaatagcattgtttggctacaaccatgaaagatctatttctcagggtagctattaagagagaatgcattaccagagatggaaaacttaggaaattgctaagtagtgaatgaaatggtgcttatttttttttttaatgtacctctgttttccacttaagtatttttgctggttattagcatttgcttggacttagcttagcaaatcatttgttctcactaaatgaggttgtagagaattcctaggtctgtttagctaatatttggtaaataatataatacaaactatttttttcagtaattttccattaatactctaatgtagagtaatacacttgagatgggcaaaacacttctgagttatcacgtagcctgggcttattgcactccatgtacctaatctattgttctggtattatttacataactaaaattttggttctgatatttaccaaaattgaggaaaatgtaaattgtatgccatatgaaattaggttttatgttacacctatgttcacctactaatacatttagtatctgtaccaatccatttgccatggcacaatcattctagcatgggacataccttcattttcaatacagaagcttatgtagaaatattgcatcttctgagcattctgtataatatgtgctttggtagatactgtcaataaagagacttctttttatctctttttttttagtttgctggaaaccatgtctcattatacagatgaacccagatttaccatagagcagatagatctgcttcagcgacttcggcgtactggaatgactaaacatgaaattctccatgccttggaaactttggaccgtcttgatcaagagcatagtgacaagtttggaagaaggtccagctatggaggaagttcatatgggaatagtactaacaatgtcccagcatcttcctctacagctacagcttccacacagacgcagcattcgggaatgtccccgtcacctagcaacagttatgatacttccccacagccttgcactaccaatcaaaatgggagggagaataatgagcgattatctacatccaatggaaagatgtcaccaactcgctaccatgcaaacagcatgggtcagaggtcatacagttttgaagcctcagaagaggacctagatgtagatgataaagtggaagaattaatgaggttagtgactttgcttattcagagtccctaaaaatgtctgtattcttagattgtttttaagtagtatgctgcgtttcagctacttagctataagaactgtaacttcctctagctataagaactgtaacttcctcctcccacctttggagatgaaagaaagaaagttcaagctttatgtttttaatttaaattttctcttctttacttcagccctttctctttgctgcttgacaagccttttccattctgtttatcaaacactaatcttctctatgactctaatagctaatttctgactaacagacacattctaatccttaaaaatctgttgtaagtactttttctgagggataagtttatcttgatcagaatatgtacactcttaatttttctgttcaacattccaatcaagaaaataatttggggtacctattatataggttctaattttagcaatagatgacacacacacacacacacacacacacacacacacacacacacacacacattgtcttttataagtgtaagaacttagagttttaaacactgagaaaagaaatctacttttttttttttttttttttgagacagagtcttgctctgtatgcccaggctggagtgcaatggcgtgatctcggctcaccacaatctctgcctttccaggttcaagcgattctcttgtctcagcctcccgagtagctggggttacaggcatgcaccaccatgctgagctattttgtatttttagtagagatggagtttttccatgttgatcaggctggtctcgaactcctgatctcaggtgatccacccgcctcggcctcccaaagtgctgggattacaggcatgagccactgcacccagccgaaaagaaatctgctttcaacagaagtaattaggaaaggcttcacactggaccctgggacactttgagggtaacagcatgtgttttccattattgtgcctccaggatctggaactttccctagcacatgttaagggcctgatatgtttaatgaatgggtgaccttgacctaaatggtaaagaatagcatttgttttaaaatacaggaaatgtatttaaaattaagggaatagtaaagggtaagaaaggcaaggcatgtcttcagtctgataaaaattactgatgggtaagacaatgtaatatgaataatatattaggagacaaaacaggttttgggagactttgagttccatactagtttatttacttttgttggaattgaggagttttgtaaaaactcctctaggaatagagatgataaaggtattgttttcagtagatttccactacagtagaagggaaagagcctgcagataaattagttacagtagattatgaaagaaactgtaacaggaatttgtcagaaataaaaatagtacctataagtatcattataattcttcctaaagatttttaaacttcaagatggaataatagtgacacataataatattgccacatggaagatatgtccaatagtaccacaatgttgaaatatccttcaaactgtcctgaatttatttttaggtgcaactttattatatgaaattctgtgctaaatcaactattttatctggattccagatacagtataaataaagtataatattaatacctgtaatgaataatttgatacagcagttacagttacaagtcattgttttgtttggtttggttttttgagacggagtcttgctctgtcacccaggatgaagtgcagtggtgcgatctcggctcactgcaacctccgcctcctgggctgaagtgattctcctgctttagcctcctgagtagctgggactgcaggcgtgtgccaccatgcccagctaattttttttttaaagttaaaaatataagagatcagtttgactttgaattctttttcatgtgttaaagtaggtgaccaaagttcaggtgttgcttttgaatttaatgttgttacgattaagagggagaacaatttgggcaaataaaagttacttcgctcattgaaatgtaacaagattagcttttaattattctaagtagagaggatatcaacaatttaaaaaggatgccaacctggttttttcggtgttgttgctgttcatcagttttgataagcttttgacataacagttaattcttaaatgtgtataagactaacaagaagtatgggaaaacttgttagtaaaagtctctagaagattgtctggaataataaaggtctaaaaacttgacttttaactcataggctgacataatgttttaattcaaatatatgctcaaaataaatgaaaacctatttagcagtgactgggatttgtagttaaatcccataattacacccattccagtttcactgtgaaatatatacaggtttatactttgttatcagtatttatgtactaccacttgtcgcataatcaggacactttatctttttccatttctctgcttctttattagaactgctcctttgggttctcctgatcatcttggggtctcagtggcccttctggatctctctggttctctgccattgcaccctcacccactgctgcactcctgctttcctccattgtgtccccctctcacgattctcaggttgtagataataacaatccttggatcagtgggaaagtttattggatcacattgtcacttataatcattaaaaccatgatgtgaggttgatcagagaaactgaaattcacaaaaattaaatactttgcccaagagaacttcaatattaagtggcagagcctaaattatgtctttattatcaatatgtcactggtgtacattccctctccaaataaatttttcatatctgtagattttaataagattttaggaaaggtggttaattaacataagacaaagtatgaattgccttaatgggcttcacatccccctcccccatgatatttgctgcttcaaaacaatcacttaccacatgaatttttatttagtggaatgttagagaaatattttgagcagtggatctttctgagtattctgtgcccttttaggaatatactgcccttgctgatcactagatgctatggtgatatgatagcccgttggaagtggtagtctctggtgggggagcctgggtatctgaatgctttcctgtctccttttctacctgtgtgcttcacctcttgcttgttcacattcctcaactcatacacaagatgtagttttaaaaatcttataattcggtgacttcacgaacttcacccctaaaaaattcgcgatacaaaaagggggttttttttttttttttttttttttttttttgagacagtctcgctctgtcacccaggctggagtacagtggtgcaatcttggctcactgcaaccttcgcctcccgggttaaagcgattctcatgtctcagtctccctcgtagctgggattacagcgtgcaccaccacccccagctaatttttgtatttttagtagagacgggattttaccatgttgaccaggctggtctcaaactcctggcctcaagtgatccgcccaccttggcctcccaaagtgctgggattacaggcatgagccactgcgcccagctcataatggagatttttttgtagaacttcatcaagttgtaattgtacaccttatcgactcattaagaaacaatgaaaaagtaactttcacttttttcatttttgagttagggttgggaaaaaaaggtaaattacgatatgaatttaacagattgttgaatataacattttaggaaggactttaaagccaaaaataaagacctgttttacgttttaatgtttaaaaatgcatctattaatatataaatatatgtgtaggggtatgtgtgtatacatatctgctaatatagcatatagatactaatgtgtgtttcatgtacatattatgaaataatttaaatgaggcttatcagaatttattaataatgccatacattaaggatattattcttaacaacccatgtactaaattttatgatatgttagtattttgtataaaactgaggctttattctaagttgattatctataggctaagtattttacttgcctaagtaggatgtgcatgttctgtagataagacaaaatggtcatgatctccagttactatgttattgatacatatttagtaacttttatttttgagtgattttttaaaatttaaagttatactttgtctccataggtgaaaatgtatgggaataggttttattcaaacatgaaagaaatttgtacatcattgtatttttccaagtgtgaaatagtctgtcctggcaggtgttgcttcatctctgaaagtctgtcagatagatgattacctttaagagatcctaaagaatgtgcagtgtatattaactatgaaaatatggaagatcttaaagcatatcatttttaaaacaggtggtctttattattctttgttctagaaaaggaagcaatgtcatttcgagctactataaataattcttttcctttctgatttggtaagcttaaatctatttaagaataaaaatttaaagctgttttataaattatctagatcaggctttccattttacaaccttttatctccaactacagaactgttccttcattgaacaaattaagctctattatatgcaaaccccataattgaataaggcaccatctttgtgctgaaggactaaggactttacagggtagtaggagagatgagacaagattaggaacaactataatacagaacagcatgtaatatattagcatgcgagtagtagtattgaaatgttaaagttagccattgcaagaagagaccttttttagctttgaagatcagggagaacgtctttgaatagatgacagttaaattgtgtcttagtaaaaggggattcaaccaacaggcataactgatgaattcatccagatattaagaaaggtctgtaagtaacagtgaaagtttagcaagttataaaaataatggcaatggagggtgggaaggaagaatttcatcctggtgtggaaatcacccagatgaatctagcatggcaatgacttgaaaaagggagtaggaggcaatgacatggacttgaactggttagttgcaaatcaggtgggtatcttatcttgaagtaagtaagctgtggaatcaaagacaagatcagcccgctcttcactttaattccctaagatttgaggcatagaaatcttgaagagtgtgagattttgtaagagaagagaggaaggaggggatttattctttttaaggaggatgtaaaattgcagatgaagagaggaagtgaggggtgggagaagatgagagaattagatttagagtaaatgaagttttcacactaccaaagtggtgatttcatagattacaatgaggacaataggagtagcaggtccttaaagaaggctgaatgaggagagaatgagggtcgggggtgatgtcaaagtttgaacaacaaagctaacccactagaatggaacttttaaaaatacttaagagaattggacacaatgaaaatagaatgcatttagtattttgaaaatacctagtgaaaccaactaaatgacacatcactgcttgcctatagaactcttttaatgctaccttaaagtacctggtacagatgtttactttggtcttatatgattacagcagatcgtttgtttcttcctttcttgggaacctttctgaagtttcataaaataatagtcaatgtttagtatttttacaatttaaaaaaaaattttgcaatgaatttttgattctatgtattacagacatatatatacaaacaatatttaatttcattgctaggagacaaattttaaaagccttgtgaagggagtattgatgatttttgttgttgttgttgttgttagatggagtctcactctgttgcccagtggcgcaatcttggctcactgcagcatccgccttctggtttcaagcaattttcctgtctcagcctcccaagtaactgggattacaggagtgagccactgcacctggccagtgcttttattttatcagatgatacagccagggcccagctttgttaaatgacttgccaatgcacaaccttatcttttaagtcttttgttttgctttttgataaagctctctggtaaaacagtgaagagctttttatttcttttcttttcttttttttctttttttttttttttgagatggagtctcactttgtcacccaggttggagtgcagtggcacgttttcggctcactgcaacctccgcctctggggttcaagcgattctcctgcctcagcctcctgagtagctgggattacaggggcatgccaccacacccagctatttttaaaatatttttggtagagacgaggtctcatcatgttggccaggctgaacttgaactcctgacctcaagtgatccgcccgcctcagcctcccaaagtcctgggattacaggcgtgacccaccgtgcctggctatttctatgtttttaaacattattggtacttagagacttgtcaaatatctaaaaatgtgaattgctactgtttgacagatttttgggattccttctgttttgtgcagtccttaataatatcgtgctgcaaggctgtgaataatttacaaactggatatttcctatttcaataattgagtgttatctcttctgtatgatttagtgtccagatgaatttaatttaaaataaatggatttaaatgacaatgtaaattagtagtcaaaaaacccatttaattcttttcccccacaaaagtacattcttttatttaacctgaataaatattctcttaaattcagcttcattttcgtaggtcattctatatatagaaatgcaatactttatttaaaaagtttcagattaattttatagttatattagaaaccaaatgatttgttttatttatataagccaattgaaatagtgctgaagttatctcttgtacactgattattgatgcatatttgaaagcttttgttctacattacctgcattttagtcagcagttattttgtttgactttaaaatatatttatttgtacctttttctttttcatatacacaatttttaaataaaatgtgaatgcatatttgtcaaagaaatatttcaggccgggcgcggtggctcacgcctgtaatcccagcactttgggagtctgagatgggtggatcacgaggtcaggagatcgagaccatcctggctaacacggtgaaaccccgtgtctactaaaaatacaaaaaaaaaattagccgggcgtaatggcgggcgcctgtagtcccagctactcgggaggctgaggcaggagaatgacgtgaacccgggaggcggagcttgcagtgagccagtatcgcgctactgcactccagcctgggcgactgagcgagactctgtctccaaaaaaaaaaaaaagaaagaaagaaagaaatatttcaaatatagacagtcattttgggaagaatctaaccagaatctagatcagtatgagaaattttactgcattaggcagctgattaattttttcctttaggaatatttttgatcaggatttccaactgatagatcagcagtatactgtagagctacagattggaaactcaccactatgacctctctgtttttttccagaattccccaaagggagcatggtcttacaacagagtcctttcaacagagcatgtaacaactgctcatcagggagctaaaatccctcatccaagttaaatcacaactcattgtttttgaataggatacttcagtttctccaaatagtctacagagagatgtgaacccctagaaagagtttgtgcttctttcacaaaacaattgttaaggttttgtgatcctttgtctcagatcaggggtcagcaaacttcttctctaaaggactagatagtaaaaattttagactttgtggccaagaggcaaatttaaggatataatgaagagacgtaggctgggcgctactgctcacgcctgtattcccagcactttgggaggccaaggcaggaggatcacttgaggttaggagttcgagaccagcccggccaaccaacatggtgaaaccccgactctactaaaaatgcaaaaattagccgggtgtggtgctgcatgcctgtaacctcagctactcaggtggctgaagcaggagaattgcttgcgcccggtaggtggagcttgcagtgagccgagattgcgccactgcactccagcccgagcaacagagtgagactccgtctcaaaaaaaaaaaaaaaaaaaaagaggatgtaatgtagagatatatacaagacagaaaacaaacagccacaaatttttattgacaaaagtcaatacagaataataataattgggtacagtttttaaaaatacaggcctgctagtcagaagaatgaaattgcagggggagggataatattttgcttagtatgtgtttatcgttagcattttctgtcgtcaaattgattgcaaatgtccatctgtgaaaatgatccttagctcataggttgtataaaaataggtggcaggctagaattagcccataggcggtaatttgctgacccctgtgttagataagaagttacctctattctatgttacttttgagcttgaacagaaaccactgctctgtttatgtaatccttttgaaaataaagcattgaaagagagattggtcggttttaagagtttaactataatttttgtttattcttgttctggtggaaaaacagaagtcttgccactcattgtcatttttgtgaatgtctggtcttttgagaatttgttgagtctaagtaaaaatttgtaacaggcattttagtggaggaaaaatgaggtctataatgtattcccatgaacacagaatattatgtagttttaagtattcttatatataatacaaaatgtataaatgcctttttagtactaaaactttatattcaacggatcccactttaaattttttgtttatacaggaaaagaagttaaagagcaagcctttcttcaaatggctaacatttttacggttgtgagaatgatgattgctttttccttaatcattttaaaggtttttaaatgaacattattcatgcagttgtgtagttaacatgcgagcccacaatctgctcacaactgaatttgttgttgttgctctttatttttctaggatttctgtctgtgtaagatatattcattccccagtaatgaaactttgtatataccatatgacagccttgttcctaatgtgaattatacagagcatgtgattaaccatcctctggtatgagacatatctattgtggtcttcactaaagcgtctgtttgatggtgtgatgttttaggacttgaatatttggtgtttcttggttcattgtaatttcatattttcacacaagtttggtctgtttaccctttatttttgtgtcctttctgtgttctccccacctctctgcttcacctttcttttagcaaagatgaggatttctaccttcaacatacattgttggtcttgtcttctgtttttgttaggagggacagcagtgtgataaaagaggaaatcaaagcctttcttgccaatcggaggatttcccaagcagttgttgcacaggtaacaggtaagagctgaagagccctttattctggaatcatgtgtagtctctgccttctggtgcagatgttggaatattgcttgcatttctgcattgcagtgcagatctgtcaacttaggcataattatgtatgcctgtgatttaaaacccattgtctccaatatcgccgaacttctctagtgatttttttgacttgtgctagtaaattttatagcatttttaataagcacaaaattccctattttgtggctagaaaaggttcctatagtttgcttttgattgtgacagagcatatgacacatgcacatccaactgctttctatactacatatttttaaaagctttgtaatcctccaagtataatccctgattataccagttaaaaaatgattcatgagggtaaagaaagttgttttttaaaccacttttccatatgtaaaagcattccttgaaacattactgagaagagtcaccattgtcttctctttgttctttatatcccatcccattctccacccccacctaagccccatccctagtatgtggtgtatatgtgtcattctctattcagattgcattttttaatgacgttcttaaatttgggggcagatgtcttttccttgttaatgtgtgatcttcctttcttagatttcagtgatttataagacccttaaaaaaagtaactgggcattagtcgttagaagaaccggacactcttttcaactacattttgtagttgcaacattgttgtactttgcatattgatagatataaaaattaattctcccctccttttgttaacattctactagctggctatgtgaatttgggctttttagcctctgtgcctcagttttcttcctgctacaatgaaatacttggatctgatcttcaacaataacttatgatttaaagatattatttctgttctccagaccatgatacatactgaagctaatttacctaaaaggttgttactggccattaatttggttaaaaatgaaacaccagagtttagaagtcttatatttcatcccaagtatctaaggtcagccaatcttttatagtgtgtgtgtttaatatattacactagtaatatatttttataaatgacacttctgcttatggtaaaatactttagttaaaggtgtccttcggtgtagaagtcttataccaaaggacagtgcgttagtttaattgttgtagtatttaggtgtttttctgtaggatatttaaaatatgttgttaacctttatcttcaaggaccaagttatggttcttaatgcaatgtaaggacaagtcaagcaggttttagtgaaactcactgatgtggactttgaaaagatgaaatgttgtctttcagtacttacatttcagcctccattactagaagcaatagtatcttccagtttgccagcctaaaactaaaaagacaaaattttagtgttacagaatagcattgcaacgctgatttttttttttcaggtagaagcatttcttagtactttgaattccctgaatcttgaatcatttaggacttttaaaatagtagctttgaaacccatccaatcttaattaatgcaaatcatagtaacatatgtttaaaaagcatttcttgagcatatctaaaggcatggaataaaccataatgggttaaacatgatacattaaatatagtattgccttttttggaaagggaaactgaaagatatgttttcccatcttgctgttcaaaatatagtacatggaacagcattattggcatcacctgggagcttgctagaatcgtaaaaatactgaatactggccgggcgtggtggctcacacctgtaatcccagcactttgggaggccgaggcaggcagatcacgaggtcaggagatcaagaccatcctggctaacacggtgaaactctgtctctactaaaaacacaaaaagccaggcgtggtgcgggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacagagcgagactctgtctcaaaaacaaaaacaaaaaatactgaatactgctctaaatgtgctgaaacataatttacattttaaccagaagcccaggtgatttctgtttgagaaatgctattctaggagactggtaaactttactgactttaacttcagtggattggcattacctcactcagtaatggtcatcatgatgccatcccgtttttatttttgttttgtttttacttttttgtttgtttgtttgtttgagacagtttcttgctctgttcccgaggctggagtgcagtggccagtgatcatggctcattgcagcgtccacctcctaggctcaagtgatcttcctatatcagcctcctgagtagctgggactacagttgtgcaccaccacacccggctaatatttattttttactttttttttttttgagttggagtcttgctctgtcgcccaagctagagtgcaatggtgcgatctcagctcactgcaacctccacctcctgggttcaagcgattctcctgcctcagcctcccaagtacctgggattacaggcacttgccaccacgcccagctaatttttgtgtttgtggtaggcggggtttcaccatatcggccaggctggtgtcgaactcctgagctcaggtgatccacccgcttcggcctcccaaagtgctgcgattacaggcatgagccactgtgcccagcctatcttctactttgtgtagagatgaggtttcaccatgttgctcaggctggtcttgatctcctgggattacaggtgtgagccaccgcacccggctatcatctcctgttttcgcaagcaagaactgaaaatacatttacacatttattatctattgtaccacgtggacctttcttttgctgccatatctatgggatttggtattgttacaaacttctttcaccattttcagcctcaccctaacttgttcttcctcctcttcatttctactccaaaagcttgcattcatcttcctttgatcagatatcttctgatgattctccattgtctaaaaaatgaaatttcttttaatctgactccagccttttcgtttgttgccatcctctattcagtatgcccccagctgaatttcactatttgccattcccagaattctgcccagttggatgctcccagagttttggttgtgccaaagatacctttcacctcctcatctcagccttatgaatttctgtttatcaagattatctctgttgttaccctcattttaacttcttgaccaatttagtccttgcagacctctctttttttctgaaattaattacacttagttcatcaccctgaggtgtagtactcattttaattatgcattttagagcaatgttcttcaggagtgacctttccttacacaaagagtctagcattgtgcaggtactctgaactttccatgtttacctagctaccttgtagtgtaagaggagaacaggtgatgctgacacaagctatacatgtgaaaatttgtccagtgtgactttcttcagtggtgtgccctctccaaaaataataattcatttgctcaacaaatgctgtgtgaatttttgcccttaaggagcttgcatttttcctttatctacttcagttgtttatatcaggcctggggaatgaggatgattgataaccatattggttcattgtcctgttggtcaacttactgaactcctatgttttttgtgtattattgtgttacattttttacccagactgcccagccatcaagctaaactcaggggcaaggcttctctttgcagagaagagatccagctagagaatagtgaggtagtagaactgaataaagccttgtcctcgtaattggtctaacttaggttagagtgagtctgagtatggaagccttctggtcacctagagctcactccctgcagtacctcatcagtgtatatacgcatttttctgtctttaaacaaattagtcaagtgtatcttcaaagaatatgtacctgatgaaatctaccttaaggtttaggatgtggttctcctgaatcttacaacaagttctcttaaaaagatttaagttcaactctaatatatgaaataagtcaaccttgagataaaaatgagaacgagtggtgcataacaaaagaaaatgctaaataaaaagtgtaatgaggtgcaaaattataacacatgtgcttgttccagaaacaaatacagaggtttctttttatagattcagaggatttctattataagataaacaagaagttcatgggtggggtctgtataaataatatcctactgataggaaaaatgacagtataaacaggatataataacagtgcctgctgaattcccagcatgttatttgtagcttctttcacagtcgcagctgttcccaccaagggtggatttttacctctgtaagaggtcagccaagattctaaattctcactaacaatggtgggttggtaagcatagtctttgctttagtaataagcacatgtattctgtattcactttcagggtaaaatgttttcttaggctgtttaagaatgcttaaaacataattttttttaatgacctttgggaaaaaattcaagcatgcagaataaatgagtaaatgggcagagcttgatcagcgcttatcagccaaagaaatatactaattggatgcatgtcctctgaagaaataaatacacagaagaagaaaaaaacagcgcctctgaattttaagaaatttaccataattttgttttcttaaaatgtagtagtataatgaagaagtaacagaatctcaatgttctggtctttctgccataaaatagccttgtgacccagagtcttattttccttatgtataagataaaggactttgactaaataggttctttcttagttccatttgagctggatgctctaacaaaataccatgaactgggtggcttataaacaactgaaatttatttctcacagttctggaggctgggaagtccaggatgaagccagattcagtgtctggtgagagcctgctttctgacttaaagaccatgccatttcattgtgttctcacgtagtggcagggggaacgggtctctcttgggtctcttttattggggcactaattctggttcataaggattcaactcacatcacctaatcacctcccaaagatcccgcctcctaaaaccatcaccttgaaagtaacaatttcaacataggaattttagagggacataaacattcaaccatagcagcttctatgtatcttttctagctgtcaaattctattctgtttttaagttgtaaatgcattttatcagatgtgcatcttacctgtacctagtgattctcattcccaaaacataagaatttgtgtaaagacaagttctgaactggttttagaaatgttccagctgtactcagatcactgcctttttaacttatctttaaaatgtaggataaaaccactgcatattctatttaattatagcaatttctttacaaaggtaaagaattaagttccctaatcagagaacttaagatcagacattaaaaatcaactaaagtttcagtatattaagaaaaaataaacaacaacaaccacttcattttctagagtcgttttaggttcacaactgtcttctatacaccccactctcccactatcaccatccagccccagagtggtacctttgttactgtcaatgaacctacactgacacgtcattgtcacccaaagttcatagtttatattggttttgcacattctttggtttctggacaaatgtttaatgacatgtatccaccattgtagtatcacacagagttgttgcactgcccaaaaacttctctgtgctttgcctgttcatccccttctcccctcaactcctggcaacctttttatggtttccctagttttgcctttccagaatgtcatatagttggagtcatacagtgtggagcttcagattggcttctttcacatagtcatatacagttcacattcctccctctctcttcatggtttgatagctcatttccttttagcactgaattatccattgtctggatgtaccacagtttctctattcacctactggatagcatcttggttgcttccaagttttggcaattatgaataaagctgctataaacaagtggaatttctatctatattagtaaagcaatgctggtagaatatgtcacagactgtggaattgtcctattataatacaaccagaaataattatcttgcttatttaacaagattttatgaattcctacctaatggattttaccagttttatgtggatctccaatttgaaggctatcacctatctacagaatgagtgggcttctacatgaaagatgtaattctctctccaaatggaagaggtttagagtttttgttaggagaaaccttttcaaatcttctttgaatgtacttcattcactcacgttataattgttttcgcagagtgcattttgggattttcttttgttttgcagcctcaggggaataggaacagatgttattccagggttcaaaaaattcttactttttaatctcatttccttctatcttattctttaattttttggaaaactattttcttttaaacataatacatgaagttacttttttttcccctcaggaaaaaaaccagccttcaccacatccaaatgcccatattttcttactttgttgacagctaagtgaggaattggagtggaaataatttcggaggatattttttgttgtttgaaaatcagttctctacagttattgaaattccttgtcctgccagggcttcagtcatctcaaatgcagtgcataggagtctacatttttggtgtaaatactaggaagactcattgtcaggtataaaatggcatctctctttcacctgtatataaagtagaaactgtattttaaaaaatgatatcctaccacaagccctgacaatgacttgtaaaggttaggcacagatgtggtttttccctcattcagtaattatcatttttgtttctctccagttcttgtttcctaagattatggggaaaagcctgtacttagatacaatgtttctttgattgttgtgtgaaatatttcttgcctaatgtaatttaaaaattgttatattaaatatgttaattgttaaatatacaggaataaatgacaaaaagaggaagtgataccccagtaagaaagtcacaaggtatctgtgtgtgataaaatagcaaaacctgagattcagctgtagtctgttagtcttaaagcaatatcataaatatcataaataacttcctgcagaagagagactctgaagagaaaataaatgccattgcttgtaaattctagatatggtcctttatgcagtaaagaattatcctattaactcttaaaagttttactcagagtgagaccttaaatcaaagtgctgcaaatagttttgtcaggaagatgtaacactatatttagtgttactaaatctgcttaagtaaggaactgatgcttgcactaaccaaactacagctgagggccttgatacctgagaggcctataaaattttgaagcaatgtttcaaattcttttggcttagaagaaaacttttaatgtcagactgtgtcaacttcagctaaatttaactatatcatttgattctcacaaaataaacttggagatgtacaggggaaatttgttttttcctttgtttttatcacctttattaagataaaatttacataagagtataggtttctgagttgtaccaaacttatacagtggtataatcattaccaaattcaagatatgaatatttcagtattccaagaagttgtctcatgcatctgtgcagtcaaatattgttctcccacccccagtccctggcaaccattcatctgcattccttcactattgatttgccttttctagaatttcatatcagtggaatcatacaaaacataccttttatgtctccaacttctttcatttagcatgatgcttttaagattcgtgagtgttgttacatgtttcagttatttatgacttttgaatgctaaatactaatccattgaatggatataacaaaattagtttacccattaatcagtagatggacatttggattgtttccagggcctgactattttgaactaagctgctgtgaacatcttgtgtacaagtttttgtgtgggaatatgttttcatttcctttgggtaaatacccaggagtgggattgtggggttgttggtaaatatacgtttaactttttaagaaactgccaaactgttttccagtgtggctccaccattttatcttcccaccagcaaagaatgaggtcttactgctctgcattctctttgggacttggtgtttgtgcttctctgtgagtttagtcattctagtgcagttataatgatctctcactctagttttattttgcatttttctaatgactgattatgttgagcatctttttatatgatcatttgttattcatgtatcttcttgggtgacatgtctgtcaaatcttttgtctattttttttaatcaggttgtttgccttatttattataagagctttttgtttattctgggtacaagtccttaaatataagatatacatatttcctagtctgaggcttgcattttcattttcttaatatctttcaaagagcaaatgttttaaatttttatgaagttatatttatcattttttttcttttgtggttcttgctttttgtgttctaagaaaatttgcttaaacaggaccaagtgcggtggctcacgcctgtaatcccagcactttgggaggccgaggcaggcgaatcacaggaggtcggcagtttgagaccagcctgaccaacatggtgaaaccccatctctactaaaaatacaaaattagccgggcgtggtggtgcttgcctgtaatcccagctgctcgggaggctgaggcaggagaattgcttgaacctgggaggcagaggttggggtgagccgagattgtgccgttgcactccagcctgggcaacaagagtgaaactctgtctcagaaaaaaaaaaaaagaaaattttgcttaaacaaagtctcaaagattttctcatgttttcctctgtaagttttatagttttagctcttacattaggtcaatggaccatttaaaattaatttttgtgttgagataagggttgaggcatttttttttcttatagagatccagttgttggaaaaccatttgttgaaaagtctagcctttccccgtttgattactttgttatctttgtggaaactcagttggacatgcatgcaaggtctgtttctgggctttgtattctgttctgtcagtctttatgtctatccttataccaatacaaactgtagattattataagtcttgaaatcagaaagtgtaattcctcccaatgttgtttttccttttcaagatcactattgactttataggtcttttgtatttttatgtacattttaaaactagcttttcagtttctacaaaaagcacatctgtagtgagattgggattgtgttgaatatatagctcaatctgacattaggaatttacatcttaatcatatcaagtcttagtctatgaacatagtttgatatctctccacttgtttaggtcttttttattttctctcaaccattttagtggttttcagtgtacacgttttgtacacataaaattcctctctaaatattttatatttttgttgctattatattggtattgtttttaatttcagtgcccgcttccttgtttcttgtatcataggtcagttggttttattatattgacctgtgaacttgcttaactcatttatttgttctagtagctttaaaacattttttttgtttaggattttctatacaatcatgttatctgtgaatagagataattttacttcttccttttcaatgtgtcttctttctttcttctttttcccctttattgaactagcactaacagttcaatcttgaatagagtgacaaaagcagacattcttaccttgttcccagtcttagggaggaaacattcagtttttcatcattaagtatgatcttagctgtaagtttttcatagttgccctttaccaggattcctttcaaggaaagcttctatttataatttttaatagtttttatcatgatagatgttgtattttatcaaatgctttttctgcatctgttgagatgaccacctggtttttcttgcttagtcttgttaatatggtaaatcacattgacttatattctgggaaaagtcccactcagttatgatgtattatccattttatattatttaatttggtgatattaagaattgtcacatctgtgttcatgagggacattctgggtttatgttttacttcctgtgttctttctatttttttgttttgttttttgtttgtttgtttttttgttttctttttcagacggtgtcttgctctgtctcccaggctggagtggagtggcgcaatctcggctcactgcaacttctgtcctaggttcaagcgattctcctatctcagcctccagagtagctgggattacaggtgtctgccaccacacctggctaatttttgtatttttagtagaggcagggattcaacatgttggccaggctggtctcgagctcctgacttcaagtgatctgcccacctcggcctcccaaagtgctgggattacaggcgtgagctgctgtgcccggctctttctagtcttacaatgtccttatatagttttgttatcataataacgttggcctcatgagataagttgggaagtggtcctttctcttgtattttctggaagcatttgtgtagaattggtattatttctttcttaaatgtctttgcaaatgtgccttttttttattatagtgattatcttacactgctcataatttactacctggatcttagggcttgtgccctgtactgaagtcagcagaatagaatatagaacagtagagattattaggtccttaatactttaaagattgccagcacttttctacatgattttactcatggcaggaatatttttctcttgccagttgcctaaaataacagatttactaaccacaaaccaaattaaattagctttagatacagcagtagccctttccttatgtccttgtgatgcctgagtaaagaacatagtttttacttgctaagctatgagattttgccgcctgtagtagtttttaaaatattgagtggcctatctccagatctcccaaacagattcatgaacaccatcttgcttttgaacatgtcgattttaaagtacgaggccaatatgatattgccccaagctcatcattgttcttgatgagaaatgtagtccaggattcttagaaactttcttaatgtgatctttcatttaatgttctgtgtcattttaaggactagaatatgctattttcttaagtgtttttttctcccttgacagttttaaacatattgtcttttgcttccaagcccttccattgctgaacagtttttgtaggacagtcttcagctttatcattaagctgaatccctatcaacatctagctgtccaagtgagttatagatggccagtggctctgctttttactagcctgcaccctcttagctaaccttctttttttagggtttgtatttttagctataacttatttaacactatcaggtgttagatgccatgccaactgttttatgtacttgagaagcaggtgttaacttcctcagttacaaatgagaaaacccaggcttaaggggattgactcatttgccaatagtcatgcagttaattgcgtttgttttgccacacagccactgttctttacatagcaatttggtatatagagaaaatatggtgccatggtcaagggcacgactttgaggatggactgtctggcttcaaaaatctgatttccatcccttacttattatgtaactttggccaaattactgaatgtcttaaccctcagtttctcctcttctggaaaatggaaagaataacaacagtacctacctaaacggattcttgagtggattaaatgagttagttttggtaaagtttcaaatggcacatagtaaatgccatagaagtttttctgttattatcgttaaccattataattgcttaattttcagcaggcaatcatttttcattcatgtctctccagattgactttcctaaagctaagtttcctgaggctaaatatgttaaccataagttttatagctttgggccacttgataatgaacttttgaacaataaatttactttttatgttagaaaatttattcatgtggttcaaacttcagaagtacctttggaagagtatacaatgctggctgggcgcggtggctcatgcctgtaatcccagcactctgggaatccgagtggggtggatcacgaggtcaggagttcaagacgagtctggtcaacatagtgaatccccatctctactaaaaatacaaaaaactagccgggtgtagtggtatgtgcctgtaatcccagctactcaggaggctgaggcaggagaatcgtgtgaacctgggaggtggaggttgcagcgagctgagatcctgccattgcactccagcctgggtgacagtgcgagactctgtctcaaaaaaaaaaaaaaaaaaaaaaaaaaggaagaagagtatacaatgctaaatctcctttctgtgttcctcagccatatccccttcccacatgagactaatgttaacagtttcttcagaaattttatgcatttattagcaaataagtatgtctattgtccttttatgccaaatcaacacctagttttttttttaacttggaaatgattccatattggtatataagagtattatcactattttcagaaagaacatagtataccatcttctagatacataaatttcaactattaatagcagttaagtaactattttaaactatttttgcctttattccacacaaaatagacactacttatgtaacaaattaaataagatatattttgataaagatttagatttcaatttgatgataaatatattattctttaagatatacatactcttgtatgagtaggattttttaaagttttgactgtgtaatttatctaggaatttatcctatagaaatatttgcttatgtctagaatgatgacagtacaagaatatttattgcagcatattgtatgataacaaaatgctgtaaataacctacatgtccaccagtaaaggctagctaggtaaattatactatatctatactatggagtactatttgtccattaaagaataaagcagctctgtatgtctccagtggaatgaagaagggggtaggttgtaaggtatggatggaagatgacttatttttgttccttttggattttgtactccatgtataagttctgtattaaaaaaaaattccagcaccaattttaaaaacaaatattatgtcacagactcaacaataatctgtaccggccagattcaattcaggggttaccagtttgttcattgtgctctctgataccaatcagaatcacaacaggattttgttgtttttgtcaacatgaatctaaagtttatctgcaagaaaaaaatacataagaataactaagagattgtttaaaaagaacaggggaaggccaggcatggtggctcacacctgaaatcccagcactttgggagactgaggtgggcagattacttgaggtcaggagttcaggactagcctggccaacattatgaaacctgtctctactaaaaatacgaagttagccggatgtggtggtgcatgcctataatcccagttattcgggagactgaggaaggagaatcatttgaactcaggaggtggaggctgcagcgagccaagattgcgctactgcaatccagcctgggcgacagagccagactctctcaccaaaaaaaaaaaaaaggcggggggatgggggaggaaagagttggccaaatttgccctaccagatattaaaatacactacataaggttagagtaagtaaaacagagtcattttattgtcagataaatgtattagttgtacaggatagagttcattaatagatccttggagatgagcaaatttagcttaaataaaggaagccctttaaatctgtaaggaaataatgtttttccattgattctttgaaaatgaaaaaataaatatagataccaacattataccagaatcaaaaatcagttttcatatggataaagaactaaatgaatatactttttaaagctggagaaaagattctacactactgttaaaagaaaataatgaatgtttttattatattgggataggaaaggctttcctaagcaatacataagaccccaaaaataaaattgtatgggtccaactgcataaaaattttaagcatatatccagtaaaagatactgtaaacaagattcacattgacaggtatttgtagcattatagagcaaaagattggtatctatgatggtatctcaaatgagctcttacaagttattatgaaaaatgacaaataacctaataaaaaatttgcaagggatagcagtgtgtaacttatgcaagacaaaatataaatggccaataagcatatgaaaagatgaaagcatcttagaatattaaataagaacaatttaattgcaagagatcaggggggatttttgcccattaaatcagcaaactttagaagattgagggatactactggtccacttctgtccatcaaaacccagcaaagacaataaaataaacaaaaatataagaaaaactagtgaagccatagctagaaccttaaaacacacaccaagtcaaataagaattctggatcaaaacagaggaaaatggtgggaattcttgtatagatacagtctaacatagaaacccatgcccatcagcagtaatttccagtcccccagtcctccaagccctggtatgtactaatatactttctgtctctgcagatatacctacagacaaacttccggacatttcataagatagaatcatacactatataaacttttgtgtcgggcttccttttacttagcataatgtttttaagattcacccatgttatagcatgcatcagtacttcattcctttccataactgaataatatatcattatatgtatatactatatttattcatcagttggtggacatgtggattgtttcactggctattttcaataataatgctgctatgaacatttgtagataagttttcgagtggacagattctcttggaaatgtgcctagaaatagaactgctgggtcacatggtaattctatgtttaatgttttgaggaactgccaaaactgttttccattttataaaactaccaccaatgtatgacatttccaatttcttcacatactcaccaacactttatgatagctatcctaatggatgtgaagtggtatgtgtctcattgtagttttgatttgctgtagttttgatttagtgagtaatgcacttttcatgtgcatcttggttatttatgtatgtttttggaaaaatgtctagccaaatcctttgtccattttaaaaattgggttatttggctgggcgcggtggctcacgcctgtaatcccagcactttggaaggccgcggcgggtggatcacaaggtcaggagattgagaccatcctggctaacatagtgaaaccccgtctctactaaaaaaaaatacaaaacattagccgggcgtggtggcaggcgcctttagtcccagctacttgaaaggctgaggcaggagaatggcgtgaacccgggaggcagagcttgcagtgagccgagatcacgccactgcactccagcctgggtgacagagtgagactccatctcaaaaaaaaaagggggttattcatcttctggggttattcatcttcttatactttttatattgaagtgttaagagttctttatataggtttatataatatattgaagtgttgagttctttatattagttcatatataagttgagttctttatgtaagttcatatacaagttgaattctttatataagttcacgtagacacacgtgagtaatgcactgtgtatacgtgaacttatatctgataaatcgcttatcagatatgtcccttagcagatggagtgtttgcaaatattttctcccatgtttttgggttgtcttttcacattcttggctaacgtgatgaaacctgtctactaaaaatacaaaaattacctgggtgtggtggcgcatgtctgtaatcccagctatttgggaggctgaggaaggagaatcatttgaacccagcaggtggaggctgggttgtcttttcacattgttgatagtgttctttgaagcacacaagtttttagttttgatgaagtgtatattgttttgttgttttgtttttgcttttagtatcatagctaagaaaacgcctattcccaaatcatgcagatttacatttgtgttttcttctgagagttttatacttttagctcttacatttgcatctttgatccactttgagttactttttatatatgatgtgaggaagggatgtgaacattatattaatgtggatatccacttgtcccatgtattttattctttttgatgctattgtaagtagaattgttttctgaattttatttttggattgtttatagttaatggatagaaataaggtttatttcgtatattgatcttatattctgcaaccatgctgaattcatttgttagttctaatggggtgtgtgtgtgtgtgtgtttgtgtattcctttgggttttttatatacaaaatcatgtatctgcaaatagaggtagttctactttttcctttccaatctggatgccttttctttctttatcttgccttctagctagaacctctaatacaatgtttaacagaagtggcaagagcaaacatccttgtcttgttcctgatcttagggaaagtgttcagtctttccccgttacgtatgatgtcagctgttgtttgttcatatataccctatatcagggtaaggaagtttgcttctattcttagttttttgagtattttatatcatgaaagactgttggattttgtcatgctttttctgtgtctattaaaatagttatgtggattttgtcatttattgatgtgactgtattacattgattttcgtgtgttgagtaaaccttgctatcctgagatgaatcccacctggtcatggtttataatcctttatatttatatatgttgttggattcagtttgctagcattttgttgaggagttttacatctgcatatgtaagggacgttaatctgtagttttttttgagactgggtctcactctgtcgcccaagctacaatgcagtggcaccatcagggctcactacagccttgacctcctgggctcaagtgatccttccacctcagcctcacaagtagctggggactacaggtgtgcgccatcatgccttgctaactttaaaattttattttgcagagatggtgtcttcctatgttgcccaggctggtcttgaactcctagcctcaagtgatcctccctccttggcttcctaaagtgttgggattacaggtgtcagccaccaggcccagcctgtctatagttttcctgtggtgtctttgtctgattttggtattaggataatactgcttcatggaattgagtcagaagtgttttttccttttttatttttatagaagagtttgtgaagagttgttaatgggtgtatgtgctttaattattttttatatgtgtggtagaatttaccagtaaagcattctggcttttctttgtgggaagatgtttgactatgaattcaatatctttacttgctatgtaactctattcagattttctgggccttgagtcagattcagtagttttttcctacaattatgttcgtttcatctggattatgtaatttgttggcatatagttgttcatataatcgttgttgatctatgtatttgttctgcctattattgaaagtggtatattgatatctccaactattattgttgaattatctctttctgttttcagttctgtcattttttgctttatgcattttagggctctgttgtttggtatatgtacatttatagttatatcttcctcgttaattgagccttttattatgtcttattttttctagtaacaagttttatcttaaggtctattttgtcttacattaatatttaactgtcactcaagttctcatttggttatttttatatgatatatctttttccattcttttactttcaacctaattatgtctttgaatctgaaatgtatctcttatagacagcatgaagttggattgtgtttctgccaatctctgtcttcttattggagtttttaatctatttaaatttaatttaattatgataaggaagaatttatatctgccattttgccatttgttttctatatgtgtttcatctttttgttcctctgtttgattactttctcttttgtgttaaatagattgttttctcatgtacaattttaaatcccttgtcatttcttttgctatatttttcgagctattttctcagtcattgccctggagattaccattaacatcttaatttatgacaattaataccaacttaattttaatagtatagaaaaacatttctcctataataggttaatttttgtcttataaattacatttatatattgtgtgcccatcaacttagattataattattgcattatatagttttcttttataaataaaaaaggagttatagacacaaaatatttaattatactctcgtttatgtttacctacatagttacctttactgtcactcttatttcttcaggtgtatttgagttactgcttaatgtcctttcctttcagcctgaagacctgcctttagtatttcttacagggcacatctgctgagagcatattttctgtaattttactcatctgaaaatgtcttaatgtctccttcccatggtttctgatgagaaattagctgtttatcatattgagcattgcttgtatgtaatgggtcacttctctcttgacacttcaagatttttctgttgatctttggttttcaacaatttatgatgtgtctaggtatggatttctttgagttaaccctacctgaagatcattgagctttttagatgtgtgcattaatgtttttcatcaaatttgggaagttttggtcactattttttcaaaatattcttcacttttctctctgtttcttggattcccattatatgtgtatgttggtaagcctaatggtatcccacaggtttttgagcctttgttccattttcttcattctttttttctttttgttccttataatagatcatatccattgacctgtcttcaagtttgctgattatttcttcttccagttcatatctaccgttgagtccttttagataatttttcattttattttttatacttttcaattccaaaatttctatttggttcttataatttttgtctgtttattgatattctgtgtttggtaaggcatttttctcatactttccttagttcctgagacatgtttcttttaattcttttagtctttaaaatggttaatttaaatctttgtctactaagttcaatatctggatttcttctaggacacttcttattgactgcttctactgtgtatgagccatactttcttgtttctttgcatgtctcataagttttgttttaaaacctggaaattctaagtaatgtggaaactctggaaatcagattccttcctcccttggatttattattgctgttgttggtgatgtttgtttaatgaatttcctgatttaacattataaagttattattctttgtggtatgtagctgctgaactatcttccttgtcagcttagtggtcagctaattattaggtaaaaatttcctcaaatctctagaaacaataagtctcccagcttttgtcaaggggctctctctgtgtattgggcatacctttaatgctcagacaggcagcttataattctgcgtaaaccttcactttctctttgtactaggtctcaaggtcagccagaggtgagagcttcgagccttcacgggtctttcctatacatcttcatagccctatacatgtgcacagccctatacaagttcatgaccttctagattcctaggaatatgtcatagctttttgaagactctcgtggacatctcatacctccacttctctgttgaaatattttggtcagcttcttgttcacatcagttgttgtcattgcctcaggcagctgcagtgttaacttattgccactgattgttttcgacaaattacctcacatctgtctttcctcctcagagagaagctattcacactgagtgagatcttgagtcaggtcaaataaagcaagccttgcaaataaagatttccaggtaattgccagacaggtcaaataatgacagttctcttagaagggtgttttgaggaactccaaacctgtcctttcccctccagtgactactaggccacacctggttttcactgtgattgcagtaatgttggtttttaagtctgctataatgatagtgtgacaggcatgggaggaggccaagttaaaatgtcacatgctattcttaccaaaattcagcattttttaaaataaatgctctttggattgttggaagcctttggtaatttctaaaattctgaagaagttgattctgacaattgttgacagtgcttttatggaacagcagattttgctgttgttgcttttatggaggagtaggttttcagaggtttttacttcactattctcactgatgtcactccaattcaagagattttgaaggaaagctggcccccaaaattttccctctagaattgtcctcaaagtatgaaaatggagacaaacatacaaacatacaagggttgaaaaatacagcaccaattagcctgtgctgttaaaaactactctgtgaagaaatctatacccaaagttatatttaaaaataaggcattttggccagacacagtggcccactcctgtaatccaggtactctgggaggccaaggcgggtggctcacctaaggtcaggagttcaagatcagcctggccaatgtggcaaaaccctgtctctactaaaaatacaaaaattagccaggcgtggtggtgggcacctgtaatcccggctactcaggagactgaggcaggagaattacttgtacctgggaggcagaggttgcagtgagccaagatcatgccgcggcgcttcagcctcggtaatagagcgagattccatctcaaacaaaacaaaacaaaacaaaacaaaacaaaacaagacatttaggtattgactggaaagggaacaagagggacttttcaaggggcatagaaataatctgtaaattgatttgagcatgcatcatgtacatttatcacatgcgtctgtatatttatcaaaactcattgaactatatacttaaaattttactgtttgtaaaatataactcaattaaaaacaaaaagataagagtttaggaatggaaaaacttttaagaaactctgtggtaaatcttaaatctttaaatctataaccatgagtgtacagctgtggcaactatgaattcagaacagaatgtaaatgctgactgtctaaaaatatgttctaaatatgaggagttgggtgcaaaggctggaatgtggagatgggggaactagagtgtaaggatgtgtcttagttatctgttgcaacattaagaacttagcatcttgtaacataagcctttattatgtcactcaatttgtattggccaggaattcaggagcagcttagataggttgttttggttcaggggggtctcatgaggttgcagtcatctggaggcttaaatgagattagaagaccctcttccaagatgactcacttgcattggctgttagcagaatgtctcagttctctgtcacgtggatctctccatagggctgcttgagtgttttcataacatggctagcttctcccacaactaggtatctgtgggtggggcagtgggagagagggagagagggaaagagagaaggagacgaaggcagaaggtgtaatgtcttttatgacctagcttcaaaagtcatagaccatcatttgtgccacatttgttggttgcacagagcaaccctgatgcagtgttggaggggattacacaaaggtagtaagaccagaaggatcatttggaggttggaggtccctttggaggttagctaccacagtctgctaatttccttagcttttttagcttggaaccattaaatattgcccatatgttaaaaaaaaatccatcccaatgatacactgtttttgtataatgctttttaccttgctttagtggactctttcgagaacctcatttctcttatggaaacatttacaaaacttcagatattttgttttcactccagtttaaaaaaaatcctgtgttaaaataaaactactttttaaatatattttaaaattctgtctatagtgtggtttcatttcagttattacttctacctgtcctgtgtgtatatatgcttggagtgatgatcttggaattagtgtatttatttctaaggggtgagaatttgggtgtgtggtttttaaaattcgcttttctcttaatttttcccctttcatctgaattgcttaggatttttaaaataatggacttgtattatgcttacaaaaagaaagtcagactttcaaaacagttttgtaatattcagtaatggtgagaatgtaggaaaacatgcttatactacggttagagtataaaactgagtacagtcttgtctttttttttttcattttttatctaagtaggagaggagtgagagtacagtcttctttaggggacagttaggtgacatttgtcacaaacataaatgctcttcacaaactatgaatcaaaaatttcattcctgtgagtcagccctagagaaatatttatttgtctgcagaaggttgtacatagagtgtcattgcatcataatttataatagtgaaacattaacaacaactgcagtatcgaataataggttcatgttttaataaattatggtatagaataccttgtaaccactagaatgaagatttacaatgtactatatgagaacattctaagatattagagaaaagtaagttacttattatatgtagaataaccccaagtgtatgtttttaaaacaactggttgtgtgtgtgtgtatatatatatatatatatatgcatgcatatttttctgtattaaatttttctgtattaaatatatatatatatatatatatgaatgcatatttttctgtattaaatgcatgtagaaagtctggatggattcacaccaaataaggatacctttaggataggaaataaggggtgggagtggaggaagggcttttattttatctgcgtgcatttatgaattatttgaatttttgtagacaatgcatatatgtgctttaacttaaatttaaacataattctgcttgcactgtggaaggcgaattatagagatgatagcagttctgaagtacaaaattgcttgaagaaggaaatttcattttttcaattgtgaaatgatcttctaattaaaaaggagcttatgagaattttgtactttgtggatcttaaatggtttgttatttttcttatagttactgcaattgtccaggcaaaagagactgagattccaaacttctggaatgaggattggaaaggacatgaaaataattttaggaagagaaagtgattgtatttagtaaatatgtaagagtgtggggggaaagtagagtgaacagtaaaattgagatggagaacacaggaaggagaacagatttaaggatgatagtgaattaagttgactgtgttgaggacctgtgggaaaatctcatggacgctatctagcagatggtttgaaagaatggtctggtaccctggaggtcattggcatttagatgacattttaaatcaatgttgttggtaattgagatgaccaaaggaattctgagggttactaacatgtaagaagctagcaaagcagccctgaagtcgactgaaaagatgtggtgttggaattgtatccagcattccaaggaggaagatgatgggagtggtcagtggtttcactcctcaggaagtggaaggaaaattaaacataaatttgtggtattggagactctgacaagaaaggattatggtggagagccctctagtggaagggagcgtggtgtttgaggaacaggtagcctgatgcagctgctcagaaaataatgtgaatgaggctggaaaggctttttcttcctttgaataccatgtgataactttcttattggaaataaattaatcaggggttagttttagtctctcaatgtgtgaaggttatatgtaaattttttcttttcctctgccctgtcagaggtagacaagataggttttgaggaactaaaacttgtgggcaatgacgttttcttctgcagtgggaagtagggggaaagttagggaaattttctcctgagaaaaagtatcaaagctgatagtatcgagaggctgccagggcttatgagaccgtgttcagctgaaggaccaaagcagctcaaagcatgagttcaaggagccttacccatctgttaacaggctgcttagaaaaatcactgtaaaacgtgtccttttatgcttttattttgtttacagtgccttttttggaaaaattacctgctttacttattttctacattattatatgaatactgagattaaatttagagggaagaaattcttgtttatttcttcctcacacaaaagacaagacaggagaatattctataacaccatcttcttcctttgttttattaaagtaataattatgcatagagaaaattgtggaacaacatgtgtaaatagctaaccttgcttacttcagagagtagaattggagggggaagacagaaattctttgcaactatttgcttgtaaaataaccagtaaagctctgtatttagtatttagggtgaaaagccaaaaataattaatgcatatttataggaagattaagaaaacaatatagagatagaaatgtaggaagaatctgccactttaaattcatattatatatctttagttatatattagcttttgttactatacagaatttagaatatgtaacattgtatattcataaaaatatatcttttcatttatttcatgagcatctttccatattgatacatatccatttacttcatttttttgaaactacatagaattttaagaacatttttggggcgactttttaaaatttaaatatatacacagaaaactgtccagcttaatggacacttaaaagtcaagttaggacacccatataaccaccctccagatcgagataaagagcaatgctggtcaccacataaactttcctcattctaactcccaggcagaaaccttctccctcctacatgggtaactactattctgatttccatcgctatagattagtcgtatctgttttataactttatttaaaatgaatcatatatagttatgtatggcttttgtgtatgtgtgtctgtgttataggtttttcagttaacattatttttgtgatgtttatccatgtggtttcatatagtggtagtttatctttttctatttagtatagtagtctatagcagaatgtgtagctatcacagttgatgcattctattttttttttttttttttttgagacagagtgtcactctgtcacccaggctggagtgcagtggcgcaatcttggctcactacaacctctgcctcctaggttcaagcaattctcctgcctcagcctcccgagtagctgggactacaggcacacaccaccatgcctggctaagttttgtatttttagtagagatggggttttaccatattggtcaggctgttctggaactcttgacctcagacaatccacccacctctgcctcccaaagtgccgggattacaggtgtgagccactgcgcctggccgatgcattctattattgatgggcatttagttgtttcacattgggggctattatggaaatgtttataagagccttcttgtctcttttgaacatacttctattgagcaggtgcacatttctgtgggatatatgcctagtaaaaaaatgctaggtcatagagtatatgtatgttcagctctagcagttatcatctgtttcccaaagtggccctgccattttatccttccatcagcagtgtgagaatcgtatatgctctatagccttgctagcacttgatattgatggctttttatttgtttggttggttctgcttttttgttgtagttttctgggtttttttatggctttttaaaaacattaattttaaagcctaccagtgttttgttatataaatatactctaacttaactaatgtccgtttgatgagattttgtcctcttctcactataccaaagccagaacctggacagttctgttgtctagcgagctctgaggcttgttctatgtatgatctgattaaggaagatttcatattggaaccagttaacagagctgataatatattttttcttaactgatttttctcaagttttctgttttgagtagtatgatagcaatatgaagaatccatgtaaaataattttattttgttgacatgaaaatcaatgttgatttcatggtggttgttttcttcaccctttaaaaatgcagtataggctgggtgcggtggctcatgcccataatcctggcactttgggaggctgaggcgggcggatcacctgaggtcaggagttcgagaccagcctggccaacacagtgaaaccccatccctactaaaaatacaaaaattatctgggcatggtggcgcatgcctgaagtcccagctactcgggaggctgaggcgggggaatcgcttgaacccaggaggtggaggttgcagtgaaccgagatcacgccactgcactccagtctgggcaacagagtgaaactctgtttccaaaaaaatacaaagaaaaaaaaaagtagtattaaaaaataaccataatgtctgaaactagacttttggtgaaagccgaattaattatccagaataatttgcattttcttagaagaggcatacagtgcctacattacatgaatctttagtccactggaaaactgctgtgtgaattatttgagaatataatcacttagggtttggaaagctgtttgaattttgccttttgaaattgaaagatttttccaggctgggcatggtggcttgtgcctgtaatccagcactttgggaggccaaggcaggaggaccacttgagcccaggagttcgagagcagcctggcaacattgtgagaccctgtctctacagaaaaaataagaaattagctggatgtggtggggcctggtacagtggcttatgcctgtaatcctagcactttgggaggccgaggtgagagggtgtggtgagccatgattgcgccactgcactccagcctgggagacagagtgagaacctttctcaaaaaagaaaaaaagaaagatgtttccagtcagagaactttgcttcacagtctttttttttaacactcccctctcccatttcctcaaattttcttttgacataggtttttaagtgtgtgaaactctaggggcttgcttttaatgagttaaatgtgatcccaggacctcctgctttttctgatgctagagggtgtgattacttcatgatagctactcttcctattgggcattatacctttaaacgggacgagtcgacacaggtgatattcagtaatattcggttaccctcagtaattccttgggaggttttaggtataggtaaccttctctggtagctgaatggtcttttggaaactgccttgtggacttacaagacagttttgtctttcctgttgttacttgcttttgccagtttgtactgagttattcattttttggaatagctatgaatggccagaatgagcatgtgattctcatactagtaagttttagacatgcttttttactttcaaatgtagagattctttacatttctaagtaattgctgtcaagagcttcttggagatagcagaaaactactgctttatattctgttcagttttgtggaaagcttgtgttggaaaaatgtctttagctgttgagatttcttaagaggtcatattgtagcatacataactctaaaagtctgctaattcttctctgtactaatggtaatgactctaaaaatggctaaatgaattaacaaataagccaaaaaaaaaccttattgaagacagtattttcagtgaccttttgtttcctagcccctaaatcttttggtcagtatccgtaatgagtaacaaaacttgctgacttgacttttttgctcaatatcttttaaaagttttattattctaaattaggggtggagtggaaagcagtggtaattgaaggagcacaaatataataaactctgacaaatagcttttactttaggaatctctttatctcagattcatggaccttttttggagattaattttagaggccattgtcgggtcttaattaataaactgccttgacgttgaagagataatttctgagtatatcctagccagtgcagtcagtctttacaaaggaatccaataatagtttgctcaggttgcaacttccttatggactggacacagagaataaagcacccagtaacctagaaccaaaagatcctttattaatttcactgtaatttcagtgccccccaaaacctatttctctttctacataggtatcagtcagagccggatctctcattggctgttgcagcagggatcagacctgagtgaacagaagaaaagagcattttaccgatggtatcaacttgagaagacaaaccctggtaaatagcatttccttttatttattgcatctgaaacaagacagatataatgaattactttaatgactccatgtgctaacttgttcagtaagatggtttcatactttactatggttgctttatgcagaaaaagactcttaacagtaaaagctaaaccctgactgtaataaattttattttattgtctaatattatctagtcatattcactccttcccctaagacacctctttgctttcaggttatatgatatttctagccatagtttgaaagaacgctatgaatgttcagtggctgattttgttttcttcaactacataactacgtaagattccgtatctcttttttttttttttttttttgcaaatcttgtttgaattagtaatgtaaatttaatatttttatttaattcatgctgtaccatatccagtgatctctgctaatgatttttttttttctaattctaatgacctgggtaatggatgtatctttggactttaggatgcagctgccctgatgactcccaggagcagcagtagattgggaaagcagaatgaaatcttaagaaaactaagatgacaaaaaaatttatgtctagagttggaagaagtaggcaagatctattcaagatactaacaggtgattttataaagtgaaatctgaagttatgggactatctcaatctatactttacacaggcaagtgacagtgagcctgccctcatgtgtaaatttaagattgggttgtgttctgtaatgctgcagcctcaaagcctttgcacacagactaaaacactagttgaaatattgcataataatagcattggctctgaggtagaaataaagaatgtcatagagatgtatttttgtgtgtaagtatgtgataagatttttttccctaaaggtcagtttctcaatccgaatggtccaggcaggatgaaacagaaaagaacctatcaacctctacaataatattaaaaatctattctgactcccagtttttattttgaaatgtttcagatgtacagaaaattcaaaagactaacacagtagacacctgtttactctttcttagatataataattattaccatttggctgggcgcagtggctcacgcctgtaatcccaacactttgggaggccgaagtggtcaggtcacttgaggccagttcaagaccagcctggccaacatggtgaaaccctgtctctactaaaaatacaaaaattagccaggtgtggtggggcatgcctgtatcccagctactcgggaggttaaggcagagaaattgctttaactcgggagacagaggttgcagtgagtggagatggtgccactgcactccagcctggatgacaaagggagacctgtctcaaaaaaaaaatatatatattattattattaacattttacatttgctttatttctataaaaaagttaagatttatatatgtgtgtattcagcattcatctcctaagaataaagataatctgtattaccacagtcctcattattatacctaagaaaattaataataatttcatattatcattttatatccagtctgagtcacatttctctagctattagaagaatgtcttttgtagctctttctttagtatctcttttaggttggaaaattgggatatctcttaaatctagtcacccaaacttttttcttttaatgacatgaacttcttaagccatgtaatttgacagaatgtcccacatgctggatttttctatttacttttattatcaaatatctaatttctttatcttctgtatttctgtaagctggaagttagaattaaaatctgaagtcaggattcatgctgaatattttaggcaagattacttcatagattatttagggaggcacgtactaatggcagcaatttattttgaaatgcatcggaaaataaaatggaattgtatttagggaaatggatagctatgtgataaagtaaaatatgtggtatgagtatggttttcacttaaaaaattctttcactattgtatgtttgaaaatttttgcaataaaacactggagaaaaatactttgtaggtagtgtttacctaatattgccgcatattaagaggcctgtcagcattaggaggttgtagcactattcatatgccaagtgtgatggttttgttaaaatggtgaccaccagatcttttctttgcagtttgtgaataatctttagggtgacactttgcccctggatgaatatcctttcctgcaacagctttcaccgatgaccttagcattcgttgatgattcttgattgaatctgttattctgatggggattgcaaaatgggataatcaactggtaaggccaaattcccgcactggagtttcggggctgggctctagtccagccctgaactagaaataggaaggacgactaaggtgcagctctagggccacaatggcattgttgcagctgatctgatagccagttgtggaatactaactacaggagtccagctttagcactgggctgatagtgttcttccaaagctggttttttttttaaattattgttatttattttagcttttagtcttaatttcctattttagtttatcttgaaaccagtattgggaaattagaggaaggtagaactagggaattgaaaccagcagcattcatctagctgataattaggagctgatttctttaagtacatagtgcctccttttaagacgttcctctaattatatgcatttgtttttcagtaagattgcattattgtcaccttttaaaaagtactttctattttttgtttaaaaaccaaatcctaactactggttttctcagtcaagtttttctgtgggacataatttaaaggtagctagagataagagggtaagttcgtaattgccatttggtagttgttgttgcgttaacagcaattgggtattagcaattgaaatttgtttgtctttttctttgcattttgacatttattataaaggcaaatatcacatagaattctttctcgataaaagtgattttgttttgttgactaaaataacctttgattttagctaaagaatttggagctactattatgtttggttaagatgaactaaaattatgttagcttataggacagcagatccttcattgcaagtcatttcagacctgattggaatccacccagatgtccctcagttgagaactggttaaataaattaatggcacatctgtacaatggaatcttatggagccatataactactttttgaaggcagctttatatgaattaaatttatatgaggtgatatggaattcataagtaaaaaaggtacataacagtatcaagggcatatttatgtaggggaacacacacacatacacatgtatatgcttatctaagcatagaaatctctgaaaagctgtgttaggaactgggaagaatagctctgtggaggggaactgagtgactgggagtacaggggtaaggagttaactacacagcctaatgtgtctttctaaatttcatactatgtacttgtattatatatttgaaaaataaagtgtaataggaagggggagacagaccaaaagaaatcaatctgccttgtaagattaaaaagaaagaaagaaaaggaagaaaaacttaggtttatacagtccagacctgcttttgagaagcaggtagaaaataagttgtcagtgatttttatcaagtaattcttttatttcataatttttttttctgtctaggaaagatagctctttagggtaaatgtaaatagtgtgatccctttacatatattctgagaagaaaatgcaaaattaagaaaagtcacaaaatgaaaaactactttttcttttttcttctgtaaatttaagcatttagaaaacaaaaatgtttgtatattctatgactctattcctggggcgttggagcatttctctttgtatactttgagtgaagtccttttgttgttgttgttgagacagagtctagctctgccaccaggctggagtgcagtggcgcaatcttggctcactgcaacttctgcctttcgnnnnnnnnnnnnnnnnnnnntagagatggggtttcaccatgttggccaggctggtcttgaactcctgacctcgtgatccacccacctcggctttccaaagtgctgggattataggcatgagcccccggccacccagcggaagttctttttttcaacctcttcagtctggatccagttgtatatggcttttggttttttgtaagtttctctttaagtggactcatcaagaaaaataatagaatggatatttaggttaattttactgataacccgattgatatagtgtagttctctgataacagactcatcatcagaatttaccagcataaatgaaagcctgccaaggcatattaataaaataggctgatggaaactaatcaaatacattttatcttgtttcttatgaaaacacttataagaaaatacctattttttaaaaaaaagtgagtgctaaattcaggatggttgacatcaaaagtccctttatttaatcaaattaagttcacagtctttttcccttgtctaatttaaacattactatagcagacagggtttgctgagttcctcttggcatgtggtgcatattctgcatgcttctaaacaattaaataaaatttgccaagagggttatgcagcaaatacatgagataaatgtcatcagaagaaacatccagtccttcacttgcagagtgttagatctcagggaaacgtgtgtgacatgggggaagatgtgaaattacttttggagaggttagttcctatggatggcgtagtaatgatgtgcttatagtccctcacccagagctaaccctgatcagcaaggacattatgatatatgtaaagagaacacttaccaaatttttatatgtcttaacaagttatgaaaagagttttgggttttttttttcctcatgggtttagatttgctaggtgaaggtgcaaaattttgttttaatggaaacttagatggggggaaaaaagatttctgtaaggaaatagacaacacacttttcctgttaggaccttagccaacccagaattcctgtattttacttcagaggagtttaaaggcttaaatacattgttcctgcattctagtgtctttgtgtttttctgttagagtcagtaattttgaactcgctcttgcttttcatccatttcaaccaaagcaagatgaactaaggtttccagaacaaatctgttattaatagagtgtttccagagtacttttttgtgctgtttttaactactgctacattgaaaaagaaaaaggagccagaaaaaaatctgaaaagtaatgtaacattatgttttaaagtaggtattttgatgaatttaagattattcatttttcaccttctgtgtgtaaactgtcttgatttcttttttttcccccaccccgagatggagtatcactctgtcgcccaggctggagtgcagtggcacgatcttggctcactgcaacctctgcctcctgggttcaagcgattctcctgcctcggcctcctgagtagctgggattacaggcgtgtgccaccacacccagcaaatttttgtatttttagtacagacagggtttcaccatgttggtcaggctggtctcaaactcctgacctcaggtgttccgcccgcctcagcctcctaaagtgctgggattacaggcatgagccaccgcgcccggccttgatttctttcaaaataaccaggccactacttacttttctgtcttctttttctccttttttcttctcccctcttccttttccttcctgcccagttttatttcatctgaatttccttcagttcttgagactgtcttgacaatactgaatattacaaagaagcataatattaataataaaccccaataccaagaaagaaccattattattagttggcttatttccttcaacctcttggttaggattctttctgttctgtgttctatttgtacccatttaccactctgcttactaaggagcatgccgcaattatggatgtggcctactacctggaattcactgacctattgcccaccctccatcctgaagctctttctttctttacaagggtcagcccctggacaagaggttgtattcccttactgagtcttatttctacctttatcttgatcagccatgataaccggttggctctgttttagtccttttcacccttgctatagaataacatttatataattttaattaggtagattccagagctcttgctgtgctgtaatccctacttgttttcagaaaagcactataagactgtgaaaccctccagcccccaaattcctgcttatgtctaaacttagttaactttcaattaggcccagactgaattctcagtttattttggcagaatgaaacccttttaaattgtttaaagaagggtttcagtttagaatttcatgttgggtagagcagaaatgtttttaaaccaggggttggcaaacttcatataaagggccagacagtaaatattttaggttttgcaggttatatgatctctatcatagctactcagctcttctgctccagtgcattcatagccatagacaatctgtaaatgaatgagcatgagcatgtttcaataaaactttatttacaaaaataggcagtgggtataatttgccaactctgttttagggtgggctgtaaatctctaaagcattatatgatgacaaacttacttgtttaagcagaaatgttaagtagttaaatatttactttccatcacatgctataagaaatcacatacatattaaaggctgaaacacaaaatgaaagatataaagatactcagtgatattcaagcccattggccataatacaaaagactgacaaatttgactgtattaaaattaagatcacaaagcacactataaaaaacaaatgacagaccagaaaaaaattgcattctgtatgactagcaattgctatgatttctctgcacccataagaagaataaccccctaaaaaaggaacaacagatagaaattcacaagaaaagatataaatggtcaataaacaggaaaagatgctcattcttattagtagtgaagtctctatattaaagggaaattttttgctgccaaatttatacatttgaataattaataatagtgtattgggggataaagggaaataaacaactgaggatgattgtgataatttttattagttatctattcttatacaataaattatccacaatttagcagcttaacacaaccagcatttattatctcatagttttcatagatcaggaatccaggaatggcttagctggttgtttctggctcagagttctgtagaggttgctgtccagctgtcagcctgggctgcagtcattgggactggatggtccacttggaaactcactcatgtggatgtggacaggtcccaggtcctcactgcctgttggtcagagacatcagttcctcacaacatgggcctcaccatccactgcctgagtgtcctcacacggcagctagttttcccttgagtgaataagagagaaagcatccaagacagatgtcatagtgtcttctgtattctgatccttgaagtgacataccatcactgccacatgctgttggtcgcacagcctaatcatggtgcagtgtgggaagggactatacggaggtgtgcagaccaggaggcagggatccttagggaccttggaggttgatgtccacattcctgtgctgggactgaatgtctgaggccttgtttctgtctatcacctggtttctgcacttctccatgtggcatttgctgtggctacagtgtccaagatggcattttctctcaaatgctggcacctgggtggagttggcagaagaccctggggactgtcagagcatctttcactccatgtagcctctccacatggctatcctgggcttccttacaacatcatagtctcaggttagtcagacttcttatatggcctctggtttcccccagagccagcattttaggagacctaggcagaaatttcaaagcatcttataacctagccttgaattgtttagattttcttgctcaacaacctgtcacaggactggcccagattcaagggcatgattagccagaggtatgacttactgtgaggagccgtctttgaaacttgtcccaggaaaccatgattgtgaaagatgatgctgacgtgttctaaaagtagtagcagtgcaaggaataaaaattgatctgatactggaaatattttgaagataaaatgaacttgcctatgaattagttatgtataggtgggataattagagaagtgaaagattaatttgagaattttgagctgagtggtttgaagagtgggtatctatttactgagatgggaaagactgcaggacaataggtttgaaaagcaaaatcaggattgattaacattttggacatctgtgtaagagaatacatctaaagatgtagctattaagaaggggatctacaatagatctgtaagtcttgaagtagaaatgctatccatggtattatttgcaaggtacaataaagagagtattaattctattaggaagaaataaatattaatatcattaacatagaattaacatatttattaatattgcataaacctacatgttctaacatgtctttctacacctgtgttaagcatttgaattaaactacaggcagagagaattttttgaaggtttttgattagaagaccgatatgatcataattatgttttgggaagatgaatttaacagtgtaaggagtgaaagaagagtggggtagccagggactgaactctatgaaagcataccaagttacattgaaagtctatgaaataagttcatggaggtcacagacaatgttgctttcctggttttattcttagcttctagcctagagcaagccacttgaaagggatttgttaaatagtgaatgaatgaataaatgcatcattggcagttcaagctatttgagaaaagagtaatctgaattagtaaaatgtctcaattatagatatttttcattgaaattttattatgttcaggaggtaacagaatctagtatagcatcaacaggtagacctatggagacctgatttagttagtagacaaaaagcatatcaaatatcatcttattttctttcatgctgtatttcactctttaaaaaagaaaagagtttacaagaattagggttattttaagtttgtctcctacctgcataaattccttaagcttataacttatttgaatggttagtaaaagattctgaacatctgaggtatattgttcaaaaagagtataactatcaagcaggaatttcaaaagaaatttttcagagaaagatacattgattaagttgtcactaagccaaagaccatacttccctagtcccataggaagtagatgttatattgttttaaataaactgcaagatatttgctaaaagtgtcttgtttatttcaggcgctacactaagtatgagaccagcccccattccaatagaggaccctgaatggagacaaacgcctcccccagtctctgccacatctggtactttccgactgcgacgagggagtcgatttacctggagaaaggagtgcctggctgttatggaaaggtatgtgtctcctttttctacgaatgatctcccaaacttagggaagacatcaactctggatagactgggacagttttcatttcaaacaagtaacttggtatcttggttctatctctaaaagtactttagaatatcataaatgctgtattatagaaataaggtgatcttagcattgagaattcataaagctggagttagcatctgtcaatttattttacttataatagtgtccccagtaatttaagaaatgttggaataaatattttttgaattcagatctttgtattatattttggaaaaactctttgaagtcttcttttcatcaaaaataatgaataattgtataggagactactgagatttaactttcctttaataaggagtatggtctaagtaagctttgtcccaaaggttaaaaatacttatttttgactttgttttagtaatttatcctctcattctgtcaccagtacctgatccatagtaggcactcagtggttttttttttaacctgaatttgaccgtagcttcaattttcctatctgaaatggtataaattaattatgattgtgaaatgtttggcatacttagcatagatcctatagtagaattatctttttagtcatctacttgtaagtgatgtttacagaattttgtttcaatggaattttgtttatatgcaattaggtaataatgttccagctgtacatttttcttatctgacctgactagtagaattggtatattggacagagcactggactcagagtcagaagacctatacccaactaactttgtttaggtcacaaactctcagctgtaacttcatgtctaaaatgaaattttttgatagccaatatgtcatctaagacttttgccatctctcatcctgctactttctgattatttcccagctcatgaacttcactacctgaaagagagggagatttaaaatgccgaaattcagatgtttttgttcatgtgatatagttgaaattaataggtttgcttaaggtgaaggtgagatccagtatccaaaatgagactataggttatccactgatgttgtcatctattcctttccttgctctctttattatagataagagcagaagccatttattgaataatgaatccttatatgcttgagtcattaaagtgaaagaatgagacattattgtcctggagacctgacatttacaatctgctctgcttttctcatctagaaatttttattctttttgaaaatttctttagaacttggcacacagcagatgagaattaaaataatgtctaacttaaattgcaacattgtacattttcctttaggtattagtttctacctggtgctaagttctaattgtgctagtgacttagccagttagtttttttcatgaaaataccagtatatatttatcacaaaatgtcatcatgagaaagaattaagttaaaaattgatgacattaatatcaataggtgatattcctaatgtactttcagagttgaacctcagagacttagggattcttattttccttggcagcaagaattagtcacagaatcacacggaattttaattaaaaagatattgagcatttaccctatgactcctatttagtcttaatttatgttttttaacattaattttaattaataaatggctttatctaatccaggagttggttatctttggcttaattttatgttacctggcacaactagaaagaggatgtggtttatgccaatagttgcaaaagcacagaaagcctttcaaaatacttaatagtacagaaggtcacacagtatgatttttgttctgtaaaaatggaactttttgttatccaaaatgacatataaaattcctatccttagtatgacgcatatttttttccttgactgcatgggtaaataaatacatatgcatagactgtaaaaccagcaaagtaagccttactcaaatgttggtataagataaaagtaaggctggacatggtggttcacacctataatttcagctttgggaggccaaggcagaaggatcacttgaggccaagagtttgagaccagcctgggcaacatagcaaaaccccatctctacaaaaaattcaaaaaatatctgggcgtggtggcatacacttgcattcctagctactcaggaggctgacatgagaggattgcttgagcccaggagtttgaggttacagtgagctatgattgcaccactgcaccccaacctgggcgacatagtaagatcctatctcaaaaattaaaatgaaattttaaaaaagtaaaaaattattccattcttcatacatcaagataaatttcaaatgagtcaaagaagtgaatccatataaataatagaagaaaacatgagtggtcccttcatatcctggcaatgggaaaaatatttcctaaccatgacccaaaatctaaaaacaataaaggaaaagattgataaatatgattacataaattaaaagaaaaactttggagggagtaaaagctgagcaaagtaaaagacaaattggaaaaaaaaattgcaacttttattatccctaataaagagctcttaaaagaccaataactctatctttattgggctaaagataggagaaaaaatgcaaatggtccttgaacatatgaaaaatatgctcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttaccctttgacttgacattcctacttctagaaaattatcttagggccagtgggtcacacctgtaaatcccaaccttttgggagggctgaggtgaaagaaccacttgaggccaggagtttgagactagcctaggcaacatagtgagaccccatctctataaaaaatacaaaaaattagcaaggcgtggtagggcatgcctgtagtcccagccactcgggaggctgaggcaggaggattgcttgagcccaggagtttgaagctgcagtgagctatgatcacactactgcacttcagtctgggtgacagagaaagaccctatctcaagaagaaaaagaagaatcttaaagatatactggcaaaaatatgaaaagataacagcactgtttttactaatttcaaaatacagaagatgacctaaatgtctatttgtagtaactatgtcaataaattatagcacatccatgtattggatgttgaaacccatgtagtggagtactatgcagctaaagaacaaaaaactctgtatacagtgatctccaggatataacattaagtttaaaacaaggcagaatcaactgtatataatacaaagctgtcatttatgtatttgcttataacttattttaaaatggaggaataaaccataaaataaatggttatcaataaaagagaaacaacttagaagagaggtagaagctagatttctcggaaaatactttgttttgacctgtaactaaattacgtaattatatatcaaaatttaaaatcagggaaaaaatgggggggagggggggaggtgacctttaaaaaataactaaaattaaacctgtatatcaaaatagtgccttaaacacccaagaattatctcaaatgtgtttataacacagtaatttcctatacttcccaagtgggaaacagcttaagaataaaaagaaacaccaaaaaaatcttacactgtttctactaaatttggtattatagatactgctattcaggtactatttttatttacatagctagataggtatagatatagatgtaggtacagataaaacaaatagtcatattagagttattaggaaccaagattgtcagtgcaaaggaaaagagaaatataaaatcaaaagatttaaataaaacactgtagtcttctgtatgtttgcatagagatagaaatttatcttgatttaaaaaaaacagccttaatgagatacaattcatctatttaaagtgtacaatttaatgctttttagtatattcacagaattatgcaaccataacctcagtcaattttagaacatgtttatcagctcccttccctttttgagacagggtcttgctctgttgcccaggctggagttcagtggcatgatcatagctcaccacagcctcaacctcctgggctcaggtctttctcccatctcagcctcctgagtagctgggactacaggcatgtgccaccatgcctggctaatttttatatttttgtagagacagagttttgccatgttgcctaggctggtattgaactcctgggctcaagagatccacctgcctcagtctcctacagtcctgggattataggtgtgatccaccgctacagccccaattttagtaaccataagattgatcagtgaattcagtgttaccttcttgattcacttattaaaaaatcccctattaaccatctacctaatagttttagagcattgattcttaaatctggatgcatattaggatcacccgaggagcttttaaaactatcagggggcttcacccctgatggactgaatcttaatctctgggtgtagagcctaggcagagatatattttgaaaagtttccaagtgattctgaagtgtaggctggactgagaatcactgttttgttatctatcgacgattgtttcccaatcatttttccataaggagtcacaagttgttgtattgaaatttatttcttgtacattaatcagctggaattcttctgtaaagaactttccctcatcaacaatttggttaccctgaaatgtactccctcacaaatgtgtggcagcagggagggagctaacatgtaagtaattatggaactgagaagtgaatgctattatgacaaaaggagcatgtagagaaaagaggaaaactacaccaaagtggtaacattttgggtgcattcagatgagggataggagttcatgagttagagaatctgagaaaaggcattataatgttaggagcattcttactttgattattcagaacttggttatactgtgcattctataattaaacaagcaccgtggttaattataccgtaagtgttggcattcgggccttatgtaggagatgtatctgattagattggtctgttagataatagcggtaggagtgtggataatggacaagaaatcaatcaagtatgtattttaacacatactacatgcatataatcagggggaaataaatgtaaaataaaatgtaaaatatatttaagttataatatctgccttcataaatcttaaggcagtaatagcttacatttgaataggaatttaattactatacagttactgattttattgataattatacgaaattatttttatttaatcttcacaattctatactgtaggtatgttattatttgcagtttatatataagagcctcagagaaaggaagtgactaacccatatgcaaatggattagagcaggggtccctaacccctgggctgtggacctccacacagtaggaggcaagtggcagcagagcaagcattactgcctgagctccacctgctgtgagatcagcagcagcattagattctcataggagctcgaactcttcattttcatccctaaaccaccctccctaccccccaccccgtcggtggaaaaattgtcttccacgaaactggcctctggtgccaaaaaggttggagaacactggagtagaggaggaatagatggaggccagcttaggaagctattagagtaacctatgcatgactgctgagggtctaagctatattgtaaaagcaaaaggatagaaaatggataaaaagtgatagatatcagaaaaaaaatggaagaaaaacaatctaacctagtcacacattgaatgacaaagcaggaaatatgtaagagttgagcatagtgatagtcagagagcctctgggagacagtacctgccattagaaaatgctttcactttgggcaaatcattcagcatctctgggccccaggtgccacatttatgaagagttaaatatcatgatgaagtaaaaagacagacttcagagccacacagacttaggaattagtcacagcttcactttatgttaatctgtgggaatttcagctttctataaagtggagatggttattatgagaagagttatgagaattatttgagataatatgtgcaaatcacacagtagaatgcctttctcataaccattgttagaccagtgttctttttccatctaagcttcttctagtttaatgctttgactgtgaagtcacctcaagatttctgtgttagagagttcagtggcactagaaatggagatttgggagtcatcaatatattaggtacagttaaagccatgagtgtgaataaactctggttaaatatatccatttatacagttcctgcatttttgcagcgaaatgtggctggagaaaaacttaaaaccctgctgactgatctcattttaaattcatgaccgctaacctcaagtgggtctttaattctgccaagcagaattaatactatacctttctggtttattttttcccactctcctgtaagattatttcacactttcttctctctgtgcaaactccccatcctcattctcttatgatgaccttgctcatcatgaacggaaatgaggaaaatcaagcaatcagaggagactgtccacaaactacctacttgctaccatgtacacacacacacacacacacacacacacacacagttttcctgcctcttaacatacccagagcacttcaatgatatgtatatttcctagcgtgtgtcttggtgcatcattcatatatatgtgcattttctccttctctgacctcattccactgtgtattccacatatttgacttctaaaatatccaattccaaaaacatttattgtcacaaaggacaatattgtgtgattccatttatatgaagtatctggagtaggcaaacctatagagacagaaagtagataaatgtgttacctagggctaggggaggataggggtgttgggtgggggatgtgatggctaaggggtatgtgtttctttttggggtgatgaagatttgtaaaatcagttgtggaggtgcttgtacaactttgtgaatatgctgaaaactattaaattgtatgccttaaataagtgaagtttttgatatatgaattatatcaagctgctttaaaaaaaggcatttattcagtgcactgttagaagcttcacatatacttaccctccatatttaatcctcactgcaggcctggtttttcctttttctaatgaggcagtcaaggctcaaagaggttgaataactaacttcctaagaccacagagctaacaagtgtcccagtcacatgtggatgtttagccagtgctattcacagatttgagttcttattaactaagaagaatgttattttaatttgggtatatactgatggtttttaatttgtggacttgggcttcgttaactctaaagtctgatgtccctagattaatatatgttacaaccttccatttgtttaagagcatatggggattataacagggaaaagatgaaacaagaatggcaaaatggttgttaattgttgaagctggtatgtagggggttgtgggtttattatatttgtgtgggtttaaaatttttataattaaaaaggattttgttgtttttaaagaggacctgactagattttaatggataaaatatataattgactaatatttattctttttttaataaagcatttgctgtgtgttagcactaacctaggcttaccttaagtagtttacatattctcaaggggaaaaaaagtcatctgtagtgtatgtctgaaatatctgcatatgcaaataatgtgattctacaatgctcaaacgtgattctgcaaacctaactgtccatttgttcattcattcaatgaagtacttacgggctgtgaggcaaagtgctagggatagaaagaacagatacatttaagggtgagaagagtgaaaggagtagatctgaagagaaggtttttgtcagaagtgttgaaggcttcatggcctaggagagtgacttctaatgtactctttccttactaatctttcagcattttgggctacatattcctttatctttggaaacaggtgtgtctctggagcattagtgtatgtgactgggacacaaaagaataagacctggctattgcacctattctagtctcaagggaggaaggtaaaataagcctccaaatctccttataggtttttcaacccaactaagcaagaaggaaagagaagcaacaacttggaaaaaagctttgactggatgcaggaataaatgtgagaatacctagcagtgataggtagaagcaatagaatatagtggttaatagtaccagcttgggggccaaatttgtgtggaaaggttactgattgctataatttttaatcgaagtggctgaatgatgaccctgtatttgggtgtatccaggaacatgcaaattaaatgctaatgaaggcaaatgaatatctctgtttgtgtttgtaattaaaactattgcgtgttttatttttcttatggataagtatattgaatgtgtttttgttattaaattctgtccatggtcatcttcagtgagcaatataaaacaaaatcattagtaaagcctagaaccctctgaaattatacagaaaatattttgtttttgttgttttaacccctgtcagtctccaaaacagctttaaaaaattaatccaaaatattctcccgggcaaggaatcagcattaaaaattttagcttgagagtatctctttcccccaaatttaagcatctaaaaatgaggtcttagaataaaagtgtgtcttcatgaacaaaaatagcatcacaaccacaatactataacgaaccaaaattatatcatagttttaaatttggtgtcactgctgttaacctgacatgtataaaatctgaattagagacatgcatctctagtaaccaagtggattttattcaaggatgctatacatcctgggagaactagcatggaagagacaaatcagcttgtaaagcgatttctagaacattgcttgaggtttctgtaatttaattttcttggttttcactgcattttggaattcttcccaggacagtttattagtacatagactttggtttcagtctctttcctttctcctctttacttttaattttttcagtgaaggttaagactaacagttccagaaactaaattctatatttaactgcagtctgggtgtggttcagacaactgcagtgcaacttgcctagtgttttgccagtcatcaaaaccctgacctgcaaagaacattccttttcctagtcttctgactctgaactatgctgagtgatgatatgatgatctgcagtaatactttcatatgtgtaaataatgacaaaagagactcataggttcaagcttcaagtgactgtggaagatcagtttcttctgtgctcttttatagcaatctctgaataatattaacctgccctattttcctagtgtcacttcctgttattcttttattacctttattaaccacagtgagattttttaaatatttacccaggaagctctctccacttctgctctcatttcatgaagctatgttttcatttagtatattttttcttcttgtttgctttatataatttgaggctttcttgtcatttaaaaatgaagaaataacttctagtaggattttccgcctattaaaaaaacactctacttcttgaagagaatcctgttactttgcaaaatgcaaaaataatcatgtttttcttccttagcagtatcctcagtttgttatggcattgtgatagtgatgctattttgtttatatccttcattattttgtataatgttccaatatttatatcacttatgcagaaatctatggagttagagacccttttaatgtcagtaagattacacctagccagagaaataattagagcagaaatacttataaatcctttctaatattgctcttctgaaacattaaaacctatctggatgtttctttggacagcagcttgtgtcatgtgaacaataagtgacttttgctcttgttgtacaaaaaaatataaattgcatctactgaccactgattccatttaagcagtccaggtgtaagctgagagccttcgtttgatttcatttacctatatttggtcaccattactgcaaagaataaggaagtgaccctaaagatcatctagttcagtttgttgtttagatcaagaacctgtaattcaaagagactaattaacttggttacattcacagaataaatgagattaagttgcttattttgagaacttacggttacgggaaccgtaaaatatgatttgaagaataattctactcattgaacttctcagccctttatcttccttaacttttatgtggtaaacatttattgacggttgctaaggtttagactaagaattgggacacagagatgaggaagacaaaagtccttatttcatttaacccaaatttcttctctttgtacttcttgtttctcttaggcccccttattattattactattattatctttttttttgcttttgttcctaaactcctttctgtatcttcctcttccttaccttctggtactttagtttgccaaaaagacttctggttatttctttttcttttcttttacacttacttcttttaagcacaccctctaccctccaactctgttgttagttttggtgattataatgtaaaactgaagtatatgctttagcatatcttatattttctgaataaagtattaggttccagtttttttttttttttttcatgtaaaaagcaaattggtcaataccttttgtttttttgagacggagttttgcttttgttgcccaggctggagtacaatggcgtgatctcagctcactgcaacatccgcctcccaggttcaagtgattctcactgcctcagcctcccgagaagctgggattacaggcatgtgccaccccaggcccagctaattttgtatttttattagagacggggtttctctatgttggtcaggctagtcttgaactcccaacctcaggtgatccgcctgccttggcctcccaactgctgggattacaggtgtgagccacaacgcccggccggtcaataacctatttttaaaatcaattagtaaatgttatgtaatttcttaaaatgtccttcaagttattaaaattatatcactctatgattctaaataatttcctgtttttgcgtagagcctttgttttctctgagattctgtggctttggataagaaattatttcccaccctagaattaaatctttggaaaataactgattcttagtataacaacatgaacagactaacttcaaaaaacaaaatcacgtccataactaagctctggcagaagagcagttcttcaggactgtgttttaatgcatattctcatgatctatcttaatactttgtttagcaatcagcttggattgtggttccctcagtttttatggttatgcattatagaaatgaaatatcttgaggttgctgcaatctgaaaatggaaagaaattattgttcacctacctttttatcagtctaggtagttagaattgcttccttcttccttataaatgagaaaactaaaaactcaccttcctactgcttagaagaaatcaccttcttttatttttcagtttatctctaaaacttgtttcagtgccttacagttgcaaaaagaacttacatttcattttcttctttattatgttgctgctgaattgagcgaactagctgaggatatcttcttcatatctcatatcaaagagcccatgtgtctgaccaagatggtggttatatttggataggaaattcagcgaatgtttttccagcttctttacattcaactctgatagctttgtagcaagtggctaagtcagtgatgatgaatttattaagtagaatatcattgtaagatgacagatatggcctatgtaaatttgaagaaaatataaatgaaataatgttaagcaaaagaagaaacagtatattattataataacgtaaaaagccataaatatccaaagataaatattgagagaaataaataatttaccttatatatttaatagtctgtacatttttttcttgtcattttttttttttctgatgacatagtggttaaaaacacagactttggagttagaacaactggtgctccaggccctaccctcttactcaccagctatgtgtccttatggaaattgcttattataaatgactttaataaccatacctatctaataggagtactttggtatggctttaggaacataccttttctaatagtgttgctcctcaacactgtgccccgtgctgaggagtgtggaaagattagctcctagccctggcaggctcagtccattggaggagtcaggttaaaaatgtcatgcaagagatgtgtaccaagtacaataaggacacaggagagtggtgcaaggaaaggaaaccctgaggtgacagtggagtggggtcctggagagcagtacagtttcaatgaggtgagaagaggaagaatgacatggccagtagtgggagcaccatgtgcaaaggcacagaggctggaaaaatgaggctgctgagtgtctgctcagttgggtgggaaatgaggctgagtgagtaggttgcagccagattgggaatgaccttacattgcgacatttgcaacatttgtctttcgcaaagcatcctatttgtatctatgtgaagtaagttcttttaataaccaaaaaacatttttcttcatcagtttttggggttgttggtgccacttttctcccagatataaaacagaagtagtaactctttcatgccaatgattcaaacttttttgggggtgagaggaggggggtggattttctgttaatatttgtaaaacatcctgggaattaaaaaattgaaactgttttgaaaaatctttctagccttctttaagacagaagcctaagtaagattctcctttctacatgatcaaggaaacatcttgaaattccagtcattttcaattagaaaaaaaaaaaatcttttgatcaatttttttttcctgctgatttgtgttacacaggtacattgttaacaaaaattataaaattcagtttttctttaactgacttctattataaaggtgcattgctaggatgaaaatttgggcaatatctttgccagaatgaattatttcaccatctgctaagtaaagttgacttggtatttcagtggtgcagtttttatgctcctttgggctagggtttggttatactcggctggtctataggctggcatagtgctgtatgtaaagtctgatattacagagtgtcacttgaacttgattgaatatttaagaagatcctataactttaacaaaattagaaaatattaccaccctctttcccccaccgtacatgttagactcaaggtgggagatacggtagtgcagtattttctaattttgttaaaatcgtaaggcattcaaatcaattcgatgattgataataataatcaaaagatttaaagtgatccaatcaaaatgactcaaaaaacaggaaaattacttttgaatgcctcagtgttgttttccttagaacattatatcattctcatccattaaaaaaacattttgtgggagcagagttgagtcctttaaaatgtgatgtttgtcctggcctataatgaatgaggatgtaaaacgtgcactctgccctcccttaggctgttttgccaccaccgcaacccctggcaagctggtcttccttcctgtctcttctgatgtcattgctgttctaagagaacatgctggaagaatacactataaattttgggattaattatgccggaagttgtattttaaaagaagtttatcctcttttatactccttatggaatgactcgggtggaacataatgaactacacctcctgtatctctctacaaatagaaggcagttcttaacatttaaatagacagcaggagcctggacatgacctcatttcaatccattagactatttgaggaaaaaacaacaaaattttcccacttattgacaggtaaagttatcccaatccatttctcatagccagtaagaagatgaactgtgcttaaatgtattttaaaattggcaaattatacttcctggttcctttttggtcaaacagaaatagccagaagagaaattatcatgatgtttttgaggcagattaaaatttttctctatcctcatagagatgctttgctagcagtttcattttgtacaaatggcataccccttatttctctagtccccaagccaattaaacagggcaaaagaccccacgttcctcatacaatgttctgtggccgcagtttacaaataaatgaagcacagttaggtaaatactggtgttgtatataatgagtgaccaattaagtatatgattcatcccagagcagaattctaggcatcatattataaacattaataccaagggagatcaacttatagacgaattggaaaatcttcacagaaaactagtgagccttcaaaaactcaagcaaatatttattgagcttctactttgtaccaatcattgtaatagataactgagcaatacagtaattaacaagacaaatgtggttctggccttaatggcattaagaaatcattattgttatactaaacattcacaacatgtacagaggcttatatatgtgtttggtgtttgaagatctcagttggtaggatctgaacttgttggtgaatatccaagtttggttgaggaaacttgaatggactgtgttagtttagtggtaggaggcatctaaaagtggtcttagagtatactttgaaaacctaggagtcctgattatagtagtgtctcatccaaatattctatttaattggttcctactttgacacgtcgtccatgaaattaaaaggccagattaagctatgtttctgtccttcttgacattattatgtaattgtcatcatcttactaggtttgtcatcaaaatatttttgctctgcagtgtgactgtgaagaaatttatttagcttgtatacaattggtaagataactttccagctctgtcagtattaatataagtagcataatttttggtcaaatgttatcagaattaatttggcttttcaagaggcaattgagggccaggcacggtggctcacacctgtatccagcactttgggaggccaaggcaggtagatgaccggaggtcaggagttcaagaccagcctggccaacatggtgaaaccctgtctctactaaaaatacagaaaaatagccaggcatggtggtgcatgcctgtaatcccagctacttgggaggctgaggcaggagaatcacttgaacccgggaggcggaagttgccatgagctgagattgcgccattgtactccagccggggcagcagagtgagactccatctcaaaataaaataaataaataaataaaggcaattgaggactcatttatctatatcctggtagtttgattgactcccacctaaaacagcagcaaacctaagaaaaaagaagtagaagtctaggtttaagaaaaagtaataagtacccatgtgtacaaagtattgtgtttctccctccgccttcagagatatatcaagataatcccagaccagtgcacctctgattcttaaaagaatctatgctattctccatgcttggtttgctgcttgttgagagaaagaatttggattgatccctgggaggaccagttctcattttagatacagacaatagccttttagtcagaggtagtcattttgcagaagcatagtattgatcataagaaaaaccatgcaaaaaaacaatggattgatccttatcaatcctgttctgttgatctccatgttataataattattggtcagtcgtgtcaggtttgtaagtgaccagtttataattcagcacttttaaaaaaaagaatagtctccctgccttgggacaccttgtacaccaggaataagaaacttaattctaggtcaccttacaaacctctttggtaaacctacctcctaccagtgaaggctgacaaaactgagaaagcaagatgcagctgccatctagctaaagtggagcaaatgcaggaaggagtatactactgccattgccctaggagtttgtgaactggttaagtgcagtttactcaaatagtagatgggacttaggtaccacggtttccgctggtatgaccttagttgtcactcacatttggtcgtttcattaggaaactaggaaatccacagactagcaaaaccaaacactgccctcttgtgcatgttctttttcttcattatttaaataaaatggagagctaagcaaatacttgctaaattcagcggtagtcaaaagacatgtttcaggagaaatactgtttctcagtttttctttaagttggttcgaatttgtcagttttactgtttttgtgtgacacctctagaaaattatctccattcttttcatgttcttcatagacatgattaaaagataatacacattaaaaggaaaaccaattgttacatagtaataagactcacaccaaacctctaatatggtaagcacttcatttagggctgcatgttttaggacaagtgatagcctgtattgtttcaaaagctcagtaataggataaagtgtactaaaaactcaccttctaaatccagtgttatgcttgacacctgtttatcaattggcaagtggggtctagtggcaattagcatgctgcaagtaaatgaaacatttaaacatagagtctttgcagtgaagggcctggggaaagaaaaactttatgttagggcacatttcatacatggtgtccataattcttattctcatgtatggattttttttcttttttaaacaagtaaagaaaagcatcctaccatcctgataatgatttggaagctttgttttctgctagtgcctgaagaggcactaactcttctaagataggttaactgtgcagtagacagacttttaatgggtgttgatgttctgtttcaagtgagaagtcccagggtttatttaattctcctctactcaggaaaaaaggaaggtcagtgttatggttgtgtctccagagcaattagatttcctttcccaaagaggaaaaggcaaggctagatgagatgtaactgtggtccttgggctatcatgagtttctttctgataccgtcacatctttgcttccaggaactcttgtgaaattaacaggaacttggtctaggtgattcattgacacagagattttcattacatatgtgagatgaagtccgaaacaataccatgtcttagctgagtagtggctgttcctgagccagtgaactaataagtcaggaaacctgagttataagtcatgtgaccttgagcaagtcagttctttctggctcctcatttgcaaagttcatgtcctcccctgcaaaataaagaagttttcagcttaaaggtctttgattctttgtcagatctactctgttacatcgaaatccaggtgtaatgagctgtgttatgcgattccataggcatttgtaaattaggcttcaagaattcactttctcatgtgaatcacttcctaggccagtactaatttttccgtttagtactcttctcttttcacgggctattctattttaaaaccttaagatgctgcaaagtcatgaaaacttacagaaactcatgtatattttagcttgtgctcacaccttctgaaaggttgatatggacagagccattatttattttattaagtctgtggagttaaaaataagctcatctgtaaaaaatacattagtaaagaacatcttttgtttgttatacctcagtgtgtttgcaaaacaaacttttaaaatgcaaattggtttgttgctaaaagttagcattaagataggctaaagtttattatttaagaataattttaatctaattccattttgccgatactttaagacagcaaactttattttcaaataatgcttttccaaattataaaattagcacgtgcttaatatataaaattgagggatacacaggaaaatataaagaaaattaaaatacctcttaatactaccatccaaagatagtaattgttaacatttggcatatttcattttagtcatttttctgtgtattatgtatacatctacatatctttttaaacaaaagatggttatgccagatatgtagttttatactttctcacttatatgatctttgaaaacatgattttcattgactaaatccattttaagaatatcctcttatttagtacccagtccctggtggttggatatgtaaattgttttgtttatttccagagatcatttaccacatagatactctcaaataggagatgggacttaggttctaagtatgtttaaagctggtttttttccttcttctgaaagagtaatctttcttctaaaagcaggcctttcctgcccactgcccagtaagtttacttggtgatgaagaaatacacactgaattgtagttagtgggaaatgtctggcaatcctaaaaccttattttggataactgaaatgatgagggtttgaatatctctttagcagagatagttcacatgaaggcacagaagaacatgttcatttacatggcattatcccttgcttggagagtcagtctctgtcttttctatatgttcacgcagacacaaaaggaggaattatttggctgcaatttttatagacttcagtgttattgaaatgaaagtggttcaaggacatttccatttgttactagcttatggtttctcatctcttataaattattttgccacttttcattttaattctttgttgtcattgtctggcaaaagatcatttggtttctccctgtgaagacattcactgatcactcagccgacagtgtcctttgtaaaagtgtagtgccctctggatttattttatcatttttttattgctacctgtggacttttgtttatgcttcttttctgttttgtcttagaaaatgtttagggctatatacattttatatggactagaagtatgttttgagctccagagtttcatttcagaaacaggtcccctttagagtccaatagccaagttctcctacagtttatccacttggtaacagaaatttctagtccttcaaaataatctaaaatgctggaaggttaataacagtgtgtactgttcctagggctgtcttgaatgcattttatcaccattccaaagcatctcttgaatctcacctttcctttctatgtccaggcctcagcctatttgaggccttctccacagccatcatcacagctgcctaactggcttctgcctctaatatcagcagagatattgccctacaaaaataagtttgatcttagaatacctctgctttaaattacagctcccagttgcctagaaagttaactccataccctttaaaatctggacccaacctttcacaaccccctgtcatacactgtgtattctagccacactaaactccttcccatttttggaacattgtaagctctttcatgactctttcactgcctttggacatggtgttgcttcctctgcctgacagcatttccctgtacccgccctctctgccctgaaaacccttgctctttcttcaagaccctgcccaagtatacactcctctctgctactgcagtactgtattcataaaactaatataatttcttttacagtacttcataatatcttctttacatacctgtatctcctggtgactacttggggaagctttgtctggttcacctttgccaccatttagccaattgcccggtataaactaggactcaacattattaggtgattaaaatgaatgattaattcagtatattcaaaatcaaagttattagatctatttcccgacttcgttggcagctcattttggttatatatagctcagaaataaacacaaatatcaaaaataaacacaaataaaaatatcttaggccaaaccaccaaatgtacttagagaagataattgtacaaaatggtgaaatcctcactttctcctgagatagtctgggttttaccaaaagtcttaactgaaaccactgttttctgttatcacctttgtttccttttcccattcatttattccctaatgtattcatttattcaaccatctgttgattagatacttactgtctattatatgccaagcatatttttttgggcttaaatacctccttttgtgagtagatagaaaccatagccatcttcctcttgatgcttccttttttctgagcaactactatgtcctccttgtcagagcacatgtgaaaaagactcagaggattttagtttacattaaattcagatatgtacataatgtagtgtggtcctagggtggccacataatttattgtccaaagcaggacactctgggggattaagatgggatttgttaataatccaagataacagcactatctcaggcaaaccagggtgtatgaccacccttatgtaagccctatagtgtaatcagatcacatcactagttgccttctgtttttcaagtatgtcttaagtttttatgccttcatattttcgtctttactgttaatgttgcctttgcctctccaatgcctgcagcctgtgcacccctcagaagcctgcctaattcaatgagctttcccagatcagcccagtccacagagatatcactcttttctgaatttaacatgttgttttatacttaattagaagatagatgcattttgtcagttatgttttggctccttttattatttagcttttttatatcttcttctcgaaccataatcaaggcccatattttgaaattactcatacccctcaagtacaatgccttatgcatagtcatgtaatacatagttgtttgctattttatttcctggtctacctttatcttcaaaaaactcttctacttatatcaatattgtgtgtcttttctcacaaaaaagttttaagagttttgcagtaaaaaaatcttattactttttaaacttaaatatttaccatgaggtactataaatgtcattttatcagtttagattatactgtatatcttgaattaatattttttaaacattgaaacattacagaaatagagaaagaagaaagttgtgctaacagtcctttgtatacacctccagctagagtagcatgtttcaatgacaattcatattttttaataggcctacattttttaattacaaaaataacaggtctttaatagagaagaaaggattaattagttaccaggcttagagatttaaaaccatattgaatcaattcttattttctttagcctttgatttggagaaagttactgatttccttttttactctggtcttctttattttatatggttagatcctaaaaatacagattaattttaatctttaattaaatttaattaattttaaacctttttaactcagtacaaaaattatgtataccatgaataattgcgaattctagtttagcttccagagatagcatggctttatctatttgttacaagaacagaaatcacaatcctaatattttctagctggtccaaatacactttccaaacataaatagttacagaattgtattgatcattaaacgagttcttaaatattgtactgtctcccccaagttctcttcttaaaaagtaatttataaaaatagcatgtgtttatttcagaaattcaacagagaagcatataaggcagaatgtcattttttttaaaattttttcttatttctccaagaaaaagtgaaaatcattcttaattgccaccagtattttcctgtttttgcccccatccccaacactcttgcttcttggagatagtcattgctaaccccttagtacgtatccttcaagatccgttttgcaatacctctttgccttctcttgttagcagttcatttactgtgagatccatttcttttggaggcccccacactgggttggtggtgcctttgtctatcattattggctcgtcaacactatcattagtggggagcgcgtgtgaggatgattcagacttgtaccctggcatcaggtggttttcagtgtagtagaagacagatgtatacagtgataactataatacaagatgaaagatatgtaagagaggaacagatgaagtgcggtgggattcatagggcaaaaaaaatacctttgattggccaagaggtgatatttgagctgtaccctgaaagatggataagatttgcactgcggggtgggggaggcaaaaagctgatatacttgcaagagaaaggcacagagatgcaaggagtttacagagttattccattttcctgggtggtagcatgcatatatgggagtagcagataaagatgtagaggttgtttggggggggactttgaacacctctataataaacctttgagaatttctgaacaggatagtgactagagatgtgctttaggaatattaatcaggcattggagggggtacagtgtcatcacaggctttgcagtcacttggaagaaaagttgtcacaatgaggtgcactggccaaagagctatggcttaaaaggaacccgtaggtcttagcaactactgtatcccatcaaatctaagaaggccttgattgtaagacacaccttagttgacgtaccagtaagggagacaaaacaccaccaattataaaatgcatcctgacttcggagatcacaataatgaagaaatatgtattataaaaacagtgaactaagatcactgtatgggcacagggaaaagatgagatatgcaggaaagaaaggagagttgagaaaatgaaaggaaggggaatgaggtcaaagacaaaagcggagaagttgaccttgaagaggaggagaatgcatgcatcttcctctgccataagatgaatgagtaatgctcagaacagtgtacaagttgagaagccaagcaattaactcatattaaataatctccatcttcataagagagaaagcaaggtcatctgcaaaaagtgacagtggtcagtttgagggcttggggtaagagagtgtaaagttttcaggtaagtggggcaggagatgggatatgaaaggcaattggttagaaaagaccaatagaattcccaacagaaatgagggttccagttaaggttgaaaaatgtggatttattaaaaaaaccaattggccctattttatgactttgtccaggaacacttggtcccctgagagaaggatggaagaaaataaatggaagttgctttctgcagggtaggagattggctggacaggtatggtggaaggacagaaaagctaaacaatctagtttctcctaagggaagttgctgatttcgcatgccatggagttcaggctaagaaatgagaggtgaagcccaaagaggaaagataaacagagattgtttttgtttttgtaactgatgggtggggggattaagcagttagagataataaagaaagtgaagaacaaactattttgaagaggaggcataggtaaatacaaagttgactggggaatttcagaatttaagatcatggaggtagaattccaagggttaagccttgaagataaagtgttgtctttctagaaaacagatgggagtatatctctgtgtatcttggaaacctctaaggcaccccgtttatttcagtatgaagtcttcttaaggaacagacaagggtcttcacaagctggccccatcccacctttccaggccagtatctcatcattgctttgtacaagccccatgttctagccacatttaactcttctctatgcccagagtcctcaaaagcttttatctaccattttgcctttgcacatgctgttcccttttatataaaacgctcttcctcctcttctctgccttgcaacctcctgtgcattctctagacctaactcagatggcactcctcagtgacgcctttccaggctcctgccaacaacactgaacacgccttcatccatgctgcctcagtgctctgtccatacatcctatggcatttcaccacaggatattgacttacatgtctctctgtagtagactgtgaacacttcagagtcagaaactatatcatctttctttacccacagtgacaagcacatattaggtacttagtatctgcttttcgtttttgtatattttgtgtaaatgaactcatccagtacatctcagaagttacgacctgtgcatttaggtcacctggaaatcttgttaaaattcagattctgatttagtaagtctgaggtggggtctgagattctgccattctaactggctcctaggtgacagccatgctgttagttctcagagttaatccaaagcatctcagcctaagtaaataggcatagggcagagacaaaagccattagaaatgtgcaagtgaagcaattatgagggtagtgacttggaaaaatcctccgtatgaacactggagtcccagaaatgataggagaaaatcatgcaggaagagatgctcaaataaagcagaagaccatggtggagggtggtagttgacaagactgggaggatatagctctatgacttaagttttacagaagaaaaaggtggttaggtgggggcagctgctgtgagtcaggactgcatcagatgaggttaaataaataaataactggcagtgaagccatgccctccaaggaggagtgggcagtgagaggagggagtagtgttaggagctgggtttgcaggtgatcctcaggaagggctggggcctccagtgctattcacaataggatggcatttccaccaatgcagacaggagtgctgaaggcataagaaaggctggattacagcgaaagggaaacccctgaataaatggtaggtgctagaatttgacaggggcccatttcctgattggaagtttccaagttgaaaccatgaaagttctccttttctttttttaaactcatgggtgactgaaaaagtagcactaataagcattctgttcccacatgcagtctgatgggtctgagaattctaaggatgggttcagtaaatttattttttaaagtactatcgtactttaaaaagtgcaaaagtaatacatacttttttaacaaatgaaaaagaaaatgtttaaactcctcccactaagccccctccccacaaatcagtaactggtatttaagcttactgtgtagtcttccagctttcatctatgcaaacttacgtacacataggaatttttaaattctgtaatggtattttcatattattattggtataataccaatattgaaaataatggtgttttcaatattattctgcggatagttttcctcacttagaaatatgtcataaacatccctctgggtcagtggacagaactctaacttattttttcctactagttttaaatagctacatataagtatagatatcccataatttgttctgccattctactgatggatacttgggtaatttccaattttttctactacaaacaattagacaataaaaaaaagtcctattgttaccagtgcctaaataatataactctgtgacttgaatcagtcacacatatcaaaaataacttccatatcaatgacatcttttaatgaagcacagcagtatgtagacctgttttgtcccatataatagccactagtcacatggaggtattcaaatttaaattagttaaaattaaataaaattcaaattccatccctgacattagcctcctttcaagtgctcagtagccatttgtgagttgtggctaccatactggacagcataaaagattctactctcacagaacattccatttgacagcctggacctagacacttgagtgtggcatcttacagaatatatttttcagtgagttagtgttttaatgagagtatgtttgaaaaataaaaactttgtgtctgtatcggttgcctctgcagttacttcaatgagaatcaatacccagatgaagcaaagagggaagaaattgcaaacgcttgcaatgcagttatacagaagccaggtaaggtcgcaggcacagccttgctctgcggtgcagcacagcgcttggttacaggttggcatctaggacacttaatcttatgcgtgccttggcatggtgctcccggctcagtctgtgccatccttccgcaggtggccagtgccctgtcctgctcacacagtacttctgagggatgtttttatggtactcaaaatcaaatgctcacataggagagttttcaaggagtgaccctacatgagatatgagaccttgaaattactatttttttaatgtgtagatttccttttctaagaatttagctaaaagatattatgaaataatgttaaagttttaaatatttaagcaagctttgtcaatataagattaagatagaattttttaaaacaattgttataaattgtaaaatgctatatttctctttggggaaagaattctttttgtagttagtttctatctcctttccacattgagatgacttctacttagctaagaaaaatttagggcagtaccattttgaagtcctgttgttccaaagtcaacaaacccacttaaatatttcaaatgtattttcttccttgtgctaaaatattatttcacattttacagattttgttaaacataaaccattttcagttaacagatccagttgatttccatgtggccagttattttgattggcctaaaggctacatacaaaagtatcaatgttttatagaaattaagcagaccttcattctccctcacccagaagccagacttctagcaatgtagaccctacaaactgctccagtgacacacaagtgaaaggaatctgtaccctgtttcaaacatgccaaaagtcccagccctaaagctgtgcagaaacttgaactctccctggaacattttgcccccgtatcatcaaggccctaacaaacctgctttctggtttcttcacccactgtggattaatagccgaaaaacaaaaggaaaggtgaggaggaaatgttacaggggggtctgtattggcaagcatggttactatccataaaaaatcacattggacttcaaagatggtaaatctaaaatgcaacttgaattgtgctatgtagtccaaaccagttacagtaatggatagtcatagcgtccttcagccttcaagaaaacatgtataatatcctctgtcctaagacagcaggtaattagttaacataaggccttaaagatgtaagtaaatttctgttgtctggatacttgataaagaataacttatcttgggttgttgtggtggctcacgcttgtaatcccaatattttgggaggccaaggtgggcagatcgcctgagcccaggagttggaggctaccctgggcaacaatggcgagaccccatctctacaaaaaccacaaaagttagcctggtatggtggcctgggcctgtagtcccagctacctggggggctgaggtgggaggagcacttgagcccaggaggtcaaggctgcagtgagctataattgcaccaccgcattccagcctgggtaagagaatgagaccctttctcaaaaaaataaaaaaagaatatcttattctgatacaataatggtaattaaatgaagcccccatagtactgtcacatggacgtggatctgacaccctagccaactgactttgtggaattctctaatattatgtatggctttccgaattgaagcatgttgtgttactagttgttgtttttgtattcatttacatatttattcattcagtaattggggtgtgtacatggtaccaggtaatactttaaaaatccctctgcatctgtagttttggcaataaacgtaatcaaaagcaacaaaataaaaatattagcccttaaaactagtttattcttggatcccagatatagattatctgaattttattgcatgtattcacaggcaaaaagctgtcagatctggaaagagttacctccctgaaagtatataattggtttgctaacagaaggaaggagatcaagaggagagccaatattggtaatgtatcagtgaggctgcttttctcttgtgcagcagttgtgaacgtcatgtttatattaagattaacttcagtttagaaactgcaagtctaaaggatcctaacttctcttttttttttttttttttttgagacggagtttcactcttgttgcccaggctggagtgcagtggcgcgatgttggctgactgcaacctctgcctcctgggttcaagtggttctcctgcctcagcctcccgagtagctgggattataggcatgtgccaccacacctggctaattttgtatttttagtagagatggggtgtctctatgttggtcaggctggtctcgaactcccgacctcaggtgatccgtccgcctcggcctcccaaaatgctgggattacaggtgtgagccaccgtgccggatcctaacttctaagcctaacaaaagttgccctaatgtctttcattgtgtttttaataaaccacagttagtattatttacactatttgtagtgtaatggtaatgacattattatttataaaactcattcttcttaaagttctagaatatagaattagacatggcccctgagcaattgattactcctgtggtacatttgaaagatacttgtaagatcttgagaaagggaatgtaatacccagaatttcttcattattactggactatgacttaaatattaggaaacaattgattaatggtttggaatgaaagagacttaatagacaaggaacgcagcaaaaggcagagataaagagcatttaagaaatatggattcttgatgtaatcatttatgtatatatacacatatcaaaacatcaccttgtacaccataaatatatacaatttttattaattatatttcaataaagctgaacagagaaaacaaaaatgccaaaagtgccctagagggaactacgaatacaactgaaaaaggaagaaataaaggatttgttcccattcaaaactgtaacagtaataaataagaataagaaatttaagttggtgagtcaggtgggatgttggtttttagcttctaaaattgcatttcatttcttccatccaagtactaaccaggcctgaccctgcttagcttccaagatcagacgagatcgggcgcattgagcgtggtatgggcatagaatgcatttcatttccttcctttgtaaatacactttttattcatcagtacagttctcatatgctctatagaaccccaagataggaagactgtttagttagttagcaagtatttatgaagcacctaacatgcacagcagcagagaccccagaatggcaaatgtgtgcctcccctgacctacatgcagttgaatttcatccatcttacagtctaaaagaaacaaatgtagagaaatacaggttcttgtttaattacattctaattaatttccttagcacaaaaattcattcagtgtttcagccattgtgataaggtaacagataatttagggatctatttgcttttttcgaagaagcagcaatcctggagagtcatgggatagatgtgcagagtccaggaggccactcaaacagtgatgatgtcgacgggaatgactactctgagcaggtgagcccctgcgcagctgggcgaggttcttggtgcctgagcagggggtatagtgggacagcttagttccttgggtgtggctgatggggtgggggaggggaaacagtcactgtccctccactctgctcctgtgtctagttagatttcatgtaatttgaaaggaatgtggtaagattcagttgtcctgttgaatttgtgagagatcgttattcacccacatggatttattgtcatacaacaggatacttggcaagtacgcaatggggaggaggaggagggaagaagttcagagggaggcagagaagcagagaaggtagaagaagagaggaggatctgatccaaacaagcaagttacaccattcacgacacacactcagtgtttgagaaatactaggggcagctggaccccatgcctaaacacgtaccgacgcagggcacgatggaaggccccactcactctggccccactgcagtgggaaccctcctgcccaaaggagtggttcttccagagtctctggcacactgacacatgcatcctctcataagtgcaatacctgcatgactcttcacctcgccctgatttattctgcattgcttttggggaaaatgtatttaattgtagccactgcgtggagtaattcagtaactaagactgtgggagtccctcctcgacccccacatagatgttgacagatttcattaaaattttgataggatttaaatttccatttggaatatgcagagaacgcatggtaccttcccctagaccacagcaagaaaacttctgctcatttttctggggtctgtgcttttttcttgctcctcagccagctcatatagtccaatgtgttctttaatagcctctgtttaccacacacctagaatgcatgcaagtgtgtgctgatccctttgtaaattctaaaaactaatctgtgaacatcagaaggaaacaatgatgtccacacttctgaagaactaccattttttcccatttaggactctagttaatagccccaagagaatattctgtaagtctttctgttcggaaacattcctcttttcagtctacccacatagatggatcatttccatctttttttacagatgccctaagggcagcacattccatgttttgtttgtttttttccttaagggacttaccctttccaaagctctttgatacggagttcccctgaagatgacaggtgagaaacataccccttatttgtaacaccatcttcagtgcctgacgtacatcctgcaatgccagcttccttcacagctttattgtttaacacattgagctgcgcggggaggacagcttcacactagttctaggtaagacgcctgccgctccccttgcacagctgcctgcagcaggagagctcgacaccttcctcccctttctcccgtagccgtttctggcagtgacatgtgtcctgttgtaatggagaattctttttttctttttttacaaaaatgcattttttatctgtaagatgtaattgtaagttctgtctagttttctcagttcagagagggaccatgaattctaataatctatttgtaagagcagcaatctggaatttaatagctcactagtatggccttcagtgattagtgctatatttgttacaaacagaaagatccaaattgttggttttatatcaatcactgcaggtttgatcatcatcaccagcaatcttattaatagaatgaatagaattctcagtgatgaaaaacattttttgtgctttttacttgttgaatcataagattatcaactgaaaatctttggacctatatccattcagtgtctacttaaatacaatttacctctattttatcatgagcccctcccccagtttcctcccacgaatgttctgcctccccttgccccagcatgtctctctgtgactaaagaattcttccaatccactaataacatttcttatttctgcacatctaggatgacagtacgagccatagtgaccaccaagaccccatctcattagctgtggaaatggcagcagtcaaccacactatcttggcattggcccgacaaggagccaacgaaatcaagacagaggccctggatgatgactgatcagggaggttaaacatgacaagttaacttagtttagacgtagcaccttagcagactttcctcggtccttaacatgtgttcttacagtataacttgcagtttcttgtatgtcaggtagctgttagggtcttgttctgtgaagatggcatggtgccctcagcctttgcatatactctctcagtattaactcccagtaaataataaccaaccaaccaaccaaacttccctctcccagcccccgaggctagaaaatcttgctgctccgtcttagcattccaagaaagtgcttccaggtatttagatagccctcagttctcaaatattagactacgtgtaaaatcttgggtacctttagattcttgtaacactagtctgtactcccttttccttccccaagactgataggatgcaagctgaggtcgtggcacaggaatgacagacaccatttggggagtatccacagagtcaaaggaacactagaatccccacctcagcgtgaggataattgatttccagctgcaataagccgtgcctcattatagccacactgtggctagattatacttctttgggtgctgtgctaagaatgtcaatggaaaaagccgatctcagattttgtttgaagttaacatgcctgacacagacatcctttcctctcacaagctgtgtgacttagtagataaaatactgccttctgcctttgggaccatgattaaaaacaaagacaaaaaccaaaagtcattaaaaaaaaaaaaaaaaaaacccagcttgagagcattggaaaaaaaaaatatgagctgaatgtctaatggatgctaagtccagttttcagaaccactgtacattccacggcacagttagcagtgcctgcctggaaaagttttggaggtcatcgtggaagttgctttgcctcctgtcagtgtcccctttccctgctaccaaaaaagtctttcaaggatggagctaaggtcaaaaatgagtgaaaaaacttgcagtgtttgtatccattaaacggaagccccctcactctgagaggtcactagaggacttcatagtggggttgtgctgcttatcacagatgcagacacttgcccagataggagcagagaaaagcaggggacgtttcctactcacattgtggctgtatgagaacacgatgggactgctttgctgttctctttactctgtccttggagaggtgtgaaaagctgtattgctacaggcaatttatttaataattggaagccatattgataatggatgtggtaatatttgtaaagtttaatctactttaagcggcagtaactaatggaatttttttccttgatcacatatgtagcacttttgttactttttaaagatatttatatttgataaatctttttttcattttgagaactcaaaataccaaacagtgaacttgcattctaaagtcaccctgtgatcaccttgtcatctagtagcaaaatgatgaactattcatgcatcaaagaaaattacatctgctggccttgtatgaaaatgatctcttggcatcccgattaaatgacacactgtcactgtgggtaagaggaaagagccttcaatgtagcagcacagggtgcgcctgaaagaggcacaactgctgtggattttctgcctcgctccatctctcctatgtataatgaagccttgtttaaaggggcatgtggggctggatgttaagcacggcttctttttgtccattacctgaaaacaatttctaagataaaaggaaggtgccatttccttacctcttcacccatcctcctccaccaaatgtattcaacttaaaactgtgagagagagagactgaatgaccttcctcagttttccctttctcattcaggagatactgaatatccgccagtttgtagttggtttccttccacttaaggcacacgctgactgcatcatttccttatctgttaatcctgcttatgtgagtgtgaggaaagtctttgagagggcatgaaagtgccaccttatatatgtctgtgactttaaagagctatatgcagggcctggtcccacttttgtccatggatttcagggggaaaaaatatatgtacttttttcagcttccaagcattgaagtgaagtggagccgtctcttctgttttactgtattacttgaaccaacaaattcaagagtagcatttgttattctcaggaatgagcctcccaccgcccccccccccaccgactcatattcttttttggtttatctttttatttcaattaggagattacgttctcttcctttccttttattttgcttagaggaaatgtaacatagtcccatttttgtggaattttgacgcttattctcaattgaatcagaaagtacaaggagacagagaaaaaatccgctctgacaagccacatccatgattgattgtaaggggattattataattgatagcttctttatcatgggattgctagtatcatttgtacttgctggtctttttaaaggaacagactcaaactgttaagacagctgcagtttctaaagaaatacaaagattgccgtggatgcactcaaaggtttcattgttttaacacctttaagggagaaaaaaagcttcagagaataaaggcaagttcgcatccatgaagggcagtaccagaccctatatggcaatgtggtaaaactgaaagaatatttctaccactgcaggagaatgtcctggagagctcagtgggaacaggaggaaggcatcttccacccacagttgttcttgtcattggagaagaccgctggctgctctgaagacccactgccttacatgtcacttttgctttttcaccaagagtgagaatttacttcctttgggcctagatttaaacctgttagttttctgtttgtcaccaagttcaattctgccattttgtccaggccaccttggttcttgtaatggtgtgtggcgctgctactgttatatttatttctagtgtctttaggtagtatatttctctcttaggctttttcaggttttagaggtggaattaaaatagaaaccctaaacttccgtattactgaagggaaagcagccaggctctaaaaactcacactgtatgcttcttggttgttccgcccctcccgttgtacttcactctctccttcaggccccaggggactcccgcaggggctgttccttcctgtcgaggaggactttcaaaggtcttttgaagtggggtgtgggggaacttgccaacaggtattcatataatttgttatttctttaaagacaccttaattgaattactatggtcagatgggtaaactttccaaactttaaaagcactgacacagggaccttttaaaatgggtcatcttgatgagatctctgcccatctgttgataaccctaacagtggatgaaggctggggagggcaacaccctgcattcttatctgagcccttcagtgctattcagttccaaatgttttgatttgtttcaacaaagtctgtaatgttggagtgcccttagagcaattttcttcacaatcaaaatcacaatcctttaagtggttaataaatgtagttgccttccactcacttatgactctggacagtccccacccctgtcactcacaagggcagtcttcccaccccacccccatattcacattcccatggcccatcacaggaagaaggaacctggggcagagacgaggaaaatcattaaggcagaggtgtacacatccagttctctagttcttggtagatttatggtggcagccagttcagtggtcaccaccacctatgttaggtccatgtatccagatatattttacctcaaaggagatgactgaagaattcaccaatatagttattatttcctttctgcctgtttaacatttgtctttaagaaatattggctttagaaacttctcccttggatatcaaccatcaggcaccaagtacaaacagactcattgaatcaagagtctccagcctcatcctgtgaatagctcctcttctgtttccctctgactaggccttcagctgacttctttgctggaattttctaatcttgtgacagcagggaaaagctggatgtggtccatctcttaacacagacactcctccctgtcttgaccagctacgtattccactgaccagcctcatcatctctgccctcaacagtggaaatgatctctttcccacagatgttctccctccctccttccttcccttccccttcctacaaacgtgaactcttaagtctttactctctggtcttcagaagggtttggttacaagcagtcttcccatttaatttgtggctctgccttttaaaattgttttttgtcttttgttgttcagagaacgaccagagtattttctccccagtgtgtcccaacagattcttaggcaataatttttcttgttgatgatcccgtgctcagtagcacactacattgaagaaccctggccctcaccattgtgtgttggtttctgtgttaatctctgtgatctgaatcatgtcagagtgatgatagattttgtcattttgttgtgattattagtaatgttttactactgtattcattggggctgtgttgagaccagccaaatccatttatagctttactgagccggattgatttgtcaggatttcccaagtgaaagttgggcatattgcccagctcctgctggtggtatctttggggagtgtgggatggggtggggggatgtcctggggcaggggtgggaatgacacatataaggcattccattttttttttttttttgcttgtgcttattaaatagcaagggtgtttactcaggatttggggatcagttgtagccatgttgaatttggcaaactgagctgtgtgccctgaaagccctctttttatttcttcatttccatattgtctgacttacttcacctaggaatacctgagttatccagtccagtgttccctgatgagagtggaagattttcctggagaggcagctgtgcatggccaggtcatctgtcaggatgttgtggtggtgtgtgatcagagcagagggcctttcttttcctgtactgtgctctacttccttatgcatgcttggtttcaaagatgaccgccactttaaaagaaagatttcctcacagctctccagagaactatcatactaaggtgataggaaaggcttctcggatacaagccaacaagtcagtcttctgattacagaaactcctctcacaggttatgtttggaaaggctgttctccattccacttataaattgaaagtgataagctactgtcttgtgatcttgcagggccagtggttgactcatctctgaaaggtaacttcgttcatatctatgtattttcaaacctggaagcttgtaaattggaagtttcagtattagctttattattctttcttggtgaggaatagaaatggcagcaaaaagaaagccaacaatctgaaaactccagtctcctctaacactggctttgttttaaatcaagatgggaagagatacatgaggggtgggagggaagatatgccggctgccctttcttatctcagtgacgtagatgcctcgggattataggcacgcggatcactgaacctcttttttgtcattcttcctatgacatttgtggcagaactttttagttgattctgttcacatgaaatgtgacaagcatttttacaccatgagacagtttactacccacatgccacacccattgtctgtctcatcagccagccccgtaactgcacccagaggggtgcagctgcaggggagctgtgcctttctcctctcctgacactcctttcacgtggcaggtttgcaggttggttggccctggtctggacagctgtgtccgtgcctgctcggctgccctccagttggtcggtgtggctggcgtgggcatgtaccccccgactcgcacttgagaagtcttgggatgccggctccctcgactccattttcattttaagtaagagtggctctgtatagccataattaactctcaaattcacattggtgtgctgtgatcaaatgaaggttggactgaatcttttcaaactgtaaccatggtaattgaggggggtggcatagaatgaatatataaaaatataatggcaattgttctgaatgactgagtgtcctcctgacatgtaattagctgttttagcaggatgtagattggcatggtcataattaaaagaatttctgtcttttatgtgattggaaatggcagcgctcccatcccctgttccctcttagcactaatgctcccaagaacatttggaacagcagctccataaactaaaataatgacatggtgctcgtgttctcccctaagtgaaacagcagaatttggagttgtttcagcttcaaaatggaagcctttgattattgttccccatttgacttctaagttctttgaaacttcactcaacatccagttccaacttgctccacctctggcagaaaccacagtcaggaccccagaagaagcccctctgaccggcccccactgcattccagcccatggtctggccagctccgggcccttgcttgcctaactcgaggatgttgctgcttgctgggctctctgggatcttcagatttcccttggttgcttgatatttccattgccgtcactatcagaaagcatttcccaaacagaagtttacagaaaattgaatcgaggtttcctcattgaatcctaagactcaaagcagacaacatgacaggacacatataactaacacaggctttaaacaggtggaggcgtgaatggagtactattcacgacattctaaagctactggagcacgggacacgtgtctgtacgctcctctcacaccccttactcggcagctgccccactcccgccgttgccgttgccctgagtcttccccactgttctgctgtgccagtgtgagcatctccccggcactcaagtccatgttctctccctcccgctcttcctcctgtctcttccatgctccctgttgcacgggacatcatgtgggcttgatgccgtacacagtccctgaccatggccccctactcttctccagaagtgtcacactagacaggagctgctgagtcaccaactcacctttccctagaatgtgggtttgttttttctcccccatcacttgcagaggtcttttttcaattatatgatcaagaatgagtctacaagaataccagcaccagacatagtgccaaatggccttttgtaagctgtttcgtgcccttgaggctcgcacttgtgctgggtgagcccaggaccgttagccttttcttttctaggtctggacactccggggttggttaggctagccactggggagaatacagctctggccttttttcatattttgctgcttctctttgtacagatctttccccctccacataccaaaaggaatcctaacctagttgaaatgctagttgcaattcagtttcatgagaatgctgaagtaggctgctgatttaaaattttcctcttccctgaaaatacacacacctagagaatttagggaaaggctcttagggcttgggaatcttatcttttcattccccacaaaatacctacaaagaaatgtctagtattccctcagtattcctcctcgtataggctctgaaagcaacctcattcccacccagcccttgcacaccggcattcaagatccatgcatgcagttgttgaaactgttttctttgggatcctatctttatgacaactggaatgattgtagatttatgacctcaaagagtagagcattccttttcctattttcccagctgctaaaatatgactgtctccattagaatttagaatccgtcttaagcttagagatggtaagagctgactggatgagtctaattctatgatttgtgagacatgcattaaaaccgtcagcagaacattctgatgatccacctacactcaaagaaaacacaattaacaccacagttaaaaccttctaatggagcccctgtcttagggatcaaggtattagaggtgctgcttcagggatggtgctacttcaaaagaactgaagttggagagacacctcccttcccaaatgcttctgcaggccactctggtgattcagaaaaccccaaccatatattcctttaccagcagcgcccacccttttccgtaactcagcttaccaaaatcagtgaaaattgagacagtgcttacccatgaaatatgtggtttttgaacaaaaaccccagaagttagttattcttataggaaactaaagatgccaccattgtaaatcataatactacagagacaaatgcacaggtctcccaaccacctcaaagtcaatacagcccatgttttctgagcacgtactgtgtgctgggcaccgtgctggacatgtgtgctgcctcatgacccgacaccaagcaagtcaccttgcccttggcaaggcaagtctcccctcatttctttcatttcagtaggacgttcatcttcaaagaacagaccacataggatggtctgccctctctgaacactaacctggtttgctttctcacgcagcagtgccaggtagcctcccaggcgcactgtggcatcgcccccgcctctgtgagctgaactccctccgtgagggtctggacgtgagggcccctccagagtcttcctccctggtcagtgatgaggacaggagtgcagggaggtgccgcagtggttgacagggtgggaagcctgtgtggccgaggggaacttgaactccggcaccccttgcctgcagttagccaaggcagagaccaggaaaccctcttgcacttcccatcttctctctccagctcttgtagcgctaccctggccgttccttcggggctcctgctgtgttcaggagcatcttgctcagctggcccctcctcctctctagaaaccgggggtctggggttctggaattagatcagtgtctgctctgcctcaggcctccctgcctcctcatgggccctgactgccaagaaataacagttgctggagacatatcttgatttggggtcagcgtaagaactttctagaacccagaatccagcaaaggcatgagctcctttgaggtagaggtctggttcctgtcctgccacatttcacgtggaactgtggtaacttgtcagggacattgaacaagggacatgggtaccaagctgacctgaggactcagctaactaaagttccacatttcttccctccttcccttgtctacctcttttccgtcaaacgtaagtggtcctctaggggttggctctctcatggtctttctcttctgatctgctctgccccgtcgtgggcatcttggaaccacctcagaagcaaggccacagctgtggactggtcctcgtgagagtctccctggatcctctgtacctgtaataggtacacagttacgttattatccaacctccaatccccaaaaagcctccttaatttgaaagagaaaaggtatatgtgccttgcattttgttatcggtccagattttgcatctggtggtggctggggtgccattgggattttggaatgggagcagtttgattcctccctcggaaggaactcatggctctcacaaaccagtgtctgtggcagtgacaagtcacagaatttgtgtttcaaggcttattccttcttccctttaagactttttcaacttcctgtcacttcgggctgagtctcaatttcagtcatgttttgtggcttcctttgagcacagaaacctctccttttcttccgttactggaactaagatcccagcgtaaactcgtgagagtcatttttccacgtcatcattcgttggagctattaagcccgaacacagaatgacattagtgttatactaatgtaagcagcagccactctggtgatgttgcattgaactcttttgttcttaaaccagattcacggcgggcaggcacagagttagaagagtgggctgcaggaagacacgtgctcagcggtggctgctttcaagcagcattgttttttgccttgaaaaccacatttcattatgttagaatcggtgatccccttaatactgcatctctgaaaatgggcaccatgaaaccaaaaccaaagttctggatgtgggggagtggagcttttctttcgaagcactgggagcttgggcagggcgtcccgactgcccctcagttttgccggagcactcggaagggcctcctcttttcctagtagttgcctcatggtgactctagaaagcaagtgtgtgcagcctgtgcctccccgacccatggcgggcgtctagatcaggccctaggagcctccccatccctgcctcttctagccacttcccggggggctgtagagcacggtcacaggaaggcctctgctgggccgagtctgcggtccctgagccatcacagcactggcgtcttcagacacaccctggctgcaaggcaggacactccccctgccgagagacaccatgtgcgtcatcattgcctcccctggaagagcccacagccttctatgatctcccccccgggctcgccctgccttccacggccatggtcacgttgggtatgcagtacttttcaaggataaatttttgtttatgttttttaagtgcctaagcaagatacagacctctggaacctgccagagagtcggcctatgccctgtccccatccctccccaccctgcactggcccttgagggtgggcacagggcggctgcccctctccagtgtccctggcgttctgcaggcagaaca

SEQ ID NO: 1271 - DNA, 1854 bp, Homo sapiens
atagtgacaagtttggaagaaggtccagctatggaggaagttcatatgggaatagtactaacaatgtcccagcatcttcctctacagctacagcttccacacagacgcagcattcgggaatgtccccgtcacctagcaacagttatgatacttccccacagccttgcactaccaatcaaaatgggagggagaataatgagcgattatctacatccaatggaaagatgtcaccaactcgctaccatgcaaacagcatgggtcagaggtcatacagttttgaagcctcagaagaggacctagatgtagatgataaagtggaagaattaatgaggagggacagcagtgtgataaaagaggaaatcaaagcctttcttgccaatcggaggatttcccaagcagttgttgcacaggtaacaggtatcagtcagagccggatctctcattggctgttgcagcagggatcagacctgagtgaacagaagaaaagagcattttaccgatggtatcaacttgagaagacaaaccctggcgctacactaagtatgagaccagcccccattccaatagaggaccctgaatggagacaaacgcctcccccagtctctgccacatctggtactttccgactgcgacgagggagtcgatttacctggagaaaggagtgcctggctgttatggaaagttacttcaatgagaatcaatacccagatgaagcaaagagggaagaaattgcaaacgcttgcaatgcagttatacagaagccaggcaaaaagctgtcagatctggaaagagttacctccctgaaagtatataattggtttgctaacagaaggaaggagatcaagaggagagccaatattgaagcagcaatcctggagagtcatgggatagatgtgcagagtccaggaggccactcaaacagtgatgatgtcgacgggaatgactactctgagcaggatgacagtacgagccatagtgaccaccaagaccccatctcattagctgtggaaatggcagcagtcaaccacactatcttggcattggcccgacaaggagccaacgaaatcaagacagaggccctggatgatgactgatcagggaggttaaacatgacaagttaacttagtttagacgtagcaccttagcagactttcctcggtccttaacatgtgttcttacagtataacttgcagtttcttgtatgtcaggtagctgttagggtcttgttctgtgaagatggcatggtgccctcagcctttgcatatactctctcagtattaactcccagtaaataataaccaaccaaccaaccaaacttccctctcccagcccccgaggctagaaaatcttgctgctccgtcttagcattccaagaaagtgcttccaggtatttagatagccctcagttctcaaatattagactacgtgtaaaatcttgggtacctttagattcttgtaacactagtctgtactcccttttccttccccaagactgataggatgcaagctgaggtcgtggcacaggaatgacagacaccatttggggagtatccacagagtcaaaggaacactagaatccccacctcagcgtgaggataattgatttccagctgcaataagccgtgcctcattatagccacactgtggctagattatacttctttgggtgctgtgctaagaatgtcaatggaaaaagccgatctcagattttgtttgaagttaacatgcctgacacagacatcctttcctctcacaagctgtgtgacttagtagataaaatactgccttctgcctttgggaccatgattaaaaacaaagacaaaaaccaaaagtcattaaaaaaaaaaaaaaaaa

SEQ ID NO: 1272 - protein, 324 aa, Homo sapiens
MSPSPSNSYDTSPQPCTTNQNGRENNERLSTSNGKMSPTRYHANSMGQRSYSFEASEEDLDVDDKVEELMRRDSSVIKEEIKAFLANRRISQAVVAQVTGISQSRISHWLLQQGSDLSEQKKRAFYRWYQLEKTNPGATLSMRPAPIPIEDPEWRQTPPPVSATSGTFRLRRGSRFTWRKECLAVMESYFNENQYPDEAKREEIANACNAVIQKPGKKLSDLERVTSLKVYNWFANRRKEIKRRANIEAAILESHGIDVQSPGGHSNSDDVDGNDYSEQDDSTSHSDHQDPISLAVEMAAVNHTILALARQGANEIKTEALDDD

SEQ ID NO: 1273 - DNA, 20591 bp, Mus musculus
gaggaaccatcttattttgctatgtaagttaaaatgaataaaaaacatgcccttctttgacatggaaatactttattacaaatgttacatagacatttggccaagcttatttgggaactacagctgagtccacagggtacagcccctttcctgagagcttatcttttggcagtggggggagtaaggcagactgaaacagtttcattctttgggtcagacaaatagaagaatataaaaactagagaacaaacacaggcagagtattcttttttaaaaacagctttgctcagacacagttcccatccaaacaatacatccagctttgtggtttgtagttagttcagctgtatactcaggaacacattttgtgtctctcagaagaaaaactcgacctgtagcagttttcctttgcaccagacactcctcatctgctttttcttttgtacatttctccacttaggtatgagattgaatggaatctcataccatgtggttctttgtgactgtctattaaattttttgtattattattattggtggtgatatgtatgtatgacgtgtgtgtgtgcaggtgtgtgcatgccatggtgcatgtgtggaggtcagactggttctctccttccacctttacataggcaacagggaaggaacctgcattttaaggtttgcattttaagtgcctttgcctgttagccatcctactggcctttgactatccctttttaggtcactgtaagcctcagccaagtagtggcttgtatcaggagttcattcattttatgactttaacactaagtgttgtgtgtactagcctgcatatgtggagctgattctttccttccactgtgggttgttccaagggtggaatgcaggtcatcaggcttgcccatcaagcccttttcctgctgcgccatctcactggccctactcattttaattattgaataatgttccattctgtggcaattcacattatctgttttttgcttgatggacttctggggttgtttctttttcttctactttatgcaaaacacactgtcatgaacgttttgtctagtaatttttgtgtcgatgcaggtttcagtgcatctagagttgctgggttgtatggtgaccctgcttagccctgttaggaactgttgagctgttttcccaagtgaccagcccacttgtgtgccagtcacatgccttctgcacatccttgccaacctttgtttttgtcttgttggctattgttctctgagtgggtgtcagggggcatctcactgtggtttgattcgcctttctgtggtgtctagtgacaccatatgcaccacacggtgctgcatgtcttcctgtgctcagtgggcatttttgtacctgtttagagaggtgtcctggtaatttgcccatttgaaaattaaattattgatcgttattactgttgaagtgtgagtgtaagactttgttgttattatctgagacagtatttcttaactaggctggtctctacacccctaaccatctgagggttgtcttgaaccccactccatctgcctcttccccctaagtgcttggttacctcctgcacttccatgtgcaactgagttctctttatattctagtgcaggtcctttagtatatagatgtgcttggcaaacattttttctttagttttgtagtcttttctctgtgtcattcccacccctgcccgtgttgctaaggatctagggatttactcagagtttctcagctcagccattacagccccaggccctgctgtgaacctttgctctgggagttactgctgtcttagcactgtgaagattttatttgtgaatgctgaatgtctccccacttatttaagtccttaactttttcaactgtgttttagagttttcgttatacaaatcttgaatttattttcaatttattcctaattaaaaatttttgatgctattttaagcgcaatttttgaaaaatatcattttcatatttccattattggtgtatagaaacacaatggatatttctatgttcaaaagtatattatgtacacacacagtctatacatacacacacaccacacacacatacacacagtacacacacatacatgttgtttgaatttttattagtgggtcctataggacttttcagtacacaaggtggaaccgtctgcaaatagagaattcacaccttccttccattccagtctggatgtctgtattagtttttcttgtctgactgccctgaccagaatgtcgagtgcagagctgagtagaatttgagcagtaaacagccttgtgctgatgttggaggttaagctgtccagtccttcaccatcaagggtgatgtgatgaggttacgctttattagactgagaaagttcctgtctattcttcgtacagttttcacagaacactgggatttctgttaaatactttcccgaaattatttatttcttaagcatgatggccttttttttcttacttttttttcctgcagaaattgacttacataccaaatgtgtggtggatgttgaagcgaacaaagttattctgaatcctgtaaatacaaatctttccaaaggagatgcccggtaagttatgaagcaataccatattcactgaaatcatcactggctactggacaaatgagggtgctcctaaagatacatggctaccaggaggctgttcccaggctgacaatgagtgagggatgtcaggagtgctgcagatagctagggggacagtggggactcatgacatgtgggcactaagggctgaagtgatgaggtggactttaagcagctggtgctggctgatggaccaggcaggtgggcagcaggagagggcaggaagggagcctgtgcacagacttatcctggtggcttttactttggccattccaggggctgcctttcctatagccctcagagggatgtttcctttaaacacaggcagactggagaccatctaacttaattactgtgctctgttaactctttgaggcataccttgactgtcaggctaaggatggatatttcagcctcacttgtggatttgggcaaatatatgaaacaaaagagaaagaggggaaaagtgaattgggagagagtaatgagattatgtttttctaaaaaaattggagtgaaattaattagatcaaataagctgggctcagattatagcaagtagacaaggagatttacattgtagtccaggctagccttgaacttacagttttctgctatctctttgagtactggaattataggtgtatgccaccacacctatctctgcttgtagttttttgataattatgaggtgaattagaaaaaaatggcaatgtagacagcagagtaaaataggaaagaagggttttatgggagacatctctatagggatgctgttgtgctgacccttgacgtaggtcaggaggggagactttctgctctggtgcccatgcaaagtatgtactttaactattgtgataatgtggctgtggcacttcatggtggtcttttggcttgagttctaaggagtgctggacttgggttcagacgttctgaattgaatccttccatagctgtaactgtagtttcccttccttgcccgcttagggctttgttttgtagtcatagctatcctggaactcatagaaatctcgccctggcttcctgagtggttaggttacaggtgttagccatcatgcctggcctgtagctatttatttttaacttatttgaggcaatctctatgatatcagatttacctatctcatagaattattttcctttaaagatcaaattagtgtttgggtaagcattttgtagtgttctgcaaatgtttattgctactgatggtgaagatatgacttagtgatatctttagtgataaggatttctgttacatattgttaccagtttcctcagaagcacagcagcttcatacagcagtcatcaatttgtgtggtccaggacaccagtcagggcacagtgggattatggcttgctctgatccatgctatgtgggatctggctagaagacttgaacacagggtttggaatcatctgggagggagtggcttggtcatcaggcctagtagttcatatcccctgttgaatggaggtgcctctgaggatatatgcaggacagcaattcataatcctggtaaccagttctaaaatatgtgtcccaaaggaaaccaagccaggaggaagcatatctgtgtccattgtgtgggccatacaggttaattctatcacattttcctgttcaaggatagtgtaagactctagaacccatttaagtttttttgtatttatttatggtatgtgtaggtgtgcatgggtatgcatgcacatagaggtcagaagtcaaaaaccagctggagttggttctttccttcttccatgtggttcccaggaattgaacctaggtcaccaggtttggtggcaggtgctcttgcccagtagcatctctggtttagagaagcattcagctctgaagccttagtttgttatgggacaggtagatacagccactgtcttttggagcagtctgtcggattgtgggatgtagctgcctgagaaggtgactaaaaatagagggagcacacagaacttaaaacaccaggctggagttatggcccagtggttgagaacaccaactgctcttccagaggtcctgagttcaattcccagccaccacatggtggctcacaactatctatattgatatctgatgcccttttctggtgtgtctgaagacagctacagtgtgctcatatacgtaaaataaataaatcttaggaaaaaaacctcaccttcttaaaaacaaacaaacaaacaaacaaacaaacacccttgagggcttccagtgttgcaggtttgtaaaagaaggagcactttctgattatatagattattttggatgcttcttttctctcatatagtaagaatagaaattggatattactattgtaagaaggattaaatatgattatatgtaatggtttttagtcaagtaaagttaagaaacttgacttttgagacagtgcatccctacatcactatgtagcccaggctggccttgaagtaattactgatcttcctgcccctctttcagagtgctgagactgcaggcatatgccatcacacccagctttgaaacatagacttttcaataacaaattttcattgaagcatatacatgtacagaaaagtgtacaacttggtgagtttttatgacttggatatccttctacaattggcatcatgtaaaggaaaaaagccagtgtattactgcttacctaatgaaagtgcttgctaccaagcctgctgacctgaaaccatggtagaaggagagaactgactcctgaaagatgttccctgaccttcacctgtgaaagaacagcaaattaagtaaaaatgagaaaaagaaacagaatattgctagtgtgcaaaagactcactattccttgcctggaacttaatggctagaccaggctggtcttgaacttgtagtgaccctcctgcttctgccttctgcttgctgaatatattccacatagctaactgtttgtctgtcttctttctttttttctttctttctttctctctcttttgtaatacttagttgaaaagagaaaaaagaaatctcgaatgtagcagtcagttgtatatgctaactttataaatttgaaaaaaataggaaatcatacattaggagattaaaatttaattttgaataattttttttcttaaagatatatttttattttcctatgtgtgttggtgtctgctatatgtgtgcaagtgcctgttgtggccagaagagaatgtcatacctcttggaactggagttacaggtggctgtgaactaccctatgtaggtgctgggaactgaactctggttctctggaagagcagcaatgctgttcaccacgagccatctctctagccataccttaaacttctactaatgtgattaattatcttgcagagtgcagaataatgaatgacaactttataggatctgtacttataactagaaaactagggattttagttaacatggaagtgtttgcatcaaagttcctagcacttgggaggctgaggcaggcagaaggattgccagcctgggctacatagtaagttagagtctaacctgggtttcatagtatgttctaagtacacggtgaaccctctagaaatgtcagctgttactcttagtattgctattatttttatactctattcaagttgaagtccatgctgtattcagtgagctataatagagcttaataaaggtgataaatacttttttttaaatctttttttgtaaagatttatttatctaagtacactgtagctgtcttcagatgcaccagaagagggcgtcagatctcattacagatggttgtgagccaccatgtggttgctgggatttgaactcaggaccttcggaagagcagtcggtgctcttaaccactgagccatctctccagccccgataaatactttaaaaatcaaaatatgtttagtatttaagaatctctggctgtcaagaagttacctaggttctagaaaatttgtagccttttaggattagaaatttaggaataaccctcccagttctaacttagcaagtgcttttctttagaacccccttcttaatgagcaatatgtctgacctgtactataagatctttctgataatgcattcagagatttttttttttttggtcgatcagtagaagtgcgttcctgttttcaccttactttactcaaagctagttagtgctttccttagttttctagcaactaggtgtgcaaatcatgtgttgcagctttacagtttttaaactattttagatattcttaaactatgaaccttctaaacagtaccaacactgtcatgtgactaatgctgcctctagacctcactcacgaggacagacgcttcctgtcgtggctctgcctagagatgttccttggggtctgtgaggttctgtcaactgctagtgctaatgctgtcctgtacaacctaactcactggcaagaatacagtgttgggcctttcaaccactagaacaaacttttttcagttgacagttgcagaattgtggagtgtttttacattgatcttttgctaatgcagttaacagtatgttttgcatgtatgacttaataaatccttgaatcattaaaaaaaaaagaaatttaggaataaagattactagggctggagagaagtttcagtgggtcttcttgctcctgtagaggacccaggtttatttccagcactacatgatgaatcacagctgcacacagctcagttcagggttttgacatcttttgacagcacagactccttcatacacacagtggcacatgaacacacaaaggtataatcacgtataaaaaagaataataaaaaggtaggtgtgtgtgtgtgtgtgtgtgtgtgtgtgtgtgtgtatctgtgtgtggtctgaggataattttatggaattggtttggttctctccttccacctttattagggggtcagaggatcaaatccaggccatcaggctttccaacaagtgcttttaccctgaatcatttcactggcttaggatctgaaagctttattgagttttctcatgttgattgggcacttaatgacaaacttgccttcctttaacaagatagctgctctgggcaggagagtgagctgagtaaagtgcttgccatgcaggggtgaagacttgaattcagtcctaagaacccatataaaagagctggggctggtgtcacacattggcagtctcggcacttgggaggcagcgatgggtggctctctggggcttgtcaagctccaggtcaggtacaagataggcagcatctggaaaccggcacctgaggttgtccttggtcctctatgtgcatgctcgcacctgtatgtacctgtatacccgtgtgtacacatacacacatgacaggacctctgattgcatgtttgtagtgcgtgggtattggtccctgttagcatcaactgattttggaaagaaaggttaagtcattgctcatgaacaaaggaacattttatcacatagagaagtgatttccccttattaccaacattatagggaacattattttatctactgtattcccctttctaatgtcattacacagaatacccactggagacaacttatatatttattttcccatgtaggcgctctgtacttatattttagtttaaccaaatatctttttgagattatcttcttacctagaaccaattggactttctagacccatccttagggctttccaaatcttcaccagcagcataattaattacaagtcatttgaggactaatgaatgactaattccttaccttgtatagatttaaaacaaacaaacaaacaaaccaaaaagaaaaaaacaaacaaaccaaaaaacctagtaacatgggcagtggtggcacttgcccttaatcccagcacttgggaggcagaggcaggcagattttgagtttgaagacagcctggtctacaaagtgaattttaggacagtcagggctacacagagaaaccttgtctcggaaaaaaaaaaaaaaaaaaaaaccaaaacaaaaaaccaaccaaacaaaaaaaactagtaacattttcagtgtgtaaattttttaaaaaatattttattttatatatgtgagtacattggtcctgtcttcagacacaccagaagagggcatcaaatcccattacagatggttgtgatccaccatgtggttgctgggaattgaactcaggacctgtggaagagcagtcagtgctcttaaccactgagccatctctcctgctcctttagtgtgtaatttaacttagcattttagataccaggtgtgttggtgcatacctttaacatagaacatgggattgctgtgagtccagctaggactgcacaggaagatatcctgtcttaacagtccccctccatattttggagcactgcactgtaactacttttgataacgtgatgtagcatgctccattcttacacatctgaaataatctttcttcatagtgtctagtgcctgtgatcatgataggtgagcaggtttctagggcatcatttgctcgagggtggcttctctgttttatgtgtgatcacagctgatactcaacatcacacaggagctgttgcctgtctggtagcaactgcattctgagagagttcaactctcagttcccatagttggtttcctacttggttctgcaaacaagggtattgtcttttctgttccaccagcttaacacaaacaagaaatctgtgttcaggggtcgggacaaactctgtaaacactagcttaccgaggatgttcccacctgtaaaaggctccttttctttaccggctgtggttttatggtggtgaagaacatggtaactactagggtcattgttcgtaagatgccagcattaggctggtctagagctctcccagatcaggctcagactcctgatccttctgccttagttctgccacttctggcttttatatcaacacaattaaatggtcaatgtcttagcattatcatgaaaataattttgatcttcaggccctttggaatgttgggagctgcccaggaattcttaagccacaagagacaacagctttagggatttagcaaaaaaaattttcgtctgctttctgttactttgagatggggtttctctgtgtagtcctggctgacctcgaactcagagatctacttgcctctatctcctgagtgctgggactaaaggcgtgggctaccaaccacttggcctgggatttagcagttttacaaactcttaagaacctaggggttgcctttcatttgcttatttaatttctactctaatgtttagattttatttgaacagaggattgtgttgcacagattgatgtattatgaactagtctgcattagtcaggttctctgcatcagaactgatacaatttgaaaggggattgggaggaaaggaatcggggtctgggcctgcgagtttggttagatatcaccgagctaggtgggacagtccggtaacaatttcaagatgccaggacggtccagtacaagttcaggttctactcattacatatctctcagctctctcctccttaaaaaacttccaatcctctatcagctctggaatggacacagtttctagtgttgccttggaccttgtggagactcaaactgaagtgagtagtgagtacagtatggacaaggccatggttgagtttgctaaaatggatcaagaactaagccattatgttaaggctgtccagtctacaatcaatcatgtaaaagaagaacgtccagaaaaagtaccgggtttaaaattactggtggagaagaaatttttggcagtacagggataatgccgactttaaagagaatgaaaagttcgtgcagttcaagcaacagctgagggagctgaagaagcaattagtgaaacccaaagaagatggaagacacagtgaattcaaccccaataaggattccagtagagcaggcaatgaacgagttgcccaaacattggctgtagtcacacagacatgagaatgtcagatcttattccggatgaagccctgagaaggttaatcaagagccacaacaagaagaaaaaacaccactccgagtaggagcaagcctcctgcccacagggatgtcagcagcctacctccccgccagccatcagacagtgagggtagacagcaatgggcctggccgagcagtgctctgtttgctgtaacccctgaaggctaattgtaaatgaaagcattttttaagttacacagtaaaaacacaagtacattatattctttattttcaagtgctctgaatttttaaataaaactttgataatcctcaaaaaaaaaaaaaaaaaaaaaaagaaagaaagaaaaagaaaggggattggtcagttggctcacgtggcacactgtaggtggtccaacagtggctgtcttcacactgctgtggccaagaacttggaggctgctcagccttctcctcacactgactgctctttatttggccaccactgcaagggtgacacccacatttaggttggaacttcttacttcaagtaacctgctaagaaacccttcacaggactggtgagatgactcattgggtaaaatccttcatccaagcctgatggcttcagtcccaggacctaagcagcgaaagaactcaccccacaaggttgtcttcttacctctggacacactggacacacatctgagtcccgtttctccagtaaatgcactttaaaaaaaaaagaaaatcctaatgccttatctcctagttcatttcagttctagtcaaattggcagtctggcttggtgcccccccttctctctctctctctctctctctctctctctctctctctctctctctctttctctctctctctctctctctcacacacacacacacacacacacacacacacacacacaggtttatacataatatgtactaatgtataatgcataaatttaatccatttctcagacatagctgtctaaaatgtaactttttagcctctctgttttccggtggtttacattcggaaacagtgagtctctgagttctgctgggccaacaatgccacttgacagcctttttctctgttttgctctttcttagactggcattctgaggtatccacagtgtgagaactgtcctgtgtggctgagaactataggcagtggttctgtcttgagcagtttagggatgcacatttctactgaatggacccattaggccctgcagtgaagagctctgccgcattgtttattattcatttcccagtttattggagcatgatgtgttttctcttcagacagaggtagtaacagctcatggcatagtgttcctttggacaagtttgaggacatctctacttgcccctttctcaattctccaaagtgacagacatctccactgtttcagcactagcccttaaccctgcgtatgtatctcggcttaatttgcagactcaatttatttcacacaccaaaaagatgctatctaatcctttctcagtatcctccagtctttttctcaaatagattttgtgctctgataaagaagacagcactgcctgtgttcacgggctttccttaggtgtccctcttattacgtatgactccttaagctcacctttccttctagggaccctcccccacagccacctccttgcttggcccacagctgagtgtaccgcactcagttcttacagtgatcacctagtcagcctggactacaggtgaaaggccgcagtccttcacaagattgggtaacacactggcctaactgggtccccggctgtatccactttccatgtggatgtacatctgtagcttcctcatccctttctggtttgatgattctgttcacagaacgcaggaaacaatccatttaacaccgctcttttgatgctgggggtgggggtagctcaaagggaaaacatgtgcaggagactctgggttccaatctttggagccagaacataaggacacagtgaaagcactgcgctttaaagtaaagggtacaaatcagaaggatcagccacctgaaaagactcaggacaaggtctgggtggaaatggggaacttatgatgtgcatgtcacttgcagtcagcgtatgctattatcccagcacacccacgtagtcactagccagggaaggaccagtgaacttctgtgtccagagtttgtaaacatttttaatttagtttattaccattttgtgtgtgtgtgtgtgtgtgtgtgtgtgtgtgtgtgtgtacctgagccacggtgtgtatggaggtcagagaacaacttttaggagttagttctcttcttccatctttatgtgggctcaggttgtcaggtttatgcaacaagtgcttttatctgttgagccatcttgctggctcaatacagattttttttttttaaatcagagttttcagaacaaaggcatagttactgtcacatggttgaactgtccctaatccttggcccttcaccaaaaagtggaaaggctggttaggtgactaaaattccaacctctagttagaggctaattctcaaggcatccatctgtaaatgaattgccccctgagtgatctgtgattggctggcttcttttccttaggtgtcatttatccctgctatagctttgacaagaacttctttttgaaaaatgacttccatcttgtatacctgttcagccgttgctgggccttgggttgttttcggctcttgtggctttgtgaataatgttgcctgttgtacatggtttatgtggacacgccttttcatttctcttgggtgggtatctaggcatggaattgctgggtaacttggaaactctgcttaacctctcaggaactgccaaagcctttcactgttgcacgttcttgacagttcaggaagggtggtttctttgggtcaccttgaggatattggtggtacctcggctaattggggggggggggtgcgtgtcttgcccaaagccacaatgaaaaagcaaaataaaacattgtgctgtccaaacaaaacaagtctggtcagctttagcccttggctaccaatctggatcccatgttcttataaaatggaacccagttatgtttattaagtaggactttttggaaagggtttaaaaagtcaagtggaatttgaggattatagcatgagaaagggtctaaagaacaaaggatttagcctggcagcagtggtgcacgcctttaatcccagccactcgggaggcagaggcaggcagatttctgagttcaaggccagcctggtctacagagtgagttccaggatagccagggctacacagagaaaccctgtcttgaaaaaccaaaccaaaccaaccaaccaaacaagcccgaaggatttatgtcccgtccgcttggttgagcaaatcctcctccctgtgctttaaacttgcctgattggttcctcatccttctgcaccttggtgtcctgaggttgtgtgtttgtttgttttcatcttcactttttatgtctttactgtttcactctgtgtgtgtgtgtagctcatgcccaggatatgaatgtgcatgaatgccccttttccataagaaaccagaagcttgacttggaaaagatgagccaccttgtaaacgctaatgtctgacttttaaaggcaaaagggctaaaagaagataaacataatattaccgtcaactttggggaggaaagtgacacttggtattattttatcaaatcttgtttgtcttcttttttctcttaaaagattaaaagagtccagaagctttcccctcctgtgtcttgttggcagtggattgttttcttgtacctctgactctttgaagagattgcatctctaagagtggctactttaagcatcagccccaaaacttgaaaaggaaagagctccctcataccaactgcattcccagctgcttgtccagttaccctggtttcttgtttagccctctgctttctgctccagctgtgctgtgtgtggctctgtgtgagtctgtttgttaacaccatgcttggtatgttaaagtggaatttcttctatgattcttcctttgtgactctcccacaccaagggtcagatcttgaaagtagaacttctgaggttgaaagcatttggagatttagatgtcacgatcttgagccaggtgtggtggtgcacacctgcagtctgggaagaggcagcctcagttccatggtgactctgagataaacttgatgagtcatgagaccagcctcaaaaatattaacagatcaacagtacccctacccccaccttagcaatattttaagatcttgatttacccagatactgatttctttagtgtcctatgtgatgaactgttctaatacactggggcaggctccaacaaggatgtcatggggtgtctcagctcttatagtagacacaggatgctgtccctgtcctccttgcttgaacttaatagttagagagcagtgtggaggttaggactgctggtctattgagcgtgtctgagatgtggatttcagccccacttggtcaaggcaccggaagaagcctctttgtcccctctgaggtgctaagaggcatcagtttagtcaagcgagatagttagtgaatgtctagtacaagcaaagtaaacccaaccctctttcactctgatcctggtgggtgtgcagattggagcttgtaaaacacactgggaagtctggtgaccgtgttcgttttctcttgcacatcttggttagggcttatgctggtaatttctttgaaacatatgaagtaattttccaactaatatcttattagtggaaagcgtcattaggtcatattagataatgacttttaaaaatttctctgctgttagatggatgctcatttaaatgaagattttaattgaaggaagtcgtgcaaaatgtaattatggcatgcacaatggacatgcctgttctctgtgctgtgaaatgacccacatgaggccagcagttctgcctgcatagaaagcgcttctctggagactccatgcacgtctgatttaatttcataagagactttcccccaggagtctgtctaccctaattatgtgggcgggctggagagtgattttgtactcagaggttgtagatgtctctgtacagcctcccatttacagaagtactatgatggctgatcgtgtaaatcatgtatgtgtaaccatggttatgaaaccgagtcaggaaaaattgtaaagaaagtatttgtggttgagtgcagctcattgtgtagttaatagaaacagatgatcaaattgcagtaagtatagttttgaccaagtttactagcacagtctagcagactgctacgctgatctgtttgatagctcgttaataaggttgtctgaataaagattatgaaggatggctgccacagaatcagtatgtgatgtatgcatatacatttatgtttgtgacagcgtctcatgtagaattcagtatgtaacttaggatagccttgtacttctgatactcctgcatccatctcttaagtgctaggaacataggtgtgtaccacaggctggacttatattttatcattgtcattgacatatgagtactgcctgcttatgcttctatgaagttcattggtaataaaaaggaataaactttagaaaatgctgcatggatacttatatttgatgaaacaaggaatccacattatgtcagcagaaagtaagtctagaacaggttaagttacaactgatgtgactctccctgcattttgaattcaatataaaattgtcagtatatgatctattgagaaaatatcttattataaacaaatttggacagcttctaagccctggcattagagaccttcctaaagagatctgctttacttggttcttgtttggcatctatatcaatttcttttctagatgctctgacagaaacaacttaagggagaatgggctcactatttgtgggcacagtctattacgttagggaaggtgtgggcaatatggctgcactatgacaggcagctcttacactgtccctcatgaggcagagagaggaatgctggtgctcagctggcttcctctttttcctttttattcagtctcccacaaaattccaagtccagccactggaaattaaccatcacatcatagctcccttccaaggctctgtgtactgtcttaagttcctgagtagctggactactggactaaccctgatgcagtacaagacaaggcaatggcacttgtgaagaagtgtgatgtagaaatgcagccgattcacagcacattggggaggtttctgatcagctcaacattttgtgcatctagtgtcacattcatcaagctaagaggacaatctgctaatctttagttgtatttatcctgctatcaatcattggacaacatgtctaagaagaacagaccccaagtaacaaagctggaaagtggagaggaattatacacttcttccatggatttttctgattcaagagttgaagtagtttggctttattctgagcattgtctggtttcctaggagaagtttcttttgcaaattagtacttggcttggaatccttaacttttatacataagagttcttttaaaaaacacagtatcttgtaaatttcacctttatcaagcctaatttacctaagcttatagtaaaatttgtttttttttttttttttttttgggttttttggtttttcgagacagggtttctctgtatagccctggctgtcctggagctcactttgtagaccaggctggcctcgaactcagaaatccgcctgcctctgcctccccagtgctgggattaaaggcgtgcgccaccacgcccggctgtaaaatttgttttgaggtgctaggaattgaactctgggccaagactgctgggtgaggcaaagtcatgaaacgtaaaaatgcatgtattttcatgttctgaccaatatataaagccagtaatgctttgtcctacctttaagaactgaaatggaatttaaataatgatcacaaagaatgtagaagttacatttgttgttacattttaagaattttgttatggggctggtgagatggctcagtggttaagagcactgactgttcttctgaaggtcctgtgttcaaatcccagcaaccacatagtggctcacaaccatctgtaatgagatctgatgccctcttcttgtgtgtctaaagacagctacagtgtacttacatataataataaataaatctttgggccggagtgagcagggctggagcaagcagaggtcctgagtttaattctcagcaacgacatgatggttcacaaccatctgtacagctacagtgtactcatatacataaaataaataaacaaattaaaaaaaagaattttgttatggaaaacttgaaagataatgtaaaaccattatccatggcttacaatgtcctaccatctcttcctctctttcttcattcatatattgttttgaggaaaattccatttactcagcaacatttggatgctgttaaacataatcataatactgtaaatttgccttaaagttagttagttaatgacggcgagttcactaacctgctagtctggaatcagaactgctccaacaatcccagcactttgtgagtatggacgtgatgccccagatagtgttcacctgactgcatatggcaggtggcagtcaggtcatacaatgcaggtacacttacagtcccatgtggtttgtggtttgtgagtaagttgggtatgagctgcagatgagctgcatgtttggacccgagtctgcccccacaatgcctgctagttaccgttgttctgcctggacttattctcaaggcccctgtttgatgttgcctttgaaacagtggtttgaaggtcggtctggagtcttgggagtttccttccaatccttgatgatgtgaagatccaatgcggcctcttacctacttagtataccagtggactttcccaggagtggacttccattgttcactaggcatgttcttggggggacagtgtcactgttgcaatcttttaggtgtccacagcacacagctttgttctgcagtccttttgaccatctctgagctgtgtgtgtgacactgatgatgttttactgcttcccaggtacctacagttaggattgtagtttctggatcccgtacccgatttcctgtatgcaaaacactgcttatgccatatagactagatggggcatgtggggtactatgtatggactggaccctcctggaagagtgcttggtttagcctacagcttgaatatttaaaaattaggacacttcatgtataaactcaaatttgttatatgtttaaacagcctttgaccaggccttcacctcctcaggcccaatttgttattctcaaagctcttatatgcctctccctttttggctagcagtgtagattcatttttaaaatatttatttttattttatgtgttttgtctgcattcatgtctatgaaccatgtgtgaatagtgtggccttagaagccagaagatgcatcagctcccttggaactgaagttacagacaatcatgagccaccatatgggttctggaaactgaaccctggtcctctctaggagcagcaaatgtttgtaactgctgaaccatctctccaatctcaattcaaatctattctattctactgtttccccctcccccactttttatttctccttatttttggtttggtttgtttgtttgaggcaggatctcactatgtagtccttgctggcttggaactcggtatatagatcaggctagtcttgaattcacaaaggtctgcctgcttctgactctgcctctacctcttaatatactggcattaaaggtgtgtatcactatgacaaacccagcagtacagattctttccggcttctgtgacaaagattattcttcctcacttttgccttgggctttgagattcattagccccaccctcattttttcttattttattttattttattttttttgtggtaaatacacagaattacagaatcttagcacttaagagctgaggctggaggaaactgaggatttcaaggtgaggatggtgatgcaaagagtttgaggcctgactgggatatattgtgagacccctcctcccaaaaaagtaccatacttttctttataactaatactttaaaaaatatatatatttattattatatctaagtacagtgtagctgtcttcagatgcaccaggagagggcatcagatctcattgtggatggttgggagccaccatgtggttgctggaatttgaacttcagaccttaggaagagcaatcagtgctcttaactgctaagccatctctccagcccccaactaatattatttaaaagggcatttctatgttgctggagaactaggttgctgcagaatcttattcaatctgtgatacttcatttatttattttactaattcagtgtgtgtttgctgaccaaaggctaatcctaagtatctatgatgctgttgactctgtgtgtgtttgtgtgtgtgtgtgtgtgtgtgagagagagagagagagagagagagaaagagagagagagagagagagagagagaacagggctcttatggcttgaactcactgagtaggctagactggctggccagtgagcagcacagatccacctgtctgcctccctagttccctagttccctagtgtgggattccaaatagatgccacctcctccaggtgttttatgtgggttctgggcatcaaactgaggttctcatgtttgcaaggcttgcatttacttaatgagccctatctccagcctcaaactatgatatttctgaaggtcctggcagtgttcaccaaagcgtgttgaatgagcagttctgggcatttactgcagtgtcttggggcagtgggcaaagattccctgctcttgagccttctgactcttgcttacagagaggtgtatggggtcagaaaaacttgaaaggggattttggtgtgattgtagatttttaaaaaggggagttagaatgagattcac

SEQ ID NO: 1274 - DNA, 548 bp, Mus musculus
gaggaaaggaatcggggtctgggcctgcgagtttggttagatatcaccgagctaggtgggacagtccggtaacaatttcaagatgccaggacggtccagtacaagttcaggttctactcattacatatctctcagctctctcctccttaaaaaacttccaatcctctatcagctctggaatggacacagtttctagtgttgccttggaccttgtggagactcaaactgaagtgagtagtgagtacagtatggacaaggccatggttgagtttgctaaaatggatcaagaactaagccattatgttaaggctgtccagtctacaatcaatcatgtaaaagaagaacgtccagaaaaatacagggataatgccgactttaaagagaatgaaaagttcgtgcagttcaagcaacagctgagggagctgaagaagcaattagtgaaacccaaagaagatggaagacacagtgaattcaaccccaataaggattccagtagagcaggcaatgaacgagttgcccaaacattggctgtagtcacacagacatga

SEQ ID NO: 1275 - protein, 181 aa, Mus musculus
GKESGSGPASLVRYHRARWDSPVTISRCQDGPVQVQVLLITYLSALSSLKNFQSSISSGMDTVSSVALDLVETQTEVSSEYSMDKAMVEFAKMDQELSHYVKAVQSTINHVKEERPEKYRDNADFKENEKFVQFKQQLRELKKQLVKPKEDGRHSEFNPNKDSSRAGNERVAQTLAVVTQT

SEQ ID NO: 1276 - DNA, 30821 bp, Homo sapiens
  misc_feature (1)...(30821): n = A,T,C or G
ggtagtaagaaaccagcatcctctctctgacttctccttcaatcttttggtcaatgaccagtagcataactccatataagtacagtgcttcacactaagaagagaagaggacaaaagccaaaatcactagattatacattcttagggagtaaagtcggtaatcatgaaaaatattgctttgctcacacttcttcaaaaagttttagatttcaaggaaaaggtaggtttcctccaaggagctcttaccttcttgccgaatgggccttgaaaagtttatgtaaaacagattttaattcatagtgataatttttcagttgacctattttggctatgttgcttgggacaccaaaatagcaacccaatattgtgtatacctcttcatcataaaatcattcacttattcaatcagcatttcttaaatggttagtatgtactaggtatcaggacagatggctgggatgcaaaaagtaaagaagacagaattcttacaccgaggaggctcataacttccacataacttttaactgttttaaattctgttcaaagtctatgttctaaactcagatatggacctgccagttagaagataattaaaagctcatttcgcttctctttaaagaatggtatttcgtatatatttgtgacttaaaagaaaaaaaagtgatactatgtttgatattcttgaatttcattttaaataatcattattacttactagaagttgttttccatcttcattgagaagcacagtttctaaggtttgctgaatataaaccccttcattgagatcatctagatatctagaaataaaaccacagtgcaagttattaatttataatagaaactttaacatctttaaagaaggaaagatttttaaaagataaggcaggatgccaggcattctggccttccactagttcatggtccttcatgctcttaagaatacagtcttataaactgatttagggccacagtttgatatttatcgctgttccaagtaaaagaaatattccctagtcctgatttgtgaattacaagtatctaggagtaaaggcagaagaacatggaatatctagtctaaaagttaatgagtaatgaattcttaagaagtgtattaagagacagaaagttaatgataaagataagttctttttcccacttttcacatataatacactaggatatgataataaataacaggattggaaactatatgacttagttaaactaagtttattacaacacctcgtaagagcaggacattatagtaaaacttcaaaattcttaagatgaccagtgccacaggtaggaaaagacaactatatacagtataaactaaattaggaaattttgtagtaactcagagagatttacacgttgctatgtgtccttttccctctccactatttactaccagaataagctattcctaaatagatcaatacctgtttaagtctacaatatatttatgtacactttgaaatgctaaataaaatctggtcacaatttctatgttgttttcacgaaattcttcatctaaatcctgtagctctggcttagcatccagtttgctttcccataattctggaccctgagaaaaaaaaacacatgtgaaatgtcaataaaagcatacttgttggtgacaatttctaaatagtcttttaaaaatttgttcttatgttattagacatcccaaacttaaagcagagcaacagaaagtagtgaagataatagaagcctagatataaaatccctttgagagaaatgaatttgaattggacccaagattagcatgcttttaagtatggggcccttcaatgtgaaatatcaaagttatcttttaaaaatacaattatattgtgttagggctttgacataatactttcaacttattttcaagttagtagctaatattaagtttagtcgaaaagctcttctctttagctttttccataattacttaaccttacagagtttcatggttcccagagaaaacacgcttttgtagaaaagacaacaataaaaatgctatagaggaagattaccttaaaatagctgaaatcaaatatgatatctccatatttctgttgatcagctctgtcttttaacctgaacacagcaggaataaactcagagagtctcaaaagttcagcaatgatggcattaccacaggaaacaatccttaggattgcttggccacagaggttgttctcggctagaaagtccaacattgtgaggcggaccgactactctgtgcctggacactggggatgattaactggcctcagagctggtgtctgtatattattagatgaaaccaggtgtgcagagagattggctcctccattaaagaacctgtatccccaaaaaaagtgtgaaaatctcaatttgtttaaggaagcacatgtgtacacataagaaacacatttttctcccaaactcactaaaaaaattttaagaaataatgagttcctttataggggaaagggtgtttatctgtcactcttcatattttccatgtggagggactttgctagattaacactcttggcctcttcttcaacatgttagtcacttctcttgagaaaaagatatgatacagctcatctctgtgctagggagaaggaaccactgggcatgtgtggttccaatgtaccctgattatacaagctatctcctactatttgatatattagcaaataatttcaaacgctataaagagagctcagagacaaatccctgtacatcattttgaggcatttgtccaattatttcccagaaatggaactgcaagcttaaggtaagaacatgtccaagattccttttaaaattacagatgctaggttctgcaaaattctgtgaagatgatttataaatactaaatcaaactggtccaaaagtctcataaaattcagcacttaggtatctagcactgttagcagaatccattacttgcttctcttgtattccaatgcactctctgaggatggttagatcacttagcatactgaatattatcgttgcttacagctcattctgaaagttcttgaaggcaaggattgatctttacccaaccactccttgctgaatacctctttgccaggctggatatgaagatgtttaaacatctcaccttctagtccagtggttctcaagcctggctgcttaagggaatcacctagcatcttagagtttctggtaagtaggttagaggtagtcctaagcatctctgtttttaagaatctccccggatgattctgatgtgaagccaggatcattaaaagagtagagaatgactggtcttatagaaaactgcagcaggcaaacaggaaattaacaatatttatctttgtgccctttgtgctgaactcattccttggcactgacaagtataaggagtgcataaataatactagggttacaagaggtgatgtctgtcctctctagctgcctgctatactgctggagatgagccctgaagaaaaaaaatcagagagatgaagtgtttcagtgtgtctttacaataaagaaataagaagtgtaacatatatttaattgtcagtatggagcatttattaggtgttctgttgggaaaggtattcttatactgggtgatctttagtaaagtgacatctaggaattcggggctagagaaagaaacctagcatctaaaaagaatgacctattttagtatgtaacacttaaaaacttttccatggtaaatgacttagaagatggatttgaaatccaaagggcagacacagggttgatttctaaaacatgcaaagggatctcacaagctgtcaaagagagaacagagagagaagcggaggcagaagccaagtaacaaggaaaagggaaaaaaagatgtcactaggaatgaaaaccaaccaaccaacaaaacatacatgtgatgttttcctgtacacataagtctttgagcatgtcactacccaggttgtgccttctaagcatcttctgtaacacagagactctcgataaaactgcttcctgacccatccctttccttcccactagcttcctcctacagccagtgcagatagcaggggtgagcagatggtagaaggcgaagggcaactggagaaggaagcgagaaagacttacacaaatgaaataactcctcggacttgatgaggtttcagaaagttcttgaagtaggtaatttgtctcattacgctactccttcttacattcccctctgcccacagacttgagtaccccttcttgttcaggcctgtgtgccttcccctgcaacaatcatttttcttagttctaggggcttggaaagcaatctgattataataatgtggtaactggttgccaaagatggctcccaacaattccttgccatgaagtcagcccatacagcaccttaagtgaagggctgaaccttattttccctctcaatgagtctggattgcattttattagtttgctgggctgccgtaacaaagcaccacagagagggtgacttaaacaaccacatttattttgtcacaattctggaggcgagaacttcaagatcaaggtgttggtaggactgttttcttctcaggcttctctcactggcttgtagccagctattttcctcctgtgtcttcgcatggccaccccattgctcatttctttgtatagagatgggagtctcactatgtagcccaggggagtctcaaactcctgggctcaagcaatcctcccatctcagcctcccaaagtgctgagattacaggcatgagctaccaagcctggccctcctttgtaaatttctgtgtccaaatttcctcttcatacaaagataccagtcatattggattagggcctatcctagtggcttcattttaacttaaccacctccttaaaaatcctgtctccaaatatagtcacattctgagctactgagtgttaggaattcaacatataaattttggggggacccaactcagctcataacagcttgtgccttccttccttcaacccaaagaatactgtagaattaactctctaccaattccaggcctaagccttgagaaggcctggcagtatctccttttgctctctttgggtgtccgaagctgccatgtaagatgtctgggtatcttgctagagagatcacaggagttacaaagaggaaagaccatgctgagagggaaaagtcctgacacagaagagaatgaagaaagccagcagacagcagaaactgaagtgccgacgtgtgacttgggttgacctggtccactcagcccccagctctttaagtcttcctagctgaagtgctagacatataagggatgaggctattcggcttctgcagccagcaaagccctctgtgccttttcccaattcctaatgcacaggatcatgataaatttttaacatattgtattgttttgggcaaataagtcttggggtagtttgccatagtgctgagattcagttttgaggactaacagtacaagttgtcaatttaaacagcatgctgatgctgttattgtgatatttcattttctataatgctgtgcaatatagtcattgcttttgtataataatgtccatgtagctatttctgtattgtactactgcattttcctccaatccccatcttttcagttctctgcttccgctgattattgcaatttccttacaggaattgtgccatttgtcttatctttggaaaaagagagctatgtcctaaaaaccactagaagtcggtgagggaacaacaagtaggtgagggaacaatctttagaaatgtttttaggcctggcaacggtggctcacacctgtaatcctagtactttagaaggccaaggtaggaggaatgcttgagctcaagagttcaagaccagtctgggcaacaatagcgagaccttgtctctactaaaaatcaaaagaatatcagtcaggtatggtggtgcgagcctgtagtcccagtgacaagggaggctgaggtgggaggattgcttgagccctggaggttgaggctgcagtgagccatgatcgtgccactgcactcttgcctgggtgacaatgagaccctctctcaaaaaaaaaaaaaaaaaaaattttctcacatgtcaagtataggagattcttgctattaagaatagttcatatctgaaaaatgctagagtgattacaaaatacagaaaaatgtttcataaaaaggagaagaaaaagttttgattacaaatgtatcttgaaatttgtgaaaatgagctttatatattaggctgtgataagtgccgtgaagaaaaagcataataaaggatggggcatatgctagtttccatagagcacctcgggcagaagtcagaaggaaatgagagagcaagcagtatggatatctgggtatggtcagcagctttctaaagtggtccctaatgatctctgcctcctggtattcatgttctatgtaggttccttcccttgagtataagctgacttactgactccctcctaaagaggagaatagggccaggtgtggtgactcactcctgtaattccagcactttgagaggctgaggcacatggatcacctgaggttaggagagccgggatcaccccggctctactaaaaatacaaaaattagccaggcatggtggcaaaaacctgtaatcccagctactcgggaggctgaggcaggagaattgcttaaacccaggaggcggaggttgcagtgaaccgagatcgcaccactgcactccagcctgggtgacagagtgagacttcatctcaaaaaaaaaaaagggggagggggggaaggaaataggatagaaacaaaagatacagtgcacttctgagattagatttcgaaaagactaacttctggcttgggcaccctctgtagcttgctagtccaggggaagcaacatatcatggtgtgagagagccctggggagaagcccatatgacaaggaactgaggcttgccaaaaaccacctgagtgaacttgaaagtagatcccttataatcccagtccagccttcagataagaccatagctccttgttcccagcctgactgcaatgttctaaaagccccagagccaaaggcagccagctatgccctaccttccggaccatagatgctataaagcttattgtcttaagccactgggttctggcatagtttattatgcagcaatagataatgatcctaataatggcatcccaagcagaggttacaagtaagtgcaaaggccccagggcaggaatgtgctagatggctagcaaggtggctaaagtggctggagcagagtcagctaggggcggaaacagaagaagtagactggattggatctgagagccaagaagccactacagctgtctagaactcccatgaaggtaccctgtaatacacattaaggcatacattattaacaagttcttttagtttcctctgtgatacttgcttgttaaaccacactgatctctaacaggctgaatttcagataatttcatttcattttctgcatggatatggtctggcttgggaaagcagagagggaaaggggaaataatggacagtgggcaaaacagtcacatactaaagccctctgaagaccaccaaactaacccagaaggtctaagtaggatgaaactttacaccaggagtgtccaatcttttggcttccctgggcaatattggaagaagaattgtcttgagccacacataaaatacactaacaccaaaaatagctgatgaccttaaaaaaaatcgcaaaaaaatctcataatgttttaagcaagtttacaaatttgtattggggcacattcaaagccattctgggccgcatgtggcctgcaggcctcaggctacacaagcttgctctagactcatgaagaggaggacaagctatgattaacaggtccaatggctacccgatttgggataccatgacagggcaacaatgtggccctgggaaaaacaacttaaagcaaagtaacattacttgccctttactctactctctcccaacatacagaaggacagacagactcagcacctgcatgcacacattcggggaagcttcagtctgggataacgacagagatcaagactttcgtgtgtcaatctcttgttttaatccttagtcccttactcaagaattacgctgtagacaactttaaaagaacatgagaaggataataataaccaaatatgttcggcaatagtaaaacaaatattatgggtctttattacctaggtaaatcacctttctaaaattctatatataaactttaaatttttaatgcaaaagcctatgagttatatttaatatacttttactgaaatgaactcactgcttgtaatctgttttgccccatgaagggcacttgtgttttctatttctaataatgcaagcatctcctgctaagtttttgaagatggaagaagttaaaacaagattagctgaaagaaggaaatcacttagttacattttatgtactagacctcctaacccggactagttatattttccatgtaacaaatggaatttccataatttgtacaaatataatttggctagagtatttggtaaatagccccctcgttggctgaaggactagtcctgaagaacagaatctaagaaccatcattaaaaatgcctaatcaagttgcagctaagaggtaggtggatggctttacaaagtgttaagactcagctaagtcttaaaaaaccactttagaattaggtccaaataaacactgtagaagaagctatgttaaattatcctttcagaggttctcttggtgctagggatcaagaacacttgaagatcagttttctcaatacaggctatattattattggcatgaaatccagagatcccactatattttcttattttcttttacaagtgccggtaacttcatttttaacaatttggcgtggaactgtgattttcagtttgggaagtaatcctaatcaaaagacatgctttcaagaataaggcatgacatccttacaccaattaccctgagtacagaataatatttcttaaggaaatcgaattgtcgtggacaaacagtttaccctcttcagaggacaaaagaaggcaggtctatttttagcctttcgcaaaacctcagttccataaaggaagcactggtctccacaaatccattatcacaaacaaaatataacggttgctgatcaagataaatgcaagctgcatatattttccagaaaagttctgaaatgaggctgaacctgaaatcctgggaaaggcaggtgaaggacaattagagaaggtgtcccttgtagtgcacaaagacagtaaaacttcgccctcactacgcctcacctatgtttgagggagctccatgcgcttgcaatcaggagacccagttttatggctctgtgactttttttctttctcctgtccgatcataatcctgattccgatcccaggaatcagggccctgggaactttttttttttcccccaaatgcaaaggattttgacatcagtatgtcacaggtgaaggcattaaggcgcggcgagcagcaatgacttgcccaaactcacagcccatggcataactagaatgcaaatccacgtctgtcagcctgtaaaagtcctcactactagcctttcagttttctcaaaagcaaagagaaataacgacgacatccatacagcagtgttcccggaaacttggaaggatgagattcggaccaagcagctgaacggtgcttcctaaagcgaggaaggggtgtgcaaaatgatttccccctaagcggagacgaagagctggattacagcccccgccccagaaagcccctaagccctccatcccgagtcccccatccaggctgcacgcgactctgcagacctccccgtggccagcgcggcccagcggggaggggaagggggccatgcaaaaatggggcgcgctcactccatccccactcacctgtcagccgggccgcgccacggcgcacgcgcagggccggaggtcgcgcgcggagccggcacccagtttccacccctccctcaaggcggcggtcctcttctatccgcagtcccggacctggagcgggtcagaccccgacttccgcccctgactccccaggcggtcacatgaccgaagcggctgggagcagggaggggcatcatgtgaccactcgccggcgacggctgatgacgcaagagcccgctctcacttttcagcggcaggcgaagggggctgaggaaaggaggtgggtctaggcaggggaaattggggtgccaccagacggagacagcttggactaccaggtagggaagaagcgggggacggcaatggggagggtggcaggagtttcgccaccctcagggacactccacggggactccgagccgggggtccgtctacccggattatggttgtggaacttttcacgccacggtagtgagtctgggacagtttaccctcctgtccgagacgccatctctccatcctttcgcctcaagtgtgtaggggcaagattacgaatttttgatccaaatagattttgtttgaactgactttaaaagtaaggccacgggaaggtcgtttgaataaactctctggacctcaatttcctcttcagttatgtagattgcagtgagaattagcgataaggagaataaagtgccgggacaccagtttatggcattctgtaggtgaccgagaaatgatgatgtctgttgttatttttgtaactggccaaatctttattggtcccctattttgtgtgaggaattgctttatatgcaatagaatatgtcagggttctagtttaaggaggtgtcagtttaaagaagctgcagacatgtgagcaaatagttgtgatgagtttcataataggagtgtgttgtgtacatgtgcatgtgatagggataatggtagcatgagggagggaaaagcaattgtatgagaaggattcagagagaagggattatccttgcatgttgaaaaaggagaggcagctctggctgacttgtacaaggctcccatggatttaaaggaagtcaacatattgtctataaataacatgcagagaaaaaactcaggaaatgcacaacttgttctaaactttcttggagatcataggtaccgggaagaaaaagatcagtgttattacctggggagggatccaagagagattgatttaaaccagttattctcaactgatgcactattgacattttaggccagataattttttgctgtggggtcagggtgagggctgtcctgtgttttgtaggatgcttaagagcatccctggcctctgcccgctagatgccaaccacaaagtctacagatactgctaaatgtccccttgcgagaggggtaaaatccttcttggttgagaaccacttaaaccaagccatgaaagatggtatcttagtcaatgtgggcttctgtaacggaaatgccataaactaggtagcttatgaacaacagaaatttatttctcacagttccggggcctgtttcctggttcataggtggcttcttgctgtgtcctcacatggtggaatggcaaagcagctatctggagcatcttttaaaagggcactaatcttattcatgaaagtgggcctcatcacctcccaagaggccccacctcctaataccatcaccttggaagttaggatttcaacatatacattttgggtgacacaaacattcagactttagcatatgggtaagatgtgggcagatagaaaactgaagagaggccctggcacagtggcttatgcctgtaatcccagcactttgggaggccaaggcgggcggatcacttgaggtcgggtgtttgagaccagcctggtcaacatagcgaaaccctctctctactaaaaatacaataaataaataaataaataaataagtaaataaataacataattggtgtgtcctggcacacacctgtaatcccagctactcgggaggctgaggcaggagaatcccttgaacccaggaagcagaggttgaggtgagccgagatcatgccactgcactccagtttgggcgacagagcgaaactctgtctcaaaaaataaataaataaatagaaagaaaactgaagagaaggttttctcatggtgggagcaggatgaggaaaagtcctctttttcctttttggtgacagcgtctcactcttatcgtccaggctagaatgcagtagcatgatcatagctcactgcagccttggactcctggacccaaggagtcctcccacctcagccttccgagggtctaggacaataggtgcaagccactatgtctgtgtaagtttaaattttttttttttttgtagagttggggtcttgctgtgttgcccaggctggtcttaaactcctggcctcaagcaatcttcctgccttgccctttcaaagtgctgggattataggcatgagccaccacacccagcctgaacaaagtctggagctgagattaagaatattgggtatgaaggggagaaggaaacaggagagctatgaatctgactgaagcagacagttaatttattcatttattgactattttcagagcacttgctgtttgtgaagcactgctaacatcttgcaagatagtcactaacaaagtggagtgactataattataattatatcaaagaaggtgctgttagagtcagagaaaggagttgtctttgacttgtacttagctgtatttattgggagagattgagaaaagtatgtctgttccatctttctgcaccatccattgcctttgcttttcaattcaatctcagtcttaatcttttccctactccagaattacagaagagcatgatcgtgttttccttggtcctctgcaaaagtgaagtttcactaaagtaatgtgagttttgcattcaaacaaatagtgacagctactgtttggtagatactttccatttatactggattgcattaatcttcatagatactgtgtctttgttcaagctaccataacaaaataccatagactgggtggcttaaacaacagaaatttatttcttacagttctggaggccagaagttcaaggtgaggttgccagcatagttggattctggtgaggactttcttcttggcttgtagatggctgccctttttatgtgtcttcacatggtagggagagagagagagagcagtccctggcgtctcttccttttcttttcttttctcttttttttgagaaaagagggtctcgctctgttgcccaggctggagtgcagtggcgtgatcatggcttactgcaacctcaacctcccggctcaagcgatcctaccacatctcctcctgaggagctggggctgcaggcccgcaccaccacatccagctaattttttattttctgtaaagacagagtctcactttattgcctgggctggtctcgaactcctgggctcaagccaacctcccacattggcctcccaaagtgctgggattataggcatgagccacctttccagccaggttttagataatcagtacacatgtgcctagtgcctatcatattggacagtgcagattatagaacgttttcatcacagaaagttctattggacaatgctgctctggacaatttagacttacactagaatcaagactgagtagaaaacagaatacttctgctgatcatggtgtctcatgcctataatcccagcacttgagaggccgagttgggaggatcacttgagctcaggagtttgagaccagcttgggcaacacagggagatggtcgtctctactaaaaattaaaaaagaaaaattggccaagtggtggcgcgcgcctgtggtcccagctacttgagaggctaatgtgggagaatcacatgagcctgggaggttgaggctgtagcgagcatgatcatgtcactgcactccagcctgggtgacagaacaagaccctgtctcaaaaacaaaaagaaaaccgaggccaggggcagtggctcacgcctgtaatcctagcactttgggaggccgaggccggtggatcacttgaggtcaggagtttgagaccagcctggcaaacatagtgaaaccccgtctctactaaaaatacaaaaattagcctggcatgtagctcccagctactggggaggctgaggcaagagaattgcatgaacctgggaggcgtaggttgcagtgagccaaggtagtgccactgcactccagcctgagggacaagagcaaaactccatctcaaaaaaaaaaaaaaaaaaagaaaagaaaattgaatactggaattatatcatttggtccttgcaggtttgtgttttttgattaatacttagtactgtaacaggtaaaccccacaagtctaaatggctttgcccagttgaagtttctttcatgcatggagcctgataggtgagtagttttcctccaagcagtgatgtagggccttgagctccttccatgcagtaattctctatcatcagcatatagctttactaaggtccctatgcttgcctgcatcaagctatcaaatgggaaaatgtggctttttgcagattaggcctggaaatggctcacatttcattgccttgggtacagtcataggccacagctaacttcaaggaaggctggaaaatgtggagcatatataggcatgtaaccgggttgaagaggaaatggttttggtgggcacctgtccagtatctgtcacaagtgttttgtccttacctgccctgagaaatagtctcaagaaacagtcctagaagtttgctattgcatttactataaggatatttttgaggattatttttttcagtgtaacccattatctcatatatgatgatccatacttgccttgattgccatggaaagctttatttttttcttgagtttctagtgttatttgttttttttttttggagaaaataactgtcactttttgttttgattgtgaggaagctcactaccaaatgtgtattactagtactgtgtggaatccttttttttttttttttttttttcatacggagtctttttgtgatctcagctcactgcaactgctgcctccaggattcaagcgattcttctgcctcagcctcccgagtagctgggactgcaggtgtgtaccaccatgcccagctaatttttgtattttcagtagggatggggcttcaccatgttggctgggctggtcttgaactcctgacctcgagtgatcaactgcctcggcctcccaaagtgctgggattacaggcgggagccaccacacctggccctctgtgtagaatcctaaagtgtgcgtgactccattataactttctcatatgcttggtttgcccgtaaatttctgttttttgatcctggtttttctgaatttatgtttttccatctttttgtgtatgtttgtatttatattgtgtaaaatgtctcaacttgtttggtataatacagtgagattgtaaacaagcagtctctttcaatgcaaatgtttgaagatcatcattggcttttattcctgtttgtattttttcttttttgatgtggaactgtaaagtcccagaaaagaacacaacaagaacccttgtttcatcacccagattttaacatctttaacattttgccatatttgtttcaggtcttgatttttaaggtaaagttttgaaaatacatagagctcaaatttccatgatgaccactagacccaactggagtgaatctttatcctgtacttaaggctgtctacactatattcccaaagaatgaaatccagttatcttcccattcctttgtacctgtatgccaggcaaagggaactcatctcatcgtttactaccttatgatcttttttcatctcactgcttccttcatctgaacagctctccctgataatttagacctttccaaatcctgagtaccttttatggtccagcttaagtgccttcatttccgtgaagcctatgtctcccctgttgtgcctataatcctttcctttcttgaacattgtagcatagtgggtttgtgtaatcggtttcttttttcaacttcatagtacttggttcattcttttaatatggaacttgttctctgccaagcctgttttgaggggttgtggcagaaaggagttatgtttattctggaatatcaaatagttaaggttatatgaaatgtatgatttaagtcttggtgaaaagtagaatctctgatttgaaaagcgtgtttgcattatattgtagaaagctttggatactgtgctaattatgttgaattttattatataggcaggagggagttaggaccaacccttcctgcttttttctgtctttattactggcatctctgtcttattagcaagctcaaagaccttaaggtgaagcatgcctgggttattaaaggactagcaatggccagataatgtagaacagtggtcttcaaagtgtaattcttggatcagcaaaatctacattacctggaaatttgttagaaatgcagattcttaggtcccttcccagacatactgaattagaaattctgagggtgaggtccagcaatcagtgttttaatgggcccatcagatgattcaatacactgacactacatgtctcctagatatatcagagttagaattacatagaggacttgttaaaacgtagattgttggggcctgagaatttgcatttctaacaagttcataggtgatgctggtgacacttggtcaggaaccatttggagaaccactattgtcagttattacgaagctctttggccattactcccggtgagtcaggaagtccttaggagtttttgagcagaggagtcacatgatcttacgtacattttcaaaggtttactctggctgctgtgttgagaatagggtggaagaggcaagactgagagcagggagaccaggtaggagactgttggagtaattcaggcaagagatgatggtttgaatcacggtgttatcagcagaattggtgagagtggttggattctggagatagtttgactacagagctggcaaaattgatgttgagtttggtataggatatgaggggaggaggagaaggatcaagtatgaaccaagagttttggttcaacaaatggaaggatggagttgctatttagtaagatggggcaggttgtaaaaggagtaggtttgggggaggggtagggcgggagagaaggaatgtgggccttccatgttggacgttttaagttctggagtgatcttgccaatggtatttagatggaatgggtctagttgggaacactaggtggatgggagaggatggaaaagagagatcagagcactgagccctgggcataccacctatactacagttttggagacatgtgctgttttaggtgctggagatacatagtattacattcattccttctttcagcaagcctttgttgaatggccactaatgtgccatgcgttgttttaggtgcttggaatacagcagtgaacaaaacagaaaaagtcaaaaagtctgtaagtttaaggaacttacagtgtaattggggactagacactataaacctaataaatacaagaatgtcgtttggcaatacctgccttgaggaaagataaagcagaagcagaagggtgggaatgcctgggggtggagattgggagggcttgccgttgtatatcagatggccagggaaggccttactgatgaggtgatactcaaagggagaccttagagaagtaagggaattgacctagtagatatctaggggaccagtatcatggcagagggaaccaagaaggcatagccctgaggcagggctgtatttgatttgggtatagaaggagaagaaaaagaagcttggattctgaacctgggaccctacaacatatggagctcaaggagatggagaggaaacagaaaggagaatgagaacaagaacaaggtaggcaggtgcagaaagtgcatcaggaagggagtgattaactgtgttgcatactgctggctgataggtcaaaggagatagggctgagcattgataacaaatttaacattaagtcttttcaggtgaccttgacaagagcagttgcagtggagtgatagagatggaaccctagtgggggtgggttccaaagggaatggaaggagaggatttggagacaaatgtatacaaatctacagacgagttttgctctaaggctgagtagagaaatggggctggtaaccagaggggtaagtgggaggaaagtcggaggatgtttttgagatgggagaagtaatggtgtatttgtttgctgaagggaatgattcagtagagagggaaaatttaatgatgcaggaaagcagggagaattgctgggagaatgtcttagagtagggagggagggataggatctagtggataattggagtggaggtggccttatctaggagcaacagtttattcattttaacaggagggaaagcagagtgtatgagaactgatgctgataggtggagaggtaagcggtgggagcttgcaaaatttctattctgactgcttctgtttcctcaggaaattaggaaactagatctttcagtgagagtgaggatagaggaggaagtgttggaagtttctagtgagaggagtcgtaaaagagcataatagaatcaggaaaagtcaagtattgtcttatgtactctgcaatgatttgtgcacttcattcctacctgccttttcctttgcctgaatgcccttctccattacccttccatctgttaaacttcgtcttttatcctttaaactcagttctatgttcccttctttgatccagtcaggcaaagttgagcattttcttatctgtgcctcagctttgcagtaactcccatgttgctttaattatcaggtttatgttttatctctgtctctcctactcagtggtgagcccctgggagtagaggctgaattttttttatttttatttttttgagaccgcgtcttgctctgttgcccaggctggagtgcagtggcatgatcttggctcactgcaacctccgcctcccaggttcaaacaattctcctgcccagcttcccgagtagctgggattacaggtgcccactaccatgccctgctgatttttgtatttttagtagagacagggttttgccatgttggccatgctggtcttgaactcctgacctcaggtgaccctcctgcttcagcctcccaaagtgctgggattacaggtgtgagccattgcgcctggccaaaggctgaatatttctagtgcctgggatagtgcctggctcatgataggttttcatcaaattagaataacaaaataattctttaaaaggagagtgtcttaagagtgctcatcttgaaaactgtggtattctcatgctaaaggaagtgcctggcacttaaagagatactaaatatttgaactgacaatgagttgtactgtggatgtttgaggtaaacaaacacttcaaattagaaatcttatgcatctctgtgcatcttgcatgtctctatgcccttctctttttatatcctgtggatttttgaatgggtctcatgattgacatggtaggtactcaatacttatgagtgaaatgaatgaatgaacctaattaaaaaggactaataatggagaaactacaatagtagttcagctgtgagatgaaggtggtagcaatgatgaggatggaaatgccagagatactacacagttccccacttaggaagggcagaagggaaggctctaatgctaattaattgtgtactgtatgctataccataccatggttattcctttccattttaaagatggtaaagctgagattcagagatgtttagcaagtcttcatgttatgtctatctgattccatgaaaatacccctttttctgctgccatagagccttgttaatagccctcccatccctttaaaactgtgaattctccccacttttctagttggtttcagtggattgagtttcaaatggcttctgaattaagcagagatgtccttttgtaggcagctttacattgctttactaagctgaaacaaattgtggttgaagatatagattaggaagtgttaaatatgaaggtaataactgaaactgttatagtggatgtgctgccagaagacaagtttatacagaaattctgctttcactgactctgggatctcaccaagtctattaatctgttagaagccagaggaactggcaggaatatagattttctcttttttttacagtttccagaattcagtatgcatatatgttggatagtttaacgattacaggttttcaaaatagtttactaataaactattttattagtatttttttctctttggaaaattgcatcatatgagtggtctactttttctaacccatttatcttgtaggcttttaagaactgtgctattgttgacttcttcacagaatcaagcactcttttggaagagggtaatctctctccaaaaactgaggacacttaccttccccatatattgagtccagctgtgtttggtggcccaggtgagtggcacagtgatttggtgtcttctctataggatatacagaatagtgtggcatttatgagatattggatacatttgtatgaatgtttacagcagttttattaatattttcctgtgcagttattattctgacttacgaatcttgtttcattgtgtttgaaaacttaggtactaatttcaagatgccaggacgttccagttcaaattcaggttcaactggtttcatctccttcagtggtgtagagtctgctctctcctccttgaaaaacttccaagcctgtatcaactctggtatggacacagcttctagtgttgctttggatcttgtggaaagtcagagtaagtaaaattaaaacctcttttgtgtctactttgaggtaacactgtgtggtggtatttatctgggggtgccttttgagtatccttgggggaatgatttaacccctctaggcatctgttgtctcattttattctacacaccgcagcagggtactgagggtgaaataagattgactcattcatgtgtgttcagacagttaagttccatgagaaactgcgctagaaatgtatgggcaaagatttgaagatcctgaccccaaggagcatacaatctaaagtatttgacatttgtgaactgtaaggtatataaatttattatgatattgttatttttcagtagtttatactttggtcatacttgattaaccagtagatagactaagcttatgctagggataccagcaaaggaaggcctcaacaaaaatgagaaaagttcaactttaatgaattttacctacatttgttcaatcaagaagatctagaaagatgtgatttgcaggccgggtgcagtggctcacccctgtaatcctagcactttgggaggccgaggccggcagatcacgaggtcaggagtttgagaccagcctggccaatatggtgaaaccccgtctctactaaaaatacaaaaccaacatggtgaaaccccgtctctactaaaaatacaaaaaattagctgggtgtggtggcaggtgcctgtaattccagctactcgggaggctgagacaggagaatcacttgaacccgggaggtggaggttgcagtgagtcgagaccgagccactgcactccagtctggacaacagagcaagactctgtctcaaaaaaaaaaagaaaaaagatgttatttgctttctttggagtagaatcgtttttattttattttacacatggagccagaggagcagcatgatccttttgttttgtttttattggcataggttttgagcaatttgtgatgtgccggggtgtgattttttttgtcctgactgatattgtttgagatttatggatctgtcagcttatagttttttgaatcaaatttggaaaaatttctgctactatttcttcaaatatatttttttaattcctctgctctcctctccttctgtgtgactcacatttcatgtatgttagatgggttgatattgtcccataaatcagtggaacttgatagattttttccagtctttttactctttagcttcaatttgaataatttctattgctaagttcattcatcttgtctactgcagtgtctaatctgataattccatttagtgaatttaaaaatttcagttactgtatttttaattgttgaagacataacaaagaattaagtagaatctttttttttagtcttccatttctttcttcattgtgtccatattttcctctacattcttgagtatatggagcatgtttataatagctattttaatatccttgtatgttaattctgtcatctctatgtgtattatgttgttgagtgtttggattttgttgtcttttttttttttttttcagccggaattttgctcttgttgcccaggctggagtgcaatggtgcgatctcggctcactgcaacctccgcctcccgggttcaagcgattctcctgcctcagccttcggagtagctggggttacaggcatgcgccaccacgcccagctaattttgtaattttagtagagacggagtttcttcatgttggtcaggctggtctcaaactcccaacctcaggtaatccgcctgccttggccttccaaaatcttggaattacaggcatgagcctccatgcccagcttgttgtcctcttttaaatagtgttggagtttgtttggtgtgcagctaagtgattgtggattaggctgatcctttctaggcttatcgttaagctttgttaggtcaagtctaatatagcctttatgttagggctaatttagccttgttacaaagcatggcccttctggagtctctcttgattgccccgagggttcagtgcgatagctctactctggctggatggaatttgagtgtctcccggtcctaggtcctacgtgactgaacctgggagttgttcactttatagctgtcagtatttgttgctcagcatcttaggactcagcatcagactcaaggggaccccagtgcagattcctagagctctttatctgcatagctccctcactctcttgcaaaccctgctggctgcctcagcctccctgaactgaagtctctgtctcctcaatccttcaagactgctgtgctaggccgagcatggtggctcctacctgtaatcccaacactttgggaggccgaagcaggaggatctcctgaggtcaggagttccaggccaacctgacgaaaccctgtctctactaaaaaacaaaaattaggcatggtggaggatgccagtagtcccagctactggggaggctgaggcaggagaattgcctgaacatgggagaagggggttgcagtgagccgagattgtgccactgtactccagcctggggaagagagtgagactctgtctcaaaaactcccttggattcctcctcccttgcgcagggaggaggccattgcaagacttttcccagttttcccttattgcagtaattacagtcctgtcccgcctttgtcctactgtcccacagctattgtttcatatattttgtttagtttttcagtcattcatggcaggtggaccagctccatacagttattcatttacggctaacagcaggtgtcactcataatctttttagtgggtggcctccaaatgttttaaccctacccagtctgtttttgattatgtttttggtgatcataatttagctttgatagataggcctggataaaagtcataataaaatcttaaaccataagagagaagactggaacataaccccttgggagattgtatcagtttttttcaggattctttttgaagattcctgggagttttagctacagagttttttttttctcttggttttgttttgttttaaataagaggtatattttgttgtaaaatacaacatgtgcaatttaagaagaattataaacatcattttttgaaaggttcatgctctaaagccaaagttggcaaagtttttctataaagggccagataacaaatattttcaactctgtaggccatgtggtttctgtcacaacccgctgttgtagtgcaaaacccaccatagatggtacgtaaatgaatgggcatggctgtggtcttataaaactttatttacaaaaatgggcagtgggccggatttggctcacaggtcttagtttgtcaacccctgctttagtgccgcagattgtcattaagtaatttttaaaagaaagatgtatttattttttaatatttggattaattttacagcaaatacttgattttgcatttaccaaaaaagttaatttaagaaaaattttgagcaagttatatgggaaaaaaagtgaactaaacaacttagacagacacagagtcaccaggagcctggacttcttatgaactcaatatgtatatgaatacatgcgtgtgtgtgtgcatacacacacacacacacacacacacattttaactaataccaggagtcaaaataacaaagtagtcaacataaactaaccaagtgactattctgcatataattcagctctaggttttaaagaggacataaacaagtattaagtagttcttcccttcatagagtttaccatcttagtgggaagacaaacacatattaaaatactaaaacaatgagaaaacagaaaagatgttataaagctgcaaataactaatatcaccactgatcttatcagaaaagtcatacgctctcaaatttataatggtgaacacaaatttttcaaagttctaattttttctttaaaactttcactttgggctgagtgtggtggctcatgtctgtaatcccagcactttgggaggctgaggcaggtggatcacgaggtcaggagtttgagaccagcctgaccaacttggtgaaaccccatctctactaaaaatacaaaaattagccgggcgtggtggtgcgcacctgtaatccgagctactcaggactcaggaggctgaggcaggagaatagcttgaacctgggaggcggaggttgcagtgagcagagatcaggccactgcactccagcctgggcgacagagcaagactccatctcaaaaaaaaaaaacaaacaactttcattttggccgggtgctgtggctcacacttgtaatcctagcactttaggaagccgaggctggaggatcacctgagttcaggagttggagaccagcctggctaacatgacgaaaacctgtctctactaaaaatacaaaaattacctgagcgtggtggtgggcgcctataatcccggctactcgggaggctgaggcaggagaatcgcttgaaccctgggggcggaggttgcagtgagccgagatcacgccactgcactccagcctaagtgaaagggcaaaattctgtctcaaaaaaaaaacaacaaaaaaaaactttcattttaccattagcaacaaatgctgttagttgttgtctttgaaattacagttgcacaggctcactttcttcatttttgagaaaatgtctttcagatacccaaacctgaataaccatagtttgtctgtgaatnnnnnnnnnnnnnnnnnnnntgttccagtctattctagtgtgaggttagggctgaaaagtgagataaaatctatcttccctgttcgaggataatgagatgaaacctcaagatgaaagaaatgttgttaactactgaatgtgagaaagagtgagaagttttaaacttttttttaaatgagtgactcaatgtcctgaagggggaaaagttcaattctttttttttttttttttttttttttgagacagagtctcgctctgtcgcccaggctggagtgcactggcgtgatctcagctcactgcaacctccgcctcttgggttcaagctattctcctgcctcagcctcctgagtcctgagtagctcggattacaggtgcacaccaccatgcccggctaatttttgtatctttagtggagacggggtttcaccatgttgtccagggtggtcttgaactcctgacctcgtgatccaccctcctcgacctcccaaagtgctgggattacaggcatgagccaccaggcctggcctatcaaggacattcttaaatgaaactagcatttgttttactatgagtgcttggtagagaggaatacaatgatctattagagtgcaacagtttggtgccactgctctgatttttgctaaggcaccagcagttttttccacaattgcttttgcaccattagtacaaacattcaacatttgtactaatggtgcaaatgttaaaaaagaaaaagaaaaacaaacaaacccagacaaatagcatcttaaaattatgatgtaaataagctaggcctggtggctgacacccataatcccagcactttgggaggccaacctgggcagattgcttgagctcaggagtttgatactagcctgcagcaacatggcaaaccctgtctctacaaaacatacaaaaattagccaggcatggtggtgcacacctgtagtcccagctactcagaaggctgagatgggaggacagcttaagctcaggtggcagaggttgcaatgagctgagatcacacgactgtactccagcctgggcaacagggccagagcctgtctcaaaaaaaaaataaaaaaaattatgatgaaaatagtttcgacccatggatcccctgaaagggcccagaagaaattacgatgaaaatagttttgacccacggaccccctgaaatggctcagaagaccacactgagaacaaactgagtttgattgcttatgaataggaggtagatgacatgagaagtcctctgcagagagaaagccaagggcaatcactcccactggggtaattcagcaagaacttgttaggggagcagtgttaatgtgataccagactgaggtgctgtccaaggacccagagagtaggaaaacaccggttgtttaaggaaattggagggtagatcagcctgtaacagtagatgaaagacttgtagaaggctgatactaaggcagccagtatcagcacttaagtgcacgcttgctattgggtccagtcctaactctgtcataagttctgtaactttgagtaaggtacctaacttctttcagcttctaatttcttatctgtgaaataggattaaaatgcctgcttcataagattgttgggactaatgagataatatatgctaagtgctctcagccacaatgttaattcaatagctatcatatatgacaaccagcaattagtaaaatttgagggtcagaacttagaagaagggcctgtgatgtgaagagggtaagaaagatggatgagtttggaagtctgtgtaagactgagtccagctaagtcactaattcatcagatatgttgccaaaactacaaagataaataaaggtttcttcctttgagttgtttacagtctaggtaggaaataagacatatacttgttattcaatcattaagtgaacattgatggcctataatgtgatgctttgccaaggagtttgaaccttatcattggaaggtttaaagtagaggaaaaaatatggtaagatccagttttagaaagataactgtccacagcagtactgaggaaggaaagacttcaggtggccaaagaggagattatgtcagtagctcaagtgaaaaagaaaataactttgactaaggtattgtaactaaggtaaaaaggatttgatttgtgtgctatgtatcttataccctcattgtaatacaggcataatagtgtaatagatgattgcttgggttcttatcccagtgccctctcttatctttgtgaccttgggcaaattctctaccctccaatttgcctcaggtttcctatttataaaaggcattattgtggggattagcgagataatattttacaaattacttagaatagtagtaagtgctcagtaattgttagctgttactagtaatttggtgtgcatttgagtttgagttgaccggtgggtgtgttggacaacagagaatggattgggagagattaaagtgcagaagagcaagtggggaatttcatggattatcccagaacagaaatactgttttccttagttttatgagattgttgactttttgggttgcctgatttcatctcaaatcagagtgaactttgataaaccaaatgataatgatcacataggtatcattttatcactttgccctgacattttcctgttgttgtattattaagttattggtaaaggagattcttgctcccaagaactagggtggtgatgtgttttattttgtttcttattggttgcagattcctaattcctataccaggtgtttgtccctgttcaactttctagcttatttgaaatgatcacctttgcctgtgttacgttagaatatatggtgtctaggcaattagactcaccactaccatgtttattcatttttctctaaatttgtcgatattctagtattaccttcttctttgacctaactgggaaatgaaatttgttacattaggagattttttttgagattaccgaagcttatttttttcaggtttttgagtttattatgtacttttctgccatcttacacagaatatactgacctaattaactggaattatttttaaatcatctttaagtagttttagtaagcgctttaggtttagttaagtaaatttgaggaatctcccttctctaaaatgttaatgtacctcaaagatgtaaactacatctttgtagttttcaaagatgtgtcatctcttctcatgcctctctgccagggcaagtctgtgaatgggcttcagaggtttggttaatgctctgcaattctacaaaaatgtatgtgcatgaggattaaaagttttaccagattcttgctaaatatttgatagcaacatttagaagtaaaggattaaagttttctctatatattgcttttctttctgtgatttcggagctatagggcagaaagattacagttactatggtcaggcagttaattgggtatttgttgagctatgctaaagtatggtgatgatgatgaatttgttacatacttaactggtgctctttttacatgtgctatttcatttgatcctaacagtaatcctgtgcagtagggactgttgctgtccccactttacacatgagaaaaattgaggcttagtgaagttacatgcattttttaaggtcacaaagttagtaaatgtttgagtagggatttgattataagcagtctgacttcatagtttctgcccttcaccattacacttcataaaaaatgtattgtgccagcgtcatggcctgtgcagtcaaatgacatttagcgacgttttgcttagataattttggttgttgttgttttttttttttttttttttttttgaggataatgttatctgatttttttttttaaatacccaaatgaggttgcatgctttttctgaaacatcctctcatggaggtcatgtatggtcatggggggaaggagctgggacctttcagggcctttgtactgaccctagactgtctactttcagttcttgtaatggcaggaaaagaaacccctgtttggctaagcaacagctctcatgtttgctcttctttgcagctggttacagtcctgactcatggaagtgattcatcaaattgattgaatgatagtctgttctttcatacatccacaacttgtgttctggctaagaatcatcacctttttagatctagttccttttgtcttaccttaatccccacgcagccaaaaaagttttcactgtgtggcagttacttcagagttcatgatgagtaaaaaacaaccagcaaagtgaaaaattacatggtcagggacatttactgccctcatgaataactgaccttttacatttgcaaatgttaagcatttccttgagagaatagttttaaatccgggtgctttgggggtaagattctagttttgttcctgaataagacattcttaaatctagaaatttggtaagtatgggtgaaaaaaaactcccagaaaattgtgatcatccataaccctatcacccatcaccttattttatgaaaaagggataagcattttgcttaaacctttcatgttcaaaatgttttgaggctggttgcggtggctcatgcctataatcccagcactttgggaggccgaggcgggcggatcacttgaggtcaggagttccagatcagcctggccaacatggtgaaaccccatctctaccaaaaatagaaaaattagctgggtgtggtggtgtgtgcctataatcccagctacttgggaggctaaggcacaagaattgcttgaacccaggaggcagaggttgcagcgagccgagatcacgccactgcactgcaacctaggcagtagagtgagaccgtgtctcaaagaaaaaaaaatggtttgaaaattacttgataattggatatgtcaatacaactgacctgatattttcagggcttgattttttagaaagacttacattctggatttttcactgtgttgtgatatatttctccattagagcactgctttttgttattaggagtctagttgagtcggggagatttctttttgaccttgttcctgtcttttatttcataattattgaatagaaggagtaactagaagtaggtggtttctagtggtgagtggtggccacaatgataataaaaataacaataaccctaagaagccaatgtttgtatgcttatacagcttttataactggagccaactataccagcaaaatagcattataacttaaattagtgaagattattaaacatatatacttaattatgctgtatatagtactaaaagtaaaaggcaatgcctacaccaggatgtagagaaaagggaaacccttgtgtattgttggtgcgaatgt

SEQ ID NO: 1277 - DNA, 336 bp, Homo sapiens
cacccagtttccacccctccctcaaggcggcggtcctcttctatccgcagtcccggacctggagcgggtcagaccccgacttccgcccctgactccccaggcggtcacatgaccgaagcggctgggagcagggaggggcatcatgtgaccactcgccggcgacggctgatgacgcaagagcccgctctcacttttcagcggcaggcgaagggggctgaggaaaggagtggtgtagagtctgctctctcctccttgaaaaacttccaagcctgtatcaactctggtatggacacagcttctagtgttgctttggatcttgtggaaagtcagagtaag

SEQ ID NO: 1278 - protein, 112 aa, Homo sapiens
HPVSTPPSRRRSSSIRSPGPGAGQTPTSAPDSPGGHMTEAAGSREGHHVTTRRRRLMTQEPALTFQRQAKGAEERSGVESALSSLKNFQACINSGMDTASSVALDLVESQSK

SEQ ID NO: 1279 - DNA, 31812 bp, Mus musculus
  misc_feature (1)...(31812): n = A,T,C or G
accctggatgaatggaagtcgtccatgatcgagacgcagctaggagtaagtgggacctggggtaatggcctgccctcagtttgcttgtgggtgtgagccgagccctggatgcaggctgttgtccacagggaacatttgggctaaatgtcaagggctcctagtatggctgtgttagcgctgggttccttttttgtctttaaaatccacagcagcttcaatctagaaaagtgaaatgtaccagtatttcctttaaaaaataatatctttattaattctttgagacttttaaaaagagattttgttattttatgtgtatataagcatgctgtggccgagacaccagaagagggcatcggatcccattacagatggttgtgagccaccacgtgggtgctgggaattgaactcaggacctctggaagagcagccagtgctcttgtccactgagccatctctttagctcctgaaaatgtcttacaatattctctgatattattcaccccctaactccatctgaccaatgcccctttcgccctaacacccccagatccacccctttcccaactctgtgtctcttttcttaaaatcttattatatttttaatagcccaccaaatccgtgtatgctgcccatgtattcatgggtttggagctatctatccactacagtgtatttgacctaccagcagccacatccttaaaaaaatctgactctccctctcctatcacctgttaggagatgggagactgagattccctcccttgctctgtgctagaattgtgactggtttcctcttgccaggtcctgttcaggcaatcacagctgctgtaagctcatgatttgtaataaaaaagttatttaaaatacaaaaaagaaagaaagaaagaaagaaagaaaggaaaaaagaaaggaaggaaggaaggaagaaagaaaagaaaagaaggaaagaaaaccaagttaatcatacaaccaaattaatatacaatttaggaaatagtctatgccatacgtacaagttttgtttatgtgaagaaaatatagaatggctggagagatggctcagtagttaagagctgtgtgctcctgcagagagtcttggtcagtcagtagcagcacctacgtggtgactcacaaccatctttaactccagttccatggaatgctgtgcctccttgtggcctgctggaacttgtgggcacagacacaggcagacaggcaggcaaaatacccacacgcacaaaatacattttaaaaaaatgcatagattgtttttgcaattggcttctaatatgcatatacatttggttagtttacttatttaattttatatgtgcatgtgtttgcctgcatgagttttgtatgtatatgagtttgcctgtattctatatgtgtgtcagagcagtgagaggtgagaagagggtgtaccattccctggaactgtagttaagggtggttgcaaactgtcactcggtttcctgctgtcatgtgggtgctgggaactgagggagggtcctcagccagatcagtcactgctcttttctgaggagccaccactccacaccctggcttcaaggactctatctgttttgttttgtttttagatagggttcctctgtatagccctgggactctctctgtagaccaggctggcctagaacactcacttctgcctcctaagtgatgagatcaagggcatgtaccactacatccagcccaaagactttctattcaggaacccatcatagttctgtggaaaggcagggttactgggttattcctcccagtattgtttttatcacagagaatcagaaacaaatgaaatgttcagtagtacattagttaaagagtttatggagctctgggtggtggcagtggtgcacacctttaatccaagcacctgggaggcagaggcaggccagtctctataaattccaggacagctggtctacacagtgagttccaggacagtcagggctacatagagaaactctgtctggaaaaacaaagccaaccaaccaaccaaccaaccaaccaccaccaacaacaacacaacaattcatggagcatgtaagatggcatggcagagctaaacattactgcagaaaatatttaaagtgtgagaaattatgtgtgttaagaaagcaagccgggcagtggtggtgcacacctttaatcccagcacttggaaggcagaggcaggtggatttctgagtttgagaccagcctggtctgcagagtgagttccaggacagccagggctacacagagaaaccctgtcttgaaaaaaaacaaaaaacaaaaaacaaaaacaaaccaaaaacccaacaacaacaacaaaacaaacaaacaaaaaagtcaaaatgttacaactcagtttataactatgttcccacttataactgacgcaggaaaagtagacttgggggtggggtaggagagatggatcagaggttaaggaagagcactggctgcgtttccagaggacccaggtttaatcctcagcacccaccatgcccctcacagcggtctgtaactctggttccaggaaatccaacatccttttatggcctcttcaggcaaacaccacacacacacacacacacacacacacacacacacacacacacacacacacacagagtacacagaatacattcaggcaaaatactcatacacataaaattttcaaaagaaagactgggagaaatgtgctcagatgttaaaggtagttacttagagtgatgtggttagaagtgctttatagtctcctttgctattcttgtttatgtatttattcagcacctttgcatcaaaagtgcactaaaatgggagctttgaatgctttaatttggaaaccttattcctctgctcccacattccttcctgcccccaagctcactctgcttgggtttggaaaaccttctctctgcagcctcatttaacatggatcgtggaaggtgttgttgcagaccccggagctcctgtctcaggagacccagccttaggtagcttcaggagaacaagggtggtgctttgtcccagaactctgcaagaaccactaattgaccggtatttgtccctaacttccccgggtcacagaacaggagggccattccagaactccttcaccattcctgcaattctccagggaactctcacccttatccccagctggaccttcaggtcctcagtgtacccctcctggtctgcatacaacttgccattgttgactggacagtgcatcaaaaccggcggatttcctccttgggagatgccacttcatggttgccttctgggacctctgccacctgcaggtaagaaacagattccaaagcactttcctcgatagaattccacgaggaagacaatgacagagtccactgaggaaactttcacccaggccaggccaaagcgaatgcggggcagtagggcagggccctcgtgttgggagcacgaggactcatgaagacacagtgtgtgcactgagtaaatactgaactcacgtgtagcatacacgtgcagatgggagcaggagagaatacctactaagtgcaggatgctttccaagtgatcttctgtatgtaaagcaaagctccgagggaaccacacccccattttaccactgagaagtcaagctcagaggacttagatcaaacgcctgtttctaaccagagtggaccttgctggaagtgttttccactgcaaggtcccaaggtctggggacaactgtagcgaccagcttccaagtgcagaaggtgagtttctcagccggtagtccagcgccccctataaggcattgccctaaacacaggtctaggagtttcttcagctttggacctttcttgaactttgtgatgtcctgcctagagagtcttgcctgtgttcctttagatcagcgtaaatggacttgcgtttcctctgctgcgacactaggtcaaagctgcccggaatcaagaacgacttgttttctcagctggttctgatgtctatgtgatgcatcttagatctaacctctccaaagcgaaggaaggacccatgcacctccgaagtcttggaaggtgcatgggtggaagtggggccttggtcagagtttgaggagacaccacccttagaggtccaatttctaactggaagccacgcatttagctcaagagccctttctcgatttgcattcctacaaccgaggtatgtggcgtgggcggaggtgttggtgtgcggggtgtgcgttgaaggagatcgctagtgccagctggattgaaattcgaactggtgtgatatttgtagctgcctccctaacacacacacacacacacacacacacacacacacacacacacacacacacacctacctggagagtgacttgggaaggttagtgtttcatggagaaaaaaagttggaccaagaagccatgagtgagcgttttttggggcgagggtcaggggagggagagaaaagggcctagtgtgtgctttctgtcaccccctacgggttcagagccagggctcccctgtgggcagtctctcccgcactgagcattgagtgcccgacaagtgcgcgcaccaagtgtgtacgtgagtatacgtgtgaaatgtggcggcgctggccgctgcggagtgtgcgctccgcaaaaatatgaataatcaacacatcgctcacacctccgccgggagcgggaagggagctgggaggtcccgcgggctttcccctgccggctggcagggggcgggggaccaccaggaaaaaaaaagggggggggcatttcagagaggctttctgcttatctcaagtgagctgaaaagctaggagggggtaaggttaggcgagtcacatttaattttccccctttaaaggtcatcccttgcctatcctgtttggaaatggaagaccagtgaggggattgtttttctgctttgcagcggagctgtgacttggcacctcagcccctgcccaagctctctttgcaactccgcggtgtggaagttcatcagccactgaaccggtgtcaacctgaatggaggaatgcgcagccagtgcctggcaccccaaaacttcttggtgtgcatctgtcccttcctgatcgtggcttcctgagtacaatttgggacagtataccgggcctttctgcataggtttctggaagtggccgaaaccaggccagtttattcaagcgtggccccaaggaaaggccttgtctagtctagacacccagcagcagaaacgctgaattccagtgttaagagtagaagctgccagtcacctgtgtcctgtcgcataccctagccattcctgcgctgccagcgggcccagtgcagatgacaccagggctccgaaggccactgttacagctgttgccaccgctggcattgttgctcctccttaccttactccttactgtcgtaaggtaaggactttttgcgatcgatcgctcggaatgagcgagtgggaaaaaaaataaagcgtatttctttgcgcttgctaccaaggaggtatgagagaagccgaggatgggcgaggaaggaggagttgaggaagacttttctggagcaagtgttaggttccttcggttcatttttagtaaacacttcccagttgacttgggcaccataccggcgagcctctaaaactttctatcctgtaattttagtgtttctctaggtggtcccgcttgaccctgtttcatcgtgttaaaaacaaatcaaaatcgtacccaagtctaatcgaactgtccttgaaggaaatttcttggtgtggacatgtgagatatttatcatgaaaccataaatgaagtaatttctttgctctcccctctctggggaattcacacttatgtactatacaaatctagtttctggaaggagaaaaaaaatgcccagcttggaatttggtgtgggaatcagtgaaatcagagtttttatataaaaatcatttacaaattgtggattaaatacccagtaggtctctgagatagagcaaagccatttgttactagttgggcaaataaaagcccggtttaaataaaaacaaaaactggtaaatgaaaaatgcttgtccaaagatagcttatggagaccaaaccttttaaatttacagggctcatactagctgtcccggtattcaggaagggtccaggtctgtgctttgggatgcatagaggcagacacacgagagagagagagagagagagagagagagagagagagagagagagagagagagagttgtggggtgagggatgtgttatgacgcctggagggcatacctcaaacctccgactttgagaagggccccagcgcacaggatgtcagggctggtaaattctgggccaaccgggccttaaaaccaatttcggcctgaacatattgtcttaagctgcagtacaacacgaacaagggggagggggaattcaaacctggactctggtattttagaagggtgaacaaaagcggtgacaacgtataaaatgagatcccaaaccacttccccagtttgtgtaactagatggtcgtgaaaaatagtaatactgtgagttctgattttttctcgaggatggaacgcgagactccccagtccttggtggaggaagcttgaggctgcgagtggggttgggtatgggggggagggggcggacacccagccgggtcccggtcctggtcccggacccggcggcatttgtgtttcaggttcctaatggagggttattctcacgtagctggaggcgaaggagatggaagcaaccctctgggcgccacgattgcgcgccgcagccaccagcaccgcttctttagcacgggtggtcaattcttccgccacccctccctaagaccttgacaaacataatcaaagccaaggcggttggcagaaccgctctcggcgcgcacaagcgttacagcttagggcacaaggccgactgctcctctatactcggtctggaacttcatttatgcgtaaaagggacttctggactttgggctcaccaccctaggaaccccaagtggtcggtccgcagtctgtccccagtgttcagaggagccgcaggggaggtggggtggttcctcagtgcagaccactaagagccaagcgtcccactgagttctagaggtaaggcacccacacactatctcccagcagggcaccgccacccctgaacttgtcactgggaaggagggaggtgagacgccactgacagtatgctttggagaaggcagcagggagcaaggagaaaggaacaattcattcgcttcctgaggggtataatttgggcggcagctgttactggtgagaaaagaggcgtcagcgaccttggctctgccctttaacctggagcctctgggggccggcgggccgggctaggccggagcccgttgctgccccgcagtccctcaggctctccgcatctttcgcgaacattttcgaggtggagctgatcaaagtctccttggggaggttaaaacaaaactaaacaaaagccagccgtttcatccacacgtcggagggctcatcggctggtccacactcttcaccgaggaacctgaggccttgcccagctgggaacatggccgggacaagaaagaaggacaagagattagttaaattcagcagacttaaaaaaacaaaaacaaaacaaaactaaaactaaaaccaaaccaaaacaaaaacgagcaggcccagctcgaagactctgggtggttagtttttcctggggtcgcaattatccgtaaagtcttgtgtaactgaactgcgcagctgaaagagcagaggtggatcttatctcgaccattttctcccccaccctccctcttttgttggataactgccgaatgcaactaggcctcttattttcttacactcaactgtacctcaagccaccctgcctcccctttaagcctgaagttaaagacctggagttagggtacaccatcaacgcgactccagcccccctccccagtctgtgcaaagagagccccagccagctttcaagtcagtcactgctgtagagagagaccaagtcttccggagcaccatcccgcctgcgcagtctgtagtcacagtttgcccctgaggtgaagtgacgtgctcaggtccccttctatggagactcaagcagtctctgaaagcgcaagcttccttttcgctcgccgggcaaacgtgcaccccaggcgctgtgtcctctagcggcgaactctcgcagctcgtctgtgagcgctcacctacagctagggggtccggtcaggagtcaattgacactcaaacctgagccctgagccgggaggaaagactcccgactgtaatgatgctgagaggctcgggtgcagtcgctcgaaccgcggcgcagctgattgtctgctccacggcagatggtctttgagcacagatttgcattcattgtcttcaaatctgttttcgcgctggcgttctagatttcaacagcagatctacgcgcagatcagaatacaaaaagagaagcaagaaaataacacccagccaggaggatttttttttaataggcacctccagccgtctagggtttcagctattttgtggagcctcggcttcccgaccaccaaccttcgcgaccacagcgctcggcggacaaagtttccaggacttcttcacagacgcctcgtgtctctaacgcagggttccccggccttcagggattggggagggagattttaaaaggggggaggattcgaaacttcatcccgcagttctcagccagccaagctgtcagcaacctctcctatctgcaaaggtgcgtactcccgccctcccggggctgttttccttaactccttcaccatttcccttcacagtatatttatttaaactgcacttgagcctcattcgtccacactccgctctctccttccttcatctcgcctctccttctaacacttgtggccttcgcacgaaatgattgcttccctggaactctctgagacttggtagaccggttcagaaagacggatgccctgagggtagtgtttgcgaaaagcataaatacaggtggtcacaggtccaaaccccgggaatgaatctgtagggtctcccgcaggcgacaaaaaacctgcatctagaggcaaatccgcgctggcttcctgctcccgcgatcggaaagaaccatcatgatcctaactctcagagtcctgctactctgttttggtgcaggatttggggaccccctttcccactcaggccaaacactcgggactctggtcgggactcggtgcttgtggcttgctgtagcctttcacctcccggacttcgggcaaagcaaagcttggctaacgccgcgggaggacgtccgcccagcttgcccagagccggccaatcccgggcgtccatgcaaatgaggctccttatcgggcctcggctccgcctcccgcggcctgggttgtagtaaccattcatggggcccgcgcgctgcagcagcccggctctgcggcgctctcagccaccgcctcctccccgctccgggtcttccccttcctcttacaactgatcctgttggggatttttttttttttttcctatatcggaacggtggggaggagcagggaggggggaacaaggaggaaggggagagatcaggcagctatctatctcctcctgtttttcccagaacaggtgatgcttccaaattgtggccactttctggagaacgttctgcagctggaaggatgcgggcgacctagagtggaagccccgaggcggcagatctgaagccaccgaggataaaaaacgcaaactttgcattgtgcgtggaggaacgggctggctatttctttccaagagggcccccaaacttcggcccttgccgcctttctcggattgcttttggagaacaccatttgctggcagcattggagagtgaggacggtgttgttgtaaagtcacttttaaggcgacagtagaggaccagactttttaaatgtttgggattcaagatacgctaggaagaggaccagctctgaaagacaagtcgctgggtgccgagatggattcggtcaggtcctgggtccggaatgtcggcgtggtggacgccaatgtcgcggctcagaggtaatgagactggagccgttgtgctctgaaagtctctggttgtgtctgtctccccgaatatctcttccctttgctccctctctttctctctgtccttgtctctcctccctggctgtgcgcactggggctctccctgggcgggcaggtcgctgcgactaggggaacccttttcccgcagtcgacactgtagtttctgaactaccgaggtcacgggtgtttctccccacagtccgttctttgaggacaaaaaaaatttattaaaagtagcgttcaagctcacatcgtggcgtttactcttggactctagcggagtggcgcgtgaagatccgagctggcagccggcgcagcggcagagccggctttccggtcactcctaggttcccccacgcttcctgcgagcgcctctcctccagcatcattcaggatggcttggagactcggggagcccagcggccagatggtggcggcggcgagaggatccggagaggcctgaggggctgcaaggaaagcaaggcggccgggagctctaggaaaggggacatgcaagcgagtcctgggtgagggagagtgggacagacaaaccgaagaggccgaggatggaccgaagcacaggagtagtcggggaagaggagaaaatggagccgcagagaagagcaccctccagttttgcgggttcctcaagttgattttgtttccaaatcttcgcgtttacggatggttaaaatttgtctagggttccatcccacgaagacattccagtcccgcttctcactgtcgctactgaactgagattcatggccctcgtgtccagactacaagagccagctcctttaccctctccagacacccacaaatttcttccaggactctcgactcttcctctgcgctctgcgttctgcgccaacctccttaaatctccggacttcacgttgagaaatgaccccttttgcagataggccacatctccaggtgtcccgggtagagcgaactggctgccacccttcaaggagtggcagcaaaggccgcaagccggatgcctgaagtggcagctgcggtacccgattgccactcctccgaagccgaatgctcagttgtccccgaagcagatggtacttcgcagaggccttggctctcgaaagcggtctaggggttcgctccggcggtgacaagccgagggaaccaagacagttccgcagatccgctccttagcgggggcttaataacatttccctccagtcttcccgtccgaaataaaatgtactttattaaagttcgaaacagcagtctgtggtggtctagcgaaaattatacactttcaaaaaagtgactgagaccatgcccagcacaagaatccagaagacctcagggccaccaggctgccctcaccatctgtcaattcgccggctccacaaggttttcagtcaaatgtggcactatcagagacaggcatatagggaggtcctgtggacgcatccaaggctctggcaagctctgggtccagctatacagagtcagggaatttgagaaaacactcgagcgcggatcgcccgagtctctggccggggcgctgctgtctcttaacattctggcttcttctggctttgacacgtggagcggttcttgggggcgaaggtcctcagcagtgagtcctcaaccctggcccgttatccccagcaatgactgtaggggattttgcagtgacactgtcctggatgcaaatttcggtagagtaaggcaaaccttgaggacagaggcttggactccacaggcttcctatcctgtagtctgtgatccaaaaattcactagccaggagttaaaaggggtcacttgttcaaatgcaaaagaaccctatccccttacatctgagtcacagctttgagttttgcgggcaggcacctggggtttagcagcgcttcttaagacttcgccggcagccctggtctttctattctactaaaagccgtctggtgacaggattctgggtggctgtataacggggtggcggaagcaaggtgcctattgcaacccctctgagagagtgtggaaaagacccagaaggtttctggtcttgagtcccttggcccttctgcaatgtgtttgggcatgttagtcactgcctaacacccagtctttctgtctttcccccttgtcctgtttctctctcccaacacttcctgtgcagcggagttgctctgtcccgggcccattttgaaaagcaacctccttcaaacttgaggaaatccaacttctttcattttgtcctggcgctctacgacaggcagggacagccggtggagattgagcgcacagccttcgtggactttgtggagaatgacaaagtaagcggaccccttaaaccctcccccccctaagccggcactgaggattccatctgtcacttgcgacactctcccgctagcatcaggaatgataaattgaggtgtctcacccttagcttctaactcagtagattttccctgcacctcaatgggccccaactctgaaccaggcgttttcggctgtgcgccctagccttggggtcagtagtagcggcagtgcatcgactgacctcgcagaaaaaagttttttagacctagttttaaaagtatacccaacgctgtcgctgccagtctccagtttttcttaaaattattattactattattttctctctggcagcgggaaagagggcaggggtgtagttggttggattccgttttatgtgggaacttggggccagccttttatggctcgcttactctcccagcgactgagcaccttccttgaactcaaaccctaatttgaaagctatgtttaatcctaaacgaagggttgttttcctaaaccaatatatgctgggcccattggctgtgcaaagaaagggaaacctggggtggctagtcgccaagcccctgaacactggaagtggtcattcccagtttgttccccacccctccccaaaggcgactaatattgccctttctaaaggacaggcaggcttacccttttttgtagagcctgggagctcaaggacagatagacaggggtggggactgcttaaagacagctttgatgctggcatcaggcatcggccggctggaggcaggggtacccttaggaaatttttaaaagagagacagggacggtgaaggtcaagcggttgtaggccttgacaaatttcccaagatggccaatggtgggaaatgctccttgtccattggtctggatctggttgtgtgggggcactgcaaagttgaagaatggagggcttctgtcttttcaggagcaaggcaatgagaagaccaacaatggtactcactacaagttacagctcctttacagcaacggtaagtggcttcatgggcaggcactggtcatcaggcagccaagactggtggctgctgtgtctgcctcctactgtgcttgggagggtagaaagctagtgagtgcagtcctgtggggactctgtgtgtgtgtgtgtgtgtgtgtgtgtgtgagccttggtcgggatgacagttgaggggtgtctctcttcatgtcaattccatctaggggtttgtggcttgactgactgggtcaggctcggggcagggaaagggttggggtgggtgcgaaagggtcttggctattcttgccaaccgcctgtccccctcctgtgcaggtgtccgcacggagcaggacctgtatgtcaggctcatcgactctgtcaccaaacaggtgagaccaaagggagcctactgtggactccccacttccccgcgttgtccggtgacttctgctcctagcacgatttgcagcaggggattcacagttctctttacctcaagtctgctctggggaaccccctccccctgctctggtggccctgtttcatgtgctatgggggagattctgggtgttgggaggtgacaaattaatgactgaagacagcgaacagttactgaagattcagttcgctggagaattcctctttgctgagaactaagggcaaacttcttcttctggctgttttaaccgagcaaagactttggttctgtgctgtgggagagggagaggagggagctctcttcagggcccggtgagagggaaccgagttagggcttgttctaaagtctccaccctgtctgtgtctccttcctgacagcccatagcctatgagggacagaataagaatcccgaaatgtgcagagttctgctgacacacgaggtgatgtgcaggtaagaggcaccttttccttgggctggaaagctagggaatcccggggctgagttgccaagggaacctggtagattggaacctaagctgatctgaagctcagaaaaccctcctagttttctaggactgggaaagggaaaccagagagtggattccatccacctgacttcccagagtttcttccacaggatgggcaatctcagctgcttgcttaggtgttgggccaggcttcattttgaatctgggacgagggctcgcaccagtctctgttactgcttggccttaagcttagggtagatttctgagggtgccacttgttgagccctgggtaccaccagagagctgagaggcctattcccaggcactgcccaggtcctaggcctctctgtcctcggtgagatgtctgggcttttcatcccctgctgttaaagtcacttctcccactgcaagatttcacagcagggtcatatcttaggccaagaaggaattgtggggcagaaaatcttttgcgggggtggggggggggagggaggggacagggaaatgaataggcacacagggagaaacccatgcttgggacatctgaggttccaggaacgatggattcagaggatcacactgtgaaaggcacagtctgttggagttcttggctttcccacnnnnnnnnnnnnnnnnnnnnctgttggagttcttggctttcccacctgccctccagagcccagtccattctattttgagccgtgcacattgtccccctttcttctactcaaacagaagaaaatagatggggacggtggtgtagggaattcactctcacattaagtctttcaattaatgttttcggagtgcctggtgtgtgctgtctagcgcatagggtgttaataccgttcacgggagggaacataccgaggagatgctgggaaggactcacttcagcaggaaccatcaacgtctgttttctacacacacatcttcctctctccacagttcgactggaggaaaagccttggttttcttccagtcctcctctctttctgagcagtctgggggtaactgcaggacacctgacttagtagggttgctccttaggcagctctctcaaggcaacccccccaaccccccaaccccttaacccagccagtaaggaaccataccaacctgacatgcttgttcaggttgtagccaagccttagaacagcaaattcaccaagaggcaaagttgaggcctggccacagcctcgacagaagtgtactgaggtaccacagcctggaaaagcctgggcctcgggtagatactccattacctcagagctcttgacaggtctggttagaatgaaaacactgttctaagatgtccttgtcggtaatacccagactccgcaggcacagtgctttgatttggttggctagtcaaaaggacatttcatctgtcactacctgttaagtatctttgtttggagagacagtcttaaaagataaaaaaggcccaagtagtccaccgtctatgacaccgccccatcactttaaataatactcagaaccccgcatgcagccgtagttaaggatgacatttttattttttaagcctaatcaaatcttccccattttatgctgtttaaatagcagcatcaatttttaaagcccctagtttagtctgcattagtaacacaatataaaaatttaatgtactgtaacttctttgcagtggagagccaggaagatgaactcttactttctctctagattctcaaacaaatattaattataggtggataaattatccattggatgggttactgtctgtagtgtgtacatgcatgcgtgtttgtgtggtgtttgtatgtgtctgggcatgtgtgtgtctgggcatgtgtgtgtatgtgtgcatcgggtgggtatatctgtgtgtgtttgtgtgtgtgtgtctgtgtatatctgtgcatgtgtgtgtttatgtgtgtgtatctgtgctcatgtgtatttttttgtgtgtgtatctgcgtatatctgtgtatgtgtctgtgtgtgtatttgtgtgtgtgtgtgtgtgcgcgtgtgtgtgtgtgtgtgtgtgtgtgtatgtgtgtgtgttgggagatgagagacatgtgactccacaggcacaagggaacttttcactagtcaaaaagggctgattctcttggaaggggacacgttccttcttcatttgaacagtcagtcacagctgtcaatggtggagtatgaataaggtgcccagttcttcagtgaccaattagtacacatagttcctttgcatggtcttgtctggtgtacctgggcacttccggaaatggtttgctattctgtattcattagtaaagggttcattaattgtctttagctttggtggtggggatggtgtgtgtgtgtgtgtgtgtgtgtgtgtgcgcgtgcgactcggtgtatgtctgtgtgtgtgataaaacaaaggggcaaaattcatctctttaggaatatttttttcttgcttccccagtgatctctgatcctctctttgctgcgttagttcatttcgccaattattagcaaggagatatctaggtgttatgttgctgcctgccacccctgcgccctcaatgctcagagggttaaaagatattataatttgaacagaagtcgtctctaggcctacagctggctaataacagagttgtattgagcgtgagcaaaccccacagctgtgacttttcgccacaaggcgcaggctagacagggccctaatcagatgggccagccgggcagtggggccagtgtctttatcggccagatggtgtgaatttagacacttttgttatgcaatcgcagggaggagttggggagaagaaaacaaaacaaaagccaccatgctgtgagcttatttgagtttgaaattagagacagatttttgaaagttgagggttgaattttaaaaaatgagtttggaagggaaaaggacacattagcttatcttgggctggagtttggctgactagacatcctcagactgagaccagggctttttttttttcccttccccagccatcttttcatctttctctcattttcccctttcctaaaaaaaaaattcaggtaagattcagaattgtgataaaaatttctcagattcaatctccactcccccaagcctttgtttttctttttccctcttcaaagattccatagggaggagaggccttgtgagcaacttgagagtgttttaagcagaaggcaccccaaataaattgtagaattaactaaaccaaacctaaacaggcagggacacagagagatagctttcactttcacacatgagaaaaagaaaccccacaaaccctcagggtagttggtagtttagttttaacctattgaagttagcctgctttctttctttctttctttctttctttctttctctctttctttctttctttctttctttctttctttctttctttctttctttctttccttctttcttgtcattgccagttaaaagcaaaacaaaatgtaggacagtggtggcacacatctttaatcccagcactgggacaggcagaggcaggcagatctctgtgagtttgaggccagcctggtctacagagtgaggtccaagacagccagagatacacagagaaaccctgcctcaaaaacaaaacaaaacaaaacaaaacaaaaaacaaaaaacaaaaaacaaaaccaaccaaacaaacaaaaaaccaaattaaaccaaacaaaaaatttcttctcaggaacttcagaccgaggaaactgtctgttgaagtataaccctaagagccttgaaacttaagtaggtaaacctgagttggtcattcagaccttgttcagagaggaaagaaaacgggacaatgtcacctgagtaattcagggacccagttcctgagtgtcagctcccaacagtgtcggggaccatgggtttctatgtgtcttaggtttactgcttctgttgtttcttaggaatgctaagactgactgctacttaaggatcaaactaaacacaaccagaccacattaatgagagcttcctttaaaaccaaatcaacccaaaaactggaaaaggaatttgttttaactgagagacccagagaattataaggaacattcaaatggggcaatataactagttcctattatgtttatatttttactattgaagtttagtgccccagtgaatgtctgtgtatctcttctctgctgggtgttgatattagatagaggtgatatttcaatatattcctattggaaacgaaggctcagtttctctgcatttctgtccctgcctgactccctcacgttataccatcctggcacaatagagaaaattctcatgaaaagcagctgaaattttgcaaacttacaggcctcctcagaatcgttccaccccaagctaaacagattggcacattctaagggcatatgtgattgtaattaaattgtaccagtgctgcgcacattgttgggactaggccgacaagctggtgatgtcaaaggacagtctagctttggaggtctttagctgtctagtgtgtgggtggggggtgggcctggtgcatgaggagtttgcagggaatgcaaaggctttggagggtggagtggagctggctgggaggattttatggtgttcatattggggtgcattgaaattttaagagttaagagctaatataatttcaaaggtcaaatattattttggaaggtcccagtggcaaaggctggcaatcaggaaagttgagatcatttttaatatttactaattcgatgtgtgtcttagagctgcctcgtgctcattgggtgggcaggtgttcctgtctctcaagggtctttcacgctctgagggtggtatggtggcccaccagtgaatctgtatatctctggcgagagaggggtttcaaacgtttgtaaatattcattttattttttttataaaaagatggctggagagatggctcagcagttcagaacacttgccactcttgcaggggacccagttccagtttctaacacccatacgctagctcatagtcacctgtaacttcagttctcggggactcaacatcctcttctgccccctctaaacaccaggcacacgtgtggaacacatacctgcaggcaaaccacttatatgcgtaaagttgaataaaatataaaaataaataaataaataaataaaggcagcacacacccctttaatccagtacttgggaggccaagccaggctgatctttgtgagtttgacgccagtctggtctacagaacaaattctaggacacccaggactgtccagggaaaacccagtattgaaaaacaaaacaggtggggcagtggtggcacatgcctttaatcccagcactcgggaggcagaggcaggcagatttctgagttagaggccagcctggtctacagagtgagttccaggacagccagggctatacagagaaaccctgtctcaaaaaaccaaaaccaaaaccaaacaaccaaaaaaccaccaccatcaccaccaataacaacttctttttctacctgtgttttgtttctatatctgtgtgtgtgtgatatgcatgcctggtgccctaggtgactgtgaaaagacatgggatcttctgcagcagaagctacagatgttgtgagccaccacgtggtgctgggaatccaatttgggtcatcaggaagagcagtcagtgcttttaactgctgagccatctctccagcctttacatttgcttgtgtgtattcaatcctgtggagaatcagagggagaatgggcaggctgcagagggtcactgagcagacccttgcctgggctgggacaggttttgtggtaccttgttgccacatgggtcttattcctgtttctttttgtactgttgtaatttgcatgcactccctcccatcacttccccctcatcagctgaaacctagaagcccctctaaagataatcaaccctaatgctttctggagaaggaagcagaactcagagggattcaggataatggactgagttcatgtggttagttagtgatgggttagatgtcagacctcttattcctggtctagcagtttcttagaggtggcgctctaggtctgagcttcagagaaaccatggcatggaagccttcacatgcagatggttattacgaacatgtattaggtagctctggggctggagaaatggctcagcagttaagaacacaggctgctcttctagaggtcctgagttcaattcccggcaacgatatggtagctcatgtattagatagcttcgacatgtagggatggttgtggttttcttaggagctatgccatggctacaggctgaatcaaccatacttgatagtgagtgttcaagagagtgtggtctgatgagcagcagctggggatttgtgtacagggttggccacctcacgtttgtctgtttaatttgaacagatacttttgggctggcatgttgcttcctcagagccatttggggccttttctcattgttgtagttgctctgtattctctctctctctctctctctctctctctctctctctctctcctccctcccttccacctttcttcccacgcttcctctctcagttcctcctttcctcaacatttctctgtctgtctgtctgtctgtctaccaggctccctgtacgttacagagggggacacctcaggaggcagagactttaagactggaacttggatacaattaagtcctatttctgctttgacagaattgttagctactcttctccaactctgtggtttatttccttcctattttaaaatgtataacattcttttttttatatgttcatttttaaataaaatgtataattttataatgcataaaattaaaaatgtataaatttgtaatatatgttttattttaaaatgtataaaatgtatacatttaaaaatgtataaatgcttgtctttctctttggagaatgacaacaataagtggataaataaatgcttagaaaggacacccagttctccagagaaagctggcaggccagtaaggttttacaataacccaggcagctacctttggtctattttctacattctcgcaccttttctttctttaaatatttattgggatacaaagacctgaaatacactttcatagaaatcgtcatacatcagcctggaagtaacctcgtagaccttaaaatccaaacatctgtggttaagttccagatctggctctcgggaaagttgagctctggcagcttggagagcagagaatctgagtgagtttcccagcttcagattgagggtttgaaaaataaatagaacattgttgcaaagtttgctgtgatgcagcttggggtcccgaggctacctaggctgtttccaggtgttcttactgcagtaggcttgtggagcctttttggtttaacgcggtttctctcacaccatcttgactccttcccgttctacagtcgatgctgtgagaagaagagctgcgggaaccggaacgagaccccttcagacccggtcatcatcgacaggtaggggaatgtcgccgccatttctgctcttcagtttctttccttcctgagtctccactctgaggactgatcctggaggacttctgctgtaagcttggctttgtattttctacaaggcacgaagctcctgcagccaggatttcctcatgttggcgatgtctctggaaagaaatcagggccttccttttgttatcctttatccactcccttatttaatctttggtgttttgcgatgtgactttgacagcccaggttgtgcttaaatgcgtgctccatcctgcatcagcttcccaggcgctggggtacagacttgtgccgggaccagcctttcagaaggtgaccctttaaatcactggcagatttatttgtatgtcttataacatatgtggatgacagaggatggtgaggcctttgtccaaccccagtacctctggcaggtgtggtcgatcacttccctggaggaatcagtacaccacaacctcagtgacattgttaaaaaccgtgttttgtggcttctgctggacttgaagtctgtcacctcaggtaaccatgtacgggctcctgacaaatttgctcttgtactgaggaagagtccttcctaacacacaggaccgtagtctgggttctacgctgtgttcagagtgagatagattctctgggacaagatgctaattcactgaaatgtgatttaagcgtcctcagctgtctgtttttgtgattggaaacagaacttacaaaccgacgaagaaataccaaattaacttccagcaatcatgtaatttttaaagaaaccccatattcccatccctaattttttctctttcgttaaaaaacgggaagaattccctgttgtttctttctgtgggttttcgggtttctagccaggtcctgaaatggttcgaagagacctccgtctccaaagttgttattctaatattccagtatattctcagtggggaggcggaacctctggcagtcttcccaggaaagtcagcttgctttctgcatggaaagtatagcacagccatagggacttaggaggctggacttgtgagcctgtcctagctcttgaccttggccaaagcactcagcatcactgttcatccataggaaagtgatggctgccaggggatgctgcctgctgctgtaggccgcaggagaggatggagatgcttggaagagggcaccgaacaagtggaagtggttgtgggatgtgtatgggaatttaatgtgtatttgtaatttaaagggggctgtttggagtttctctggtttttataaaagaatatatctatataccattgggagaactctctggggccattcatctttctcattttatagattaaaaatacaaaacaaaacaaagaaatggagccccagagtggagacgtgttgtgcacagttggcatggcagacttggcaccagaatatagtagatcttactgtcagacttatgctcccctcaattcaacaactgcattctcccagcatgccctctgttctaaccaatgcctagggcctgctgactacacagaatatcatctctgcccttcccacaatacctttgggatcctctgggaactggaagcatatgcaagtgcctagatacaagtcttgccctttggagtgtatacataagctcactgatcgtcatctagtctttgtggggtgtgtgtgtgtgtgtgtgtccgcccgtccgatggtgtgcttccacagtgcttgtgtgatgttcagagaacaaccttggattgtggtctttgatttctaccttgttcaagatagggactcttcttattcattgcccattccataggctagctggcccaccagtgtctgggcagtgtactgttacagcctcccatctccctgtagggggcgccagtatcacaaacactaatgctactgagtctggctttcatgtgggttctagggatctaaacaagagttctcagacctgtgctataagcactctccccactttgcccggctctcatctagtttcccccactaactccagtgcctctttcagaaaggttacctagtttcatgactctcatatctcttctggggataaatatcccatacgacagttttagaaatgcttgcagacctgtaaatgccagctgacccttgcatcttacaagcacacatcccaccgattctgcttcgcagtagctttttactttcaatgctgttggtaaaatgcattcctggataaagctaattgtgctctgagaaatacatggtaagagcaccaaagaacccagcggtggtggggtggggtgggggaggtagctgcatgtctttaattgcagcactcaggagacagaggcaggagaatctctgtcagtttgaggcagcctgggatacagagagtttcaggacagccaaggctacacagagaaactctgacttgaaaaacaaaacaaaacaaaaccaaccaataaaacaaacagcaacaaagaaagcagtctttaaaaaaattatatgtacttgtctgtgtggggattggtacacatgagtgcagttcccatcaaggccaggagagggcattggggtggctagagatggatgtcaggaactgaactctggtcctctgggagagagcataacttcttaaccacttggctatctctgcagctcccagaaggcaatattctttcttctgtggagacaaaagagtttcatattaggtgtcttcatgggttgtgttagagtgcttcacatttttctaagatggtagaaattgtgtccttacaaatataatgtgacggtggcatttgttttaaacattatgtacacatccaaagagcctggcgaagtctctgagtcacctgaaatacgtgctacttccaaacactgcacatgcacacatggaaacatacaagcagaacaatgctatacacttgtttaacgccaggtcttaggagaactgcttttattatgaacaactataaacgtatgcatttgtgcgtcttccttattgtagagtccttttctgaagacatggcttcctcaccagagccttatctcgctgctctcaaacgtctcttgggtataacctccattttaaggtcttgccttcatttttaagaagtgagaaggcacgtacgcagtcaggctcctgtttgttaggtgggaaggtgggtggagcttgtatcgtccagcgatttgattggccctgttcatatggtccttgggttcaacggctgccagcgctaaggtgtcgcatttccttacggagcaccaaatgggtgcaaagcagttgatttcagctttcctctgagtaaatgtccaggtctctcctttgcccttgttcccatactaccggctaattatctcacccttccgcacccagcctcgccagatgcagttaatttacacgtctctttttgagcctcctcgaagcgtaggcacatccctcactctctccactccagctcaagggaagaggacttactcccttggatttgtaaatgttcatggaagggggaggcacaagcatgattctccaacgttccatcccctttcaagggtttcttttgtatgtatgtgtgtgtgtgtgtgtgtgtgtgtgtgtgtgtgtgtgtgtatgtatgtatgtatgtatgtatgtgtgtatgtatgcatgtattgccttggtgactgcaacaccgcagtgaaaggatacgggtatatcgatgatataccctctatgggataacgaaacaggaggcagaaaacgtcatagagatgcccttcacatcagcaatggccaattagagtctttggtcagggtgaggcaaacagcactcctacatgacacaagggattctaggctgcaaccaaacaactgcgttgcccaaggagcccctgtgatcacaccttagcaacggctcagtttccaacaggccgctccaaattcgaaaagcagtgttcaacattgtgtggccccttaattgatagttagcttttacagtaggggatccttaccaggaacttggttttctgtttaccaagacttagctccaaacttaagaggtgtatcctgctaaatgtctctctaccttgatggctctctctagaaacatacacctactttgtgtgtgtgtgtgtgtgtgtgtgtgtgtgtgcgtgtgatttgttgttttattttattttattttattttattttatgtgcatgagtgttttgtctatatgcatgtctgggcactatgtgagtgcaacgtctcagaggtcaaaagaaggttctggccttcctggaactgaggttacagatatttgtcagccactatgtgggtgctgggcattgaacctgtgtcctctggaagagcagttagtttgtttaaccactcagctgtctctccagcccctttcaggtcagggtttctctctgtagccctagctgtcctggaactcacctgtagaccaggccatccttgaactcacatatctactagcctctgcctcctgagtgctggagttaaaggtgtatgccaccattgcctggatctattttctcattcttagttgtatcttcagcatgcttttgggaagttttgggtaaccaccccttcttccagaaagctcagaccagtagaattacaaggatttgcaaagacactgaaaagtcacgtgaattgaggggctcagattcacccatttttcagtacaaaaaaatgcaaagttcttcgggaaaatacaaaacatgacagatgtatcgcttattttatgttgctgacctgacagagctctattttgatgaggggttgcaggaggtccagcaaggtggagaaggagtggaacgggtcagcgttgtggcagcaggagccagcagaagtggcttaggaaatggcttggaccaggaagcagagggtcttcagccggaagtcggcagagctgtatcccttaagcctgtagccggctaggccccatgacacagactcaaaacagcaccaccatttggtaaccaagtgtttcatgtttcatgttcaaacagtaacaatgacacaatcctctctgtggtcttgggcttcttttggcggagaagtcttgtctggtaaatagaaatactttccattttgtagttctgagggaagctctaactcagctctggtgccacaggctggatgctctttaaactctctcttctgtctggaagtctctttggcctgatcattgagccattgggttggatacaacctcatactttgttcacatgaagaaaattttagggacaggctcataattagattggtgtgaacttcaccctttaacatttcagcatcacattgtcatctgcagagtagttcacatccaggaacctcacaacggcgaggcttccttttgaatctttacaatattgattgatgattgattgatcatgtgagtctgcacatgctctagtgcatgcacagtggtcagaagacaacatgaaggagttagttctctccttctatgaagtaggtgctggggatggaactcagttcaccagccttggcaggaagtacctttcccctgtgagccaccttgtatgaatctctgtaggaggagcctccccataggtaaccctggagggtaagaaaagaacatgcccaacccatttctcacacactaactgagcagtctcgtctgaggattctaatctcacacgtgtctgagccccctaccccaccccaccccaccccactcaggagaatcttttcaagtattgatgtgtttttattcttttttctttttctttttcaagaagcccaatgagcaacagaatggctatgattcagaaagtttgctcaaacaattgcccacagagactttttgagatgttttctcttcatcagagccttttttttttttttttgtatgtttgtttaaatggtagtaaaatatatgtgacatgacatttaccaccttgaccacgatgaggctttgggtttagtcaggcgcgttgtcatggtagctgtaagtgctctccatccatagagcactgtctagtcttttgaaactggaactatgtgcctattaaacaactctctattccttcctattcaccccacccacccctgtacctacctgtctatctcctgcatcacagataatggacttgtgcatcctttgttcttctgtgactgccttgtttcacttagcacagtatcttcaaggcagctccacattgcagtgtgtgtgtgtgtgtgtgtgtgtgtgtgtgtgcaagcttgtgtgtgatatgaggatacatgtggagaccagaagttgaaagccagtatctcccgtcacctctctctatcttattttttgagatcatctagactggctgaccagcaagtcctagtgatcctcctgtctctgcctccttagtgctgggcttatgggcacatgctgcctgctgtgtgacgttttgcgtgtattctggggatctgcacccaggtcctcgtgcctgcacagcaagtactttattgattgagtcgtttccagagtccctatttaaatgaagttgtcttcatttccggctgtcatcttggtaggcaatcttaccaggggctgttagccgggtggcagtgtcctcatccacccttcctccagttcctagaacagccacttcccatctctgagtgtcctgtagaatactagactaccttcctcctgagaaccacagcttagattcccgggctgttgctgtcgttctcctctcttgagcctgtcactcacagtccggagcttcttaagggctagaagcatgcagagagtcatcactataggattgaagccctaagtgttttgctctgtgtgtccatcctggatggacagggagctctttcccttatcacaggcatagatgtaatcctatttgcttgtatttctggtttgtggcgtagtccctgcttccccttttattatggagcctgcactcaggtcatcctggacttgagctgcacatgagatctctgcaaagccgccaaggctgggaccactccctcctgttccctggaaaagagcaagtcagatagctgagagtcattttcctccaacaactaatgtttagctaatatttaattggcactcattgtgtgctggtcattatgctaaccgacttgtggtaattaaatagctctagtagttgctttaaaaaaaatcttcattatgcatgtgggggtgtagatcagtctcaaggagttgggggtcgattggttaaggttatgagtttcagcagcaaaatcagattttactccatcaggtagttatgaatttaaagccatttggtactatgggggggggggtgtccagaattcagcgcctttgaaagcagggagacttgggagcatgacaagtcaggacccctgatgggagcagtggagcagtgaagcaggaagcaggggtgcgggcaggggttgctggcctctgcggtgttagctgagactgtataagtcacattcacctgagagatggaatggagctgtgtcagtcctcactgtggtgacctagatcaggacctgggctcctacccacctactaaccatctgtgtgacattacagagaccatgagccacctctcagcctcggtttccctctttgtaagaagagctacgttggattggtagtctaatttccctggttgtactaagcccagaagtaagttctggatgtgacagtctgtgctcatcagtgatgcttaaagctactgacctctgtgaagacacccatctccacagttggggcacctagctaatactgttaaaaggccccaaaagcctggtcttggggctctctctctctctcttttttctctctctgtgtgagtgtgtgtgtgaaaattctgtcccccagggaaggtttagattttttttttcaataaaatcatcaattatctgttcgatgtaaattgttcattcttttatgttttttctgttgtttcccaaggaaacgtctgctattttctcaacccttttggagagctacaggtgggaaagggcttgctcaggaaaggtggccctgctgcctgtgatgtagagagtctgtcaccctgtgttgaggaggaacatccctgggtaatggttaaaccaaggaagaggaaatgaaataaacctttcttctaggaagcagttctgggctattacttggttgatgcttgcctagcgtgtgtgaaacgctgggttcagccctcagcatggcataagataggttgtagtgcacacactttccatctcagcacgtgggaggattagaaattcaaggctgtttttttctgctacataataaattcaaggctagcctgggggtatacaaagctcaaaaacaacaaaacaaaacaaaacaaaaacagtgcccaccaataacatcactcctaactattcagaaggtggttgtgggtccatgaccaactaaatatacacaaacagagtacacagtgcttaggggacagtcgatgagatggcaggtcacttgcctcttatgctctgtgaccccctgctaggtctactgtgccagtctgaagcatttgtgttcttctcctttcgatgctctgtttcctcctagactgcccaccctaggtttcttgtagataataatcttccagatacaaatcctgtccttttgtcaggacccgagtcagagtctgcgtcctcagaggagtctgtctcagtaaccaaggtctttccacttgtcacgttctggttgggtattagagattatttattatcctttagcatatttgtgtctgcctcttttccctgctatggtcttatttttgggtatcagatgtcacatgtcttttaaaactcaattgcaggattgtcaaggaatttgtttgtgttaatgaaactgcctctccctttgagttgtattaaatacatgaaggtacccacgtacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacacacattaaagcaaagggctacagagatagctcagtgattaaaagtacttcttgctcttgaagaagatgcaggtttggtttccagcatgcacattatggttcatgaccattggtaactctagttctaggacatccaataccctcttttgacctctgtagatatcaaatatgcatttaatacatattcatatacgcagaaaaacaagcatacagaataaatacaatagaaacaataaaacagaataaatacaacttttaaaaagccacagcaattgtcctgtttctcctgatatatctgcagtggtttggatgtcaggggcattcagttgatgttaactggcagggtgattttttttttctttttctttttttttttttttttttactacaaaaccttgaggaatttaggtgactgagaaatttgccagttcatagaggaactttcctataactgtaatcagttgaaaatgacctagcagtcttaggacaagtggttgatagattgaaaaaaaaattccaagaacagatgtcttaggttataaagcagaatgaatccttattagttcaggaagtatttacaaagggcatagtgtgtcatgaactttgctttgtgccccaaggagtaaaactgaccagaaacaaagctctcccttcaagactttattgtttagacagtaagacaaaggggcctcagacatgtcatgatgcagaaagagccacacaagagacaagatagaaacctccagggcttgtgaagggtggaggtgattgcagatttgacagaggtgggtgtggcgaaggttgtactggctgacctggagctgaaggactgagtctgagaggaggaattatgggaaggaacacatttcctggatgtcctcatgggtttagaggtacatgggcattgtgacgggaagggaggtttggaagagtatttaagatcagatttttggggaacttattatgtccccatgaaagcac

SEQ ID NO: 1280 - DNA, 485 bp, Mus musculus
atggattcggtcaggtcctgggtccggaatgtcggcgtggtggacgccaatgtcgcggctcagagcggagttgctctgtcccgggcccattttgaaaagcaacctccttcaaacttgaggaaatccaacttctttcattttgtcctggcgctctacgacaggcagggacagccggtggagattgagcgcacagccttcgtggactttgtggagaatgacaaagagcaaggcaatgagaagaccaacaatggtactcactacaagttacagctcctttacagcaacggtgtccgcacggagcaggacctgtatgtcaggctcatcgactctgtcaccaaacagcccatagcctatgagggacagaataagaatcccgaaatgtgcagagttctgctgacacacgaggtgatgtgcagtcgatgctgtgagaagaagagctgcgggaaccggaacgagaccccttcagacccggtcatcatcgacag

SEQ ID NO: 1281 - protein, 162 aa, Mus musculus
  VARIANT (1)...(162): Xaa = Any Amino Acid
MDSVRSWVRNVGVVDANVAAQSGVALSRAHFEKQPPSNLRKSNFFHFVLALYDRQGQPVEIERTAFVDFVENDKEQGNEKTNNGTHYKLQLLYSNGVRTEQDLYVRLIDSVTKQPIAYEGQNKNPEMCRVLLTHEVMCSRCCEKKSCGNRNETPSDPVIIDX

SEQ ID NO: 1282 - DNA, 220224 bp, Homo sapiens
  misc_feature (1)...(220224): n = A,T,C or G
tacgtacgtatatatacgtgtatatatacgtacgtacgtatatatacgtgtatatatacgtacatgtgtatatgtatacatatatatatatacacataccaatgtttcacattttgggagaaattaaggattatttaataaatgctgttggtacaattaagagtttagtgacagaagtttgatttccacctcttaatataaatggaaataaattccagatggactatagttgataaataaacatcaaaatattttgaataaaatgggcggggtgtggtggctcatgcctgtaatcccagcactttgggaggcgagcggatcacttgaggccaggagttcaagaccagcctggccaaaatgatgaaacccagtgtttctactaaaaataaaaaaaaatcagctgggtggtggcacatgtctgtaatcccagtcgttcaggaggctgaagcacgagaattgcttgaacctgggagttggaggcagcagtgagccaagattggcaacagaacaagaacctgtctcaaaaaaaaaaaaagaaaaatttttgatatttcagtatctatagctaatcttctgtttaaattggccttctaaaacttagtctttattgttgaaaagggaaccaagaccataatgaacaaatctatttacttagggcaaaatttttaatgaaaatagagaaataagaaaatatacatcaatatttatcttggaatggggaaggattacctgcaaacaacacaaaatgaacatattatgctttaaaaagttttatttttaattatgagtacataacaggtgctaaattttatttttaattatacacaaaagatattataaagaaaaacatgggtgaagttaactacacacaagttaaagacctattgcaggacataaaataaaatgggctcgtctaaggccaggcgcagtggctcatgcctgtaattccagcactttgggaggctgaggcgagcggatcacttgaggtcaggagttcaagaccagcctggccaacacggtgaaacctcatctctactgaaaaaatgcaaaaattagccaggcatggtggcacacgcctataatcccagctactcaggaggctgaggcaggagaatcgcttgaacccggaggtggaggttgcagtgagtcgagatggcgacattgcactccagcctgggtgacagaacaagactctgtcaaaaaaaaaaaagggggggggttgtggggaggggggcttgtctagctgcctaatccaactgccattctcaacccgccctgaagtgcttcacaatggaggcacttgctttcccagataaacgtctaactatggatggccacgtgactcagttatggcaaaggaggcataagggctgtttctggaaaagcttctactttgcaatctactgggccaaacctgctggtggctctgttcctcttgcttcctgccttgaatgtgcgccactattgccgccgtatccgccactaggaggcagtaacggtgagattgaaactcaacatgcaaagcaaatgaaccagggttgtttgtggcaacctaacttggggccatctacctcccggcttcttggtatgtgagataattaaatgattttattgcttaaattaaattgctgttagtcgcttatttgggtacttgcagacgaaaacattgtaactaaaatacatctgtatttctgccaccaaaaaattataaataaaattaccagcaagcaaagatggaaaaaatattttcaacatatatgataaattaaaattcaacgtccttaataaaataatatttaactccccaaagatgtacactggccaaaaagtgtatgaaaaacaatttccccttactggaaattcactaaatataaataaagtacaaatactaaaggacatttccaatctatcaaactgggaaattttaaaaataagactataacttcaaagattcagaaggttgaggggtgagggcagaaggggtaatatcaggtattgctggcaaaagtgtacatttagtctttcgagaggccaaattgtcaatctgtattaaggtgtaaaaacatgcaaagcctttgattttgcaattttacttctaggactttatcttaaggaaagaatcatagttattgaaaaactaagctacaaagatgttcatcatagtattgtttataatagtgaagaattaagagcaacttaaatgtccaatccaatagactggtcaaacaatttatggtatggatagggaaatactatgcaaatattaaatgttactgtagaaaaatatttaatggcataggaaaatatgctatattaagtgagccaacaggttacaaatcagcatatagtctatgctcccatttagagtactgtatatagaaatatgcataaaataaagggagaaaacccatccaaatggtagcaacagttatttatgttgatgccattggaggcggttacaaatttcttttgtttttatttgtatatatttttctgcaataaacatgcattgcctttgcataaaagatgctgcaagttttaaaagagcttctagttctgtggaatggaaaagtctggaacctcaccccttaacaccgcctcccccctccccccgccaccactgccgcaccccgcagcctccagtcagccacctcctggctgacagtgtctcagttctccctcccagcttcgtttaatgcgggctctggaaagcaccactcggggagctcggctctggctctcgggagacagagaccagtagtgtcaggcgagccgcgtctcttcctgagggcgcagggcggggaggggctccccaagctctctgtgaaccactcatcgacgggggtttgtcgtagaaaccgaagatccatttcagagctcctcgagatcttcaattatctagcgagttccgcgatccatcccagcacgcggccacgcagcgaaccgcacttgcattcggggtgcgccctactcactgccgcgcgcagcgcggagcccccagcacagcctcctaggaatgaagtcgcattctctccctgggtgagaccccgctcagtgacctacggtgccctctgacgcccgcgtgcaccaaacagcttccaaagcgcttttctcacatgcaattccatgcggaacaaacaaaaagcttatcacccactgagcgatccagtccctgtgccaggcaaaggagctgcaaggacaagcgagtcagaatccctgcctcaggagcgcataggtcgggggaaaggaaacccatccccataggagactcaggacccagtgaattccataagcagatgtgatcatcctcatcttacacctgcagatgctgaaggaaagcaagcgtttattgaacacctactgcgtgccagatactttcacctaagctgtcttatccgtaaggcaagcaaagctctgaggaataaatatccccattttaccagtaagggagctgaaattcagaggaataacattcccatttaactggctaggaaaccgaggttcagaggagtaacaacaaatgccagagaccttattagtaaatgccagcctctaacctgggtctgcggacaccaaagtttctccttcgagtgaggacaacagaaacgaccgaacttgcccgggttcagatccacggaaagtggacatcacgggttgtgagggtttctgggcatttagtccagcgacccctacgcggcgaggccagcattgccctataaacgttgctctaagcacttaccgcgcggggtgactgtctgaacgcagtgacccccaagccctgtgacccccatctgctctcctttgggagaaaagagtaagtggaagttgtgtcccccttcgagggtggtatggagctgcccggccaggagagcgatctctgttttcccagctggctctgaggttttccgtgggtgccatgtcccgtgcgccctggacccactggcgccccgaaatgattgcccggctcgcggcaggtgagggggtgggggtggaaggttccgtgagccagaaatggaatttctaggccttgggctgtgtttggggagatcccatgattagaagtccagtttgcaccgtcaaagacttcttgaaatccgtgcactctatgcaagtgactttcctggattttctctcttgccacctgagtgaggtgtgccagtgtaggtggaggtgatcgtgatggtgtgcgagtgcgtgtgtgtgttggaggaggaggttgcctagtgctaaatggaatgaaattctagatggtgccatatttgcagctgacccccgccgccaaagtctcccccatcctcaaatccgggaggcgggagtcgcggtgactagtatattatgaggaagaaagttggatctgaaagccaagggtgtttgtgggggcctggaggaaaaggcagccgggttgggggtgggtaggcagcagtgagcgggagacttttgtcacccctcccttatccgaggagggccccgggcgcgcggggcgctgcgtgcgtgcggggccgagtgagcgcttgtgcatgtgggtacgtcagtgtacgtgtgaaatgtggcggcgccggccgcagcagagtatgcgctcggtaaaaatatgaataatcaacacatcgctcacacctccgccgcgatccgggaaggagctgggaggtccctcgggctttcccctgccggctggcgggcaccaccaggaaaaggggggcatttcagagtagctcttcggttatcactgagctaagaagccggaaaaaaagaaaaaagaaaaatgtcatatttaactttttctttctgaaggccttctgttgcaccctattgttgagtattagaagtggaagatcggggaggatccttattccccatttagcagctgggatgccacttgtcatctcccaccctcattttgttcatctgtaaaatgggggcaaacaaatcaataaattccactggaagtgttgctgtgaagtttaagggcgagaaagggcctgggcaagtcctgcctctgatcgttagtaccttcctcttggtcttccgtttcacggagaccagcatgattaggccttttaatgcgggtcaacttgccctgatcgctgcaccgtaaatagtgatgacagatgccaccgccttcgtgcacagttccctgaaaggggctgtaatcggccagccgatttaccccagcaaggcccccagcaggggcttcacgtgaaagtcacccctcccacctgggaaatcgggtccccaggttcgcgtggaagctatcaatcacttccctatacagacagcctgttccgcagcacacacacctcccgggcctctatttccgcgtggtcacccgcgctccccaagctgctgctgcgagaatttgttctcttgacctttccgctttgcttcctcgctcgttctgcacccggaataaggagatgggaaagagggatatttctgaaggagaataccagggggaggaggagcagaggagaggaagacgaggaggaagactttctggagttgccaagtgttagggtagcggtgaatctggctcctccagtctattttgggtaaacttactgcagtgccccgactggcctggatacaaccgacatcaagtgtctctaaaacgttcctccacgactcagtatttctgcagctgttgccgctgaatctccttcactatgcgaaaacaaaagaagcgaatccacttcttacccaaattgtcctataagggagctgtttggtattgacggcggagtccccctgagatatttgtcgtgcatttatgattagtttcttttctcccaccctctctagggaatttgcatttatagaacatacaaatctagtttccggaagaaaatgccaaagttgcaatttggtgtgagagttaatggagttcgatatttaaaaaaagcatttcataaagaattgtgagttaaatattcggcaggtctctgatatgccaagtaaagctatttctttgtagtcggacaaagagtaaaagttccagcttaaaaaataaaaaacccaaaattgtaaaattcacgttcgaagacaggccagggggacagccactttttccatttataaaacccagactggctctccctgtgaatcgaattccccggctactgtctggctctgtgcttcggcgcagggggtgtgtgtctggaagagggggtgaaggtcgtatttaggggtgtgttctgacatctctgaattcaccccagtgtcctgccggacaggaacacagccaggagagcagtttctaagtaaaatttccgaacctctgatcgggaggagagacttggcgcccagatgactggaccggacgagattgagcaaaggggcttaaaaccaattaaaaggaaatcgaacataccgcactgggttgcagacgtgaaacagaaacatgaaaaaaacgggggtgagggtcatttgggaagggtaaatgaagaaggggacagggtaaaagacagacacccccagttttgtataaatagattgtgaataattttaatcatagtgttcattttggatttttcttgacccgggctagaggcagaaccgagctagttggccggagcctgaggagcgcgtgggctccgcagtcccgcgggattgggcttcccggggccgcagctgcgcttgccaggcccccgcacagctcggggcaggttttgtgttgcacgagatcgaaaaggaggtttgtttgggggtagctggaggcgacagaggtgggagcaaccctccaggcgcagccgccgctgctcattcccccaaccaacgcatgtttcgcgcgggtggcggactccgcgagcattcctacccaaaacctatacagacgcaattaaccccaactgggttggccgaaacgccgccacgctgggcccaaggcagtccttgtcccctcacgctcgcgcaggcacttcagcctggccaacagggaacttcaacgcccgcagcgagccacacagccatccctggagctcccagcagcactgccgcggggggcgcccttagcgcagccggcaagtagtggggaagccccactctgtcaaagttcgggaccacggctcccccaaattgcctcccagcggggcaccgaggcccctgagcgcgtctcggggggttggctgggaggaggggcgcccgccgagcgcggccccgtctgttttggggcgggcagcagggagctgggagaaaggaacaattcattcgcttcctgagggggcataatttgggtggcagctgttaccgccgagaaaagctggtgccctcgaccctgactttgccctttaaccccagccaacctgagcctgaggggtaaactgttggggcttggcccaggcccactgctgaccagaggcctctccgggtgccctgcgcacctttccggggcaacgtggaggtacagctgatcaaagcccccttgaaaaaaaaatcaccgggctcataggcatgtcttgaagggctcacggctgttccacactctctgccaaggaactcaaggctttggccccgctgggcgcagaccccagacgaagggggtgggggggagttgcttgaggttcggagagatttataaagagagaccgtagaagactccaggtgatcagtttttgctgggaccgaaattctccgtaaaacctgcatgtaacagagaattgccgagttgaaacagggcagtgaatctcatccctacaaatttccctccctacccccttcttcctttggacactcctgtcttacttggcttttactagccacccgatccatttcccaatcgccctgtatggctctcccgccccttccagtccaacagggaggaccaagccagagctctggggtcggggtaccacagtcaacacaacccagaggcggggggtttaccttctctaccttcccccaaatcaatgaccccagtccctggatcccggggcctgtgcagagacggtccgtgcacccgccccgcaaactccctaaccccctatccgttttcaagcgaatctccgcagttcggaccagcacttcctagtcgcaatcccgcgcacgcagcgtggtgccgcggtttgtcccttggggaggtggaggcgcgcaccggtccctttctcgagagagccgagttttcttgaagtgcaagcttcctgtcagcctaggcaaaccagttgcaaggcgctgtgtcctctagcggcaaactctagcagttcatttgcgagcgctcacctacacctaagggatctggtctctcaaatctgagacccaagaggggagaaagtgccctgaacgcagtccaggcgctcgcaaatgccctccccgtaatgagaccgggagactggggcgcaatcgctcgaactacgaacagctgattgtctcctccacggcagatggtctttgagcacagatttgcattcattgtcttcaaatctgttttcgcgctggtgttctagatttcagcagcagcagatctatgcgcagatcagaatacaaaaggagaagcaagaaaatgacacccagccaggaggatgtttaataggcaccgcgagcagccccgcgcagttaaaaaaccgtctagggtttcagctgttcggtgaggctgctgccaccgcctgccggccaccagcccgcggccagcaccgcggcgaccgcgcgcggtgggcgaagtttccacgactcccccgtccctccccgcccactaccgggggcttcgggaacggagaggtggggagggaaccggaggacccgcgggaatactccccggccgctcgcgcactcagcccgcctcgatctgtcagcaacctctcctccacacgggtgcgactgccgctcgcgcccgcccgcccgcgggtgttttccttaggtcctggaccgttttccccagcactgtatttgagcagcacttgcccctcgcttgtccgccccaccccatcccccgccttctttcatatgttctccactctcagcaacgtgcaagccgcacacaacatctgatatcaccatggaactccaggagacctggggagccattcagggagctgggtgctctgggggacgtttgcgcaaaacataagcacatgtggccacgctcacaagcatgcacacagatccgaaccccgggaacgaacgtgcctcccggcaggctacaaaagcctacatctagaggcaggatccagggaggcttcccgcagccaggccgaacccctgcgtccccagcccgcagagacctgctaccctaagtcagtgcagggtgtgggggccccccaatcctgcgcaagcacacggggttcgtgctaggactcgacgcccgcagctttctgtcccctttcacctcccggagtcccggcaacgcagagcgtggcgcgcgccgccggaggacgtcggcccggcttgccaggcgccggccaatcccgcgcgtccatgcaaatgaggctccttatcgggccgcagctccgcctcccgcagccagggccgtagtaacccattcatggggcccgcgcgcggctgcagccgggctccgtggcgctcgcagccaccgcctcctctcggctccaggtcttccccttctttttacaactgatcctgttggggattttttttttttctaaattggaacggtggggaggagcagggaggggggacctggaggaaggggagagattaggcagccatcaatttcctccagtttctcccagaacaggtgatgcttctaaattgtgatcactttcaggaggcagcactgcagctggaaggatgcgagcgacctagggtggagtggctgaggcggcagatctgaacttgcggaggataagaacccaaactttgactacatcagtccgcacctcgccagtgaagcaaaggacgggttatcttttttttttttctaagactcaaacttgggcacttgatcccttttcttggattgctttggaggagacgatttgctggcaacgttgggaacagtcaggactgtgttgtaactcttacttttaaagcgacagtagaggatcagactttttaaatgtttggaattcaagatactttaggaagaggaccaactctgaaagagaaatcgctgggcgcggagatggattcggtcaggtcctgggtccggaatgtcggagtggtggacgctaatgtcgccgcgcagaggtaacgacacggccgcgcaattattatgctgtctctcgctcttacggtctgtctctccgtgtgcaccccccccgcgcaccccgtgcctttctctctccctgtccccccatctgtcgcccaggccctgcgcgctggggctcgccctcgggcaagcagatcgctgcagtcaggcgaacgctcacccggcagccggcactcgagttcctgaactgcctgggtcgtaggcgtttctctccttctcctttaccacagtccactctttgcaaggaaaaataaagtagcccccaacatctcccagctcagcccctagtcctgcaagccgagccggcctggccccgaacggagcgtgaacaccggcgctggcagtggcggcgcgggaggaaagccggcttcctggccactcttggcttcgccacgccgcctgcgagcgcctacctcccgcatcttgctgggcgattcctggagcctgggaggccggcggccagagggtggcggcggcgaggggagcgggaaaagccggagcggctgcccgggaagacgaggcggccgggagctctgggaggggggacaggctggagggtcccggctcaaagataaaacagtgagccagacgaacggagctagggaactggagaaaagaagagatttaaaagaagagaaaatactgagtcacagtagaaagagttgcggaagaagaaagaggcgagaaaaggcgaccagcagctagactggctcagggatcgccagcctctggttttgcggatccctgaagttgactttgtgtttaggcgtctgcgtgctgggatagtaaataccatgtccggggtgccaccctacgaagacattacggtcccactctctcatcaccactactgagttgggatttgtggcctccaggtccttgtctgcgagagaggcagcccttctacccccaaagagccgatgaacttcttccactaccctcgcttcccctgctgccctcctggccacccacatttaagtgccaacatcacacggagaaatgatccctttcccaaactggccaggtgtcccgggtagagcgaaccggcctctacccttggagcggagaaagcagaagttttatcgctccgggacttgggccggcggcggttccctccctcctgtggcccggggagcgcggatttccctccggcagaccgcacagcgcggcggccgcggctttccgcagcgcttcgggactggcccgcctgcgagctaagggaaataaggcagcaccgcagagccaactgtgccgcgcatttccttagctgggctccttaaagacgcctccctcgctttccttccttcccgggatcaaaaagtttgttgaagctggaaggagcagacttagtgggggagagcttagccaaaatgttacccctttcaaaagagtgaatgaaggtgcttgcgcaccggggttcaacctgggagaccccagcgccgcagggcagctcccgcaatctgtgcgttcacctcagccccaagtcttcggtgaaatgggatctgatggccaggtgggctgtgactgcgaccggttggctgggaagcgtgtgcacacactcagcacgctcgagggcgccttccgggtcccccaacttgggtttcacagtcactgggttcggctggcgccgccggaaaacgcagcatgagtggggatcgcgttggccccaggaaaggaggttctcgccttttaacagtttggcttttccccacctagcacctctgggagggagggccccctatgtcggtcatctcatttgtggtggccagcgatccccggggctggtcgcgaggattccgccctgtctctgtcccaggcacaacttttcggaagagcgaggcaagcagcccaaggacccagacctggactctgtgttactctcccgcctgccccttggggttcttacccactacctttcccagtcagcatttgggcgttgtgagcagtgggtccaggactgataactcgaattaatactaaataaaagggtcgcttcttccaaagcaaaggaggcacttattcccctaaccctgggccccagctctgcatcctgatacacccagcagtaccacctgagggagtggatggagacagccccacggtataggacgcgggccacctccttaggggaccactctgggcctctgtctgcagccggggtctttcggtttcgactaaagacgggatggtgagtggcccagcggtgggatgccggaccacttggtggtgtcagagaccccaggtatcaaccctgccacccaacccccgtggccacggtgactcctttaaggagtctcctcttccttatccgaattggaaaaaaggcccgaagggttcagaactctggacctgggaagtggaccccttacccctctgcagtgttgtgggcggttagtaacatcgcctttttgtgcttccccgtgtcttgtgttcccccgtttttctccctgtgcagcggggtcgccctgtcccgggcccactttgagaaacagcctccttccaacttgaggaaatccaacttctttcacttcgtcctggcgctctatgacaggcagggccagccggtggagatcgagcggacggccttcgtggactttgtggagaatgacaaagtaagcggaaagtaccccccaaaccccgcggcctaataactccctcttgcgaagcactaaagattccatctgtcactctcgcgacacttttccactctcaccatcagggatgataaatcgaggctactcacccccagcctctaaatcagtcgatttcccgaacctcctcccaccccgactcccccaacctggagctggaggagcgctcccggctctgcgcaccgagcctggaggccttagtagcgcctggttatggactgacggcggagcaaacgccccttggactagttaaaaagtacacccaaggccgccgctccccttctctgggttaattttaattattttgcacctgcgagagccaggtggcctgagttgcggcactaagtggaaaccggcagcccagccttggcctgccttctggccgtgtcttctctcctgttctgttctccaaggcagcgcctcctccaaactcaagcctggaattgggggctgggttcggtctcaaatgaaggacagtccgccgaaacctatgtgtgaccaaaggaaaatcccttgccctttccgggtctccgtgtccccagctgtacaatgtgagctttagagtaggcacttcccaaagtccctcctgaacctggaactcagtccctgagctcgtggccctgcgtgcgcagtcctcgcgggataggcccgaatgctgcctttccaaatgacaagtcccttcacttttctgccaagggaagccttggggcttcctaaggacagacagagcccgatgggttgggtggtgcctgtttaaaggcagctttggcaagtggtcctgttgtcggaagctcaagggtcacacttctgaggacatttttaagggagacagagggctggaaagggtcaagtggctacgagtcttggcaagtttccgggggcggccaaggacaggcagatgctcatgccctttgacctagggctgaacagggggttactcaaagctgccttttgatggggagaagggatgtgaggtggggattcactgtctcctctttccctcattttggggggctgaaaggcaagggaatcgaacgctgcctgtcttttcaggaacaaggcaacgagaagaccaacaacggcactcactacaagttacagctcctctacagcaacggtgagctcttctacagcaacggtgagccggcgcctagcagccggcttccgggccgcacgcgctgaccttgccatgatcactctcagggatcgcatggagcccagggcggcgggaggcttgcctgggacaggggattggaaggtcaccgtctccagggcggctcagcatggagaggctgcttgggcctcagacccatggcagagaagggtttggggtgcccggaaggggctctacggcccttgactcgtgcccctccggtccccgcaggtgtccgcacggaacaggacctctatgtcaggctcatcgactcggtcaccaagcaggtgagccggaggccacttggcttctcttcgcctgtctctgaccccgacccccaaaccccccagtttgtttctgacctgcccctcctccacgatttcctgggtcagactccacagccccctccacgtccccctcccagcaccttgtctgctagggaagatttttttttttttttcttccctgtctcaccaagtgacctgttttgtctggctcagggaaaccctgggggcagtaagaggcgaacaaaaaggatggagaggaaacaattattgggagattcagttcccgcaaacattccattttgctaagaatgatgttctcactggggcaaacttctctatgatttcagtcgagtccaaactcggcaaccgcgcagaatgtgctgcgggcgggaattcctaatgcggtggcaggtagtgggagggaaagcgatgttgtgcttgttctgaagtcccttctttccttgccccccacccctctccacatcttcctttcctgccactacctccttcacagcccatcgcttacgagggacagaataagaatccggaaatgtgccgagttctcctgacgcacgaagtgatgtgtaggtaagagccgccttttcccaggccttcctggagagcccgcaggtgctccagccccgccttggcgcgccgcgttcccgggactaactttcaggactgagcgctcgcagctgggaggcctcgcgggcagacgggcgcagagtgtagatccacggaaaccccttcatgcaagtgtcttaaagcataaccattgggactcagaacgactcgggattccacctctctgatgtcgcaggagtttcctccggctacgtggaaagtctccactgtgcccttgtcagtggtagtggtggaagcgggctgggcaaccccgggccgggtttgggatcggctggagttcccgccgggcctcttgtggtagatttccagtaactccacttggagttactgagtgaaagccctggaacgactcctagtctgggcgagggaccaccagagggtccagcggctcatttccggggtgcttcctggcacccaggcacctgctgtgatgcgtgggcgtttcttcctcccgggaggttgctctcttaggagttctcgtgtcgggggagtttctcaggtcagaaggaactacctggaagaaagatcagtccagttcccaccagcgttaggaggggcagggagaggacccgctgggagatctggagtgtggagcaacagctggattctgatattcacgtcgtgaaaggttcagtctactggcgttcctgcacctttcccatcttcctttcagagatcaatccattccaccttgagtcctgtgcattccccccccaccctttttttctgcctgactagaagaaagtttaaaaaatcagaagaattgcatctacccttattctttcaacaaatgtttattgagtgcctaacgtgtgcccggtatcggttgggtgctggggatcccaccgcagacaagaaaggatataaataggaaactctgggaagagtgtggctattttattatgaaaatttaaatgtctgctccatacatgcttttcttcctccaaaaatctttgattggagggaaagtctcaattcttccttacttggctattgctttagtcaatgtctcctaactccagacttactagctttgggtaattgcagattatctgatttagtgtgtactgttttacgggcagctccctgaagccctgtctccctccccaacccagtcaggaagaaaccataacaatcagacatgtttgttttggttttgaccaagtaccaaaacaaactttccaaatgccagtggcttcagctgaaagcaatggaggcttccttgctggagtagctggggggaaggcattgggaggagtaagaagatagatactccaatatctcagggacgtttgatagatttgttcagaaagaaaatacagttctgagatgtagttcatataatacctagatttaaatagaacgctttgattaggttggttagttgaagggaggtttttctttttatgcctttgtttggagagattacctcctgaaaaggaaagaaaacaaaaaattgatccattgtctaatgaattatacctatcatttaaaataatacttgcatgccccatccagctgtagttaagactgacatttttatttttaagcccaatcaaatcctcctcattttatgctgtttaagtagcagcatcaatttttaaagcctctagtttagtctgcattagtaacacaatataaaaatttaatgtactgtaacttctctgcattggagacctgggaagatgctctgctgttttcttcccaaactacaatttaaaataaatattaattatgtgtaaataaatgatccattggatggatactgtctgcagcatacatgtgtgtgtgtacatgtgtgcagatgagatgggtaatggcaaatattagatgcatccaaaagggaagttctcattcaatctgtcagttagagctggttgatactccaggaagggggaaaagttccttctcttacattttaagagccagttgtagcagtcaatgattgagagatgaatcaggtgccctgtttctcaagggttattgcatatacttagtttcatttgcatagtgttatttggcatacctgggcacttccccggatggttttatgttccgtaatctttagtaaaagcctcataaatctgtgtttagctttgaatgggggaacaaagcagagacaaaataaatctctttaggaataactttttttttctcccttccccaatggtctctgttcctctcttccctgctttggttcattttgccaattattagcaaggagaaatctagttgttatgtcgctgccagccacccctgagccctcaatgctcagagggttaaaagatattataatttgaacagaagtcgtctcaaggcctacagctggctaataacagagttgtattgagcttgagcaaaccccacagctgtgacttttcgccacaaggcgcaggctagacagggccctaatcagatgggccagccgggcagtggggccagtgtctttatcggccagatggtgtgaatttagacacttttgttatgcaatcgcagggaggagttggggagaagaaaacaaaacaaaagccaccatgctgtgcgcttatttgagtttgaaattagagacagatttttgaaagttgaaggttgaattttaaaaactattttggaggggaaagggacacactcgcttgtcgtgagctggagtttggctgacgggacactctccgtccaaggctggggctttttccccttccccagccatcttttattcctctttttccctttctgaaaaatgcaggtatgattcaggattgtgataagagttctcatatttccccacctcccacttccaacttgttttattttttctctctccttcaaagactccgggtggagatggggagaataaattgagagtgtttcaagtaaaagattctccaaataagtactagaataaaataaaccaaaccaagccagagagaaacagtggaacagctttcattttcattcattaggaaaaaagagcacctctgagtctctctggggttgttacgaacacagtcttaacctattgccaagctcagtttcctcttctctttgttttatttatttttttattacttttttttttaatcttagagtcatttttagttttagaaaacacttatcaggaacttcagacttgcttgttggagaataatcctaaaagccttttaactaaagtagctgaacctgaagttggtcactcaggctttgtttacacagcaaagggaaggcagaattgagtttatcatctgagtaattcagggacctggtttcttagctgttccacactgtttggggagtgtaggttcacaaacatctcaggttctccacttcccattgcttgtgctaatattgctggcaggaggactgaatgccgttaaaaacaaagaacgactagaacatattagtgagaacttttctaaaaaaaaaataataatttgctttggccaacttaacagacccagaaaaaaatttaagatgggctcaaatggggctaattcaaccaagttctattatttttatacctttactattatagttcaatggccaagtgagtgtgttctatgtatgttttgtgctgaatatcagcattagagatgatatttaaatatgttactgttggaaaatggaggattggatcctaaagtttatctgcatttttctttgaatatcatttcctcccaagttctttccctacattatactacactggcaccaggcttacatttttatctgttttcttttcctccagaggaaatccccacggaaggcagctgaattcagctgaacaattttgaaaacttactcagccccctcagaatcattcctacccaaactaaacagattggcacgttctgacagtgtgtgctcttgtaattaaattgtacccggcattgcacacatatttggggttaggttgacatgctggtgatgtcaaaagggagagtcttgcttgaaggtctgtaggtagctggcatgtatgggtcttttgaaactgtgttgctaagaaaaatggtttgcctgagctgcaaaggtattacgttgacataagcaatattctagaaacaggaaaggtgggagaaatgggtggggggtagggatttgggaagagagacaagggctttaggaggtgggagagcagctggcctgcatttttattggtgttaatcttgggatggattgaaattttaaaagttaagacctaatataatttcaaaggccaaatattatttcagaaagtcccagtggcaaactctggtatttaagaaagttgagaccatttttcttttccttcctactaatttgattaaatttcttaaaacctcattgtgcccatttgctgcaaatgtttaagcatctctcaagtatattttactttctgaggatggtagacttactcacttgcgaatccacacacccatgaaagaggtgggtttaaaaagttttaagatatttatttgtttgtgtttaattctgtggagaaccagagagggcaaatgagctgcagagagccacagagctaggactggggcttggcatggtggcatacacctgtaatcctagcactttgggaggccgatgtgagcagatggcttgagcctaggagttcgagatcagcctgggcaacacagcaagaccctatctctaccaaaatgaaaaataaaaaattagccaagtgtggtggtgtgcacctgttgtctcagctacatatgggagtctgagaaaggaggatcatttaaacctggaaggttgagactgcagtgagtcatgatcatgtcactgcattccagcctgagcaacaaagggagaccctgtctcaaaaaaaaaaaaaaaaattctaagactgggttggtgctaggccattgggttcctgctgtcacatgacttccctttttccttatgttatcaccactttcaaagggtgctcatggaatcccctagcctcatggacttagacctagaagacactctagagagaatcaaatccaacactttcactttattcataagaaagaaaaagcccagaggggttaaagacatttgactaaatttgtgaagctggttggtgacagcttggacaccagaacgctgattcccagttcagcaatcttcctaaggtatcatgtcaaacttatgctacagaaaaactaccatgggcagggcagtgttcacatagagtttggttattgttagtgtgcttactccttaggcatattctccaaccagtatggatgataaagattttttaaaaagccatgtcaaggctacatccttagccaactatagttgatagtggaccatgtacctgagatgagctgagaggtattcagaagtctgtagccctgataggcagcagatgggctccctggtggtaagggagtgaattcccagtgcttcttaccagcaagcttcctttgcccttctcacatttgtctaggtattttcgaacagatacctttggattggagtgttttgcacccctctcaggtcctagggagtactttctgtttgttgtaattgccccaggggatcttctttatctccctctcagctaatcctatcagcatttattgaggtctttctatcaggtacccagcacaagagggacgtcttggaaagtggagttttcagagctgggacttacaaacagtgggataccatttctgtttcagacttggtgaaaattattggagctaccatccaacagctccttgcttcattttcctcgtattttaaaatgtataccatagttctggtcttcctacatcatctgaaaaatgatggaaataagtgaatgaataaatgtttataaagtatagcaagatctctggagaaagatgttatgtaaataaggtttatagtaatcctggcagccacttgcagtctattttacatattttccttcctctcgtttctttaattatttactgagccacaaatatctaaaatatcataaaatcattgaatatcaatctggaagtgaccttatccatcttaatatccaaccttccgtggttccgattacaaatatgactcatgggaaagttgtgatttgctgagaattagccagcttctaagtcacagagtgagaatttgagtatattttggcttcaggttcagtgttttttattttttattttataaaacatggtcataaatcctgccctcaagtagcttatagttgggaagctaccttagacagattcattttttttttcttcaacttttattttaagttcaggggaccatgtgcaggacgtataggtttgttacacaggtaaacatgtgccacggtggtttgctgcacagatcaacccatcatctaggtattaagcccagcatccattagctattcttcctgaggctctccctccctgcaccacccctcggacaggccccagtgtgtgttgtttccctccaagacagattcacgaaggtgaatgttcttgtggccaggcactacagctcatgccagtaatcccagcactttgggaggccgaggtgggcagatcacctgaggtcaggagttcaagaccagcctggccaacatggtaacaacccatctttagtaaaaatacagaaattagctgggcgcggtggcacacacctgtagtcccagttagtcaggaggctgaggcaggagaattgcttgaacccaggaggcagaggttgtggtgagccaagaaggaggcatcaagccattgtactacagcctggtgacagagccagactctgtctggggggaaaaaatgttcttgtcatgtgctcattgcattttcttgatttaataaatttctttcactcttggttccttcccaatctacagtcgatgctgcgaaaagaaaagctgtggaaaccgaaatgagactccatcggacccagtcataattgacaggtagggggaaaaagtgatttttcaatcatttttggttccttttcttcatgaacctcaactctgagtactgatccatggagctttgctgtcaagttggtttcatgttatttcaagtcactaaggtcatccaacaaaggcctcctcatgctggcctttcttggaagaagccagaatcttcctttggaacacgtgtctctaaatctgtggtggagtcttttccaggtgcaccagcttcagcctaataagtagtatgtgtggtgcaggatataagcgatggcacctctcctttcgggcagggtatggtctcaatcagttttctagaagaagcaatgtgccccaagttaagtggcacccactttattattctcggtgattgctgcttggctggaagattatcaattcagattacggtttaggggattatggcaagctctctgctgtgttcagggagattcctttctaccatggaggattgcattctgtgttctatgttatattcagaatgggaaagattctttgggacaagacactaattcactgaaatgtgatttaggcatcctcagctgtctgttttttgtgattggaaacagaacttacaaaccaatgaagaaataccaaattaacttccagaaatcatgtaatttttaagaaaccccatattcccatccctaatttttttctctttcgttaaaaaacggaataattccctattgcttctttctttgggttttcacatttctagccaggtcctgaaatggattggagagaccacagtctccaaagttgttattccaatattccaacgaattctcagttgggagaatggaacctctggcattcttcccagaaagccagcttggtttcttcgtggaaagtatagcatagcctaggaactgaggaggctggaattctgatcttgtcctagcttctgaccttggacaaagcactcagcatctttgttcttcaataatataatgatgggttaggaggtgcagtcactgctgtaggcttcaagaggctactgaaatatcaatggcagctttgcagtgttctctgagatgcttgaagaggatgatgggcaaatataaaatgtttgttggatgtgtatagtgtctttgccattttagaaggttccagtgagctgcgttttagggagctattggggttgctctggtcttttttgaaagtacagagaagcttaaatatatagagttgcaaggactctttggagtcagtcattttcctcatctagctgaaaaatctgaacgctgagcggtggcatgacttgcccgtggttgtgcagctggttgggcagagctggcattagaacacagctgtccttacttccaggctgggtgccgtaactcacgcctgtaatcccagcacttaggaagaccgaggtgggcagatcacttgaggtcgggggtttgcgaccagcctggtcaacatagtggaccccagactttactaaaaatacaaaaattagtcaggcatggtggcacatgcctgtaatcccagctacttgggaggctgaggcaggaaaatcgcttgaacccaggaggcacagattgcagtgagccaagatcacgccactgcactccagcctgggtgacagagacagtgagactctgtctcaaaaaaaaaaaaaaaaaaaaagaaaaagaaaaaaaggaatacagcagaactgtccttacttccagactgtgcttctctccatggccacaacctcattctcccagcactttttctgtcctaactgatgagttggatctgttcatttctgtgtttcccagggattctctgggagactggatgcatatgagagcagcctagaccctgtcctttccggcctgtggattgagctcactaatcttgatctagtcttttccactatctttagcttctcttttaagaaggtactctaacctcatgactgttacatcctttttcgtaataaacaccctgtaaaccggctttagaaatgtttgcaaatctgtaaatactcacctgcaccttgcttctcataagtacacaccttaatggctctgcactaagcaggagctcttactttaaagaactacatctcactacattcaccgataaagttgaatatgctcatgttttcttcctatgtaacacacatattacatgtacaaaagaaagtatctttgtgtctatagaaagaaaagattttcatattaggcgccttcatagtttgtgctagcatgctttaaattcttctgagaaagtggaaatcgtatcttggctgcagattatgagttttatgtgactgtggcatttatttttactatcctatgtgcaataaaatagcccagtgatgtctctgcctcacttgaaatgtgcgttacttccgaaatgttgcatgtctacacatggaaacatacataccaaagggtactgtaaatagtccagtatcaggttttaagtgagcccaccttactataaacagatccatttgtttggcttgcttattgtagggctttttttttttaattgaaattttagggtacatgtgcacaacgtgcaggtttgttacatatgtatacatgtgccatgttggtgtgctgcacccattaattcatcatttaacattaggtatatctcctaatgctctccctccccccttcccccaccccacaacagtccccggtgtgtgatgttctccttcctgtatgatgagttcatgtcctttgtagggacatggatgaagctggaaaccatcattctcagcaaactttcgcaaggacaaaaaacgaaacactgcatgttctcactcataggtgggaattgaacaatgagaacacatggacacaagaagggcttttgttttaagataagagttctctcactgaaaccttgtctcatcgctcctgaatgtctttcgggtttaccttagccttcttgccttcattttcagaagtaaaatggcatgaagcaacctgagcaccatagtgggatcccatctctacaaaaactaaaaaagctagccaggtgtggtggtgcacacctgtggccctagatactcaggaggctgaggtaggaggatcacttgggcccaggaggtggaggctgcagagaactgtgatcgtgccaccatattccagcctggatgacagagggagacctgtctcagaaaagaaaagaaaaaaaagggcataaagtcaggtttccatttgttgaaggtgggaatggtgcttacggtatccaggggtttggatcagccttgcgcctggtctctgcgtccatctgccaactccgtgagttcccttacaagccccaaatgggtgcaatgtagtctattttggatttcctctgtgtaaatatagaactctgttccttgtccttgttcctataatgccaactaattatctcctcccccttctcacctaaccttaccagatgcagttaatttacactgtctgtctttgcgttttctcacacaacaggcacactccactctggctcagaagaagtctgtttattcccttgaaatgtgcatgttccagggagagggagaggatggttccccaacttttcaccaccaaggaccccttaagcttcttccttggtgaacacagggttttgcaggactttgccttccaaactgctatggacaaataataatgcagctataattccatttttattaatcaaaaacgtataacaaaatgggaaggtaaaacatctcctctcagaaatgcccttgataccatcaatggccaattaagagtttttgattgggatgagataatcagtgttaccacactgacttgggagacttccagctcaaacacaaaacaacttggctttctggtgagtccatgtgaccatatcccagcagatcttctgtttctaataggctgcttgaaatacgaaaaatcgctttcactactttgtggccctttaattgaaaaccattggagtttacaataggggatcctccattaaggacttagttctccacttctcaagacttagccccagagttggagttttttcccccaatactaaattactccctgccttaatctctctagaaacataaatttattttctattttcatttttctgttcagtatgcttttgtgaattcttgggcaactatgcccctctccaaaagcctagaccaaaacacagcctagcaggacttgctgctgaatcaagggtctcctgattaatttttagtgtagaaatccaaagtccccatcaggggaaaaaaccacaaaacagaacagaacaaaacagaaacactaatgaaacatcattcttactgtggccttcagctgagctcttgtctataaaggcctgtgtggtaaataaaaataaaaggctcaaatggatttgcatttgtgttttagagggaagctctaattcaaacttggttgttatgggctgtgttcttttcaaactctcttctctatctggcaggttctctgacgatccagtgagcctctggggggctcaggataatctggtgatctgtgagaagaggactttagggacagtctgactaatgtgggagaaggaagatgagtccctattgttcctgtccttgtcagccccataaaaagtcagatggatagagagggcaataatttattttgaatcttcgtaggctacccatgtgcgtactggtagggtattttctagtaaataaataaagaggaggtccaacctatttctcacacgctaaatatcccagtcttttgtccctggacgttggtctcatatatttctgagctctgttcccaggaggaccattttaagtgttgatgtgtttttgtttattttctttcttgagaaaccaaacaaacaacacaatgaccttcattcaaaaggtttattcaaaaagatctgaataaactgaagtttatttgcccatgaagggttctcctgacaccattttcttttttaaaaaattaattgtggtaaaatacatataaaatttaccatcttagccattttaagtgtgtagtttggtggcatgaaatacatccacattgttgtgcaactatcaccaccattcatttatataactcttttcatcttgcaaaactaaaactctgtacccactgaacaattccccactacccgtctcctacccccgcaagcacatggaaaccaccattgtatttaatgtctctatgaagttgactactctagacacctcacgtaaatggaaccaggtagtacttatctttttgtttctggcttatttcacttagcatcacctcaaggactctccatgttgtagcatgtgtcagaatatcctttcttttaaaggccaaatgatattccgttgtatggatgaaccacattttgtttgtatattcgtctggcaatgggttgctttgaccttttggctactggaaataatgttgctgtggacatgagtatatgagtacctgtttgagtctctgctttcaattctttggggaacatacccagaagtggaattgctggactagatggtaattacattttcatttttaaaaggaacttccatattgtgcataagcacaagcaaggcttccaacttctccacatccttaccaatccttgtttatattttattttattttatttttttgatagtagtcatcctgatgggtgtgactcttgttttcttcttccaccatcttggtgtgggtattgtcatctgctggtttcacctttggtccaggcttgtcattggcccttctcctgctgtctaacacagtctcttcctgcctttctctgcctcatgaagtaacttgttctactgaagcatatgtttggatctactttcccctgggccgtacttgttcttcctgtctctcaagtgtgtttcttaactccagtgaagtgcgatttgtgggacggaaacttttagagaatcatggtagagatagaatttgggtagtagttggagttgagctgcaggtgagatttatatctacaaggtgacgtatgtctgcaaggtgaccattacctcccattcctcggaaatgggtaaaccagatatatcagtagtgttatctcctgagtgaagatttctggctctgagaaggatagataaaaccaataataacatttatctaacaattaattggcacttattgtatgttgggcattgtgctatgacatttgtgctagtaaaatcatcttaattctcaatggttgataaaagtctcaagtttgaaggagttatgtaactcagccaaggtcacatagccagtttgcttgtgaaactggaatttagtcaataggtagaaattacagagagaaagattttggtgtaataggaagaaaaactgcagagttaagagctgtgaagatggaagggcctggtgggtgtgatctggaagaactgataggaacactggagggggaatctgttattgtggaaggagtgggtgctgttggcccctgaagtagcatttaacttgagattgtgtgagtcacattcaactgtgtgacagatttgacagaatgtccatcctcggcgtgactgaggagtggatagtgcagtgcagcaaaagggcctcggattaggaccagaagacctgtgttgggcccaagaacatttcactagttagctatctaatgttacagaggtcaagagcctcctctctgtgactcagttcccctatttgtcaaatgaagtgctttgggttcatgggtgactaatacactaccttccaattctactttctctgattcttgctgaggcctcaagtttgggggtcaggtatgctaattcatccctgctcctcaataatttaccggagttattaatatatatgtcttctctgtccagactcttcatctccagtatgggagaacccagtactgtgaagagcccacagaaacctggccccaggctattaaaaaaaatttctttttgagacaggctcttgctctgttgcccaggttggaatgcagtggtgcaatcatagcccactgcaatctcaaactcctgggcttaagtgatcctccctcctcatcctcccaagtatctaggactacagttgtgccactatgccgggctatcttttaaattttatttttttgtagagacagggtctcactctgggcccagtttggtctcaggaattcctggcctcaaactatcctactacctcaggcttccacagtgttgtgattactggtgtgggctgctgcactcaatgtatttttttttttaagtgaaaatttcattctctcagggagggtttagattttctcaataaaaaccacagattatctatccaatgtgaatgcatcattctttcatgatctcattccgttgtttcctagcaaaacctttgttagtttcttggccatttcagggaattacaggtaagataaaggactctgtagctgggaaaaagtgtccctatggattgaagctcttcattggaggacactggagccaagtggtaaaaaagaaacaaaattttgttcgagaaaatgactctcctcctcatgattgcagaggtggtgctggaaagttcactcatgtaattgggttagtatttaagaattacacttattctgcttgcctggccagcttcctgacactggagttttaggatttgatgcaaatcaaatccttagtcgtgtataaatgggctcgttccatcattcattcacttgctaagtccttatgttattcagtcatcaagcaaaaaatatttgtgaatggcagtgagagatcagcagcgaatacaataggcatggttcccgctctcatggagcatacagcgtaaataagcacacaaaaaatacgtattcacaaaatacaaaaagcgctccgaagactaggtcaatggatggtacctaggtcccaacattcgaatcccatcctttctttctctgtgaatccccctgtccggaacacagatcttgaatttttcctcttttctccctttgtatacactatttccacctggaatacccaccacaagcactctgccaatataaatcctatccctttttcaagacctagttcagattctacttcctcaaagatattagttcttgtagtgaaaatcttttcccttgacatttatcacaaattcttactcttgttcaggggtatgggcattatttatttattttacctatttcgtgcttgctttacatttccaattgtattataattcttagatatcagacatcacatggcatttaaatcttgatgccaatatttattagctgtgtgatggtgttaataatacctctccccttaagttgttgtgctaaatacattcatgtaaggtgcccacatagtgcatgatacaacagatgctttaaaaaaagtcagggcaattatcctgtatctcacattgcatctttgtagtggcttggatgctacagacactccatagatattaattcacagattaatctctgactgccaagcattgaagagtttgggtgattgagtctactgccagttcatataggacaattcctgtgacttcctgcattctacaacctcttagcgatcttatgtccagtggcagataggtacagaacaggcccaagaacagatatctagggttgtaaagcagaataaaattcttacttatatttagtaagtatttatcaagggcctattatgccatggaccttgcagtggggtcttagggataataagattgagtaaacagaaagctttcccattaagagcttggagtttatatggaaaaacaaaggatgtgtagatatcctttgcatagactaggatgctatgcaaaatgcaaaaagtaccataaaagagataaaaggataagcactctggaagatctgaagtgcggagataatttccatcatggcagagataggtggggtgatggctatacctcgaatatttacaaattggggcagaatggccttctaggaagaaagtgtgttggaaaaggcacctggaaaggaaagaatttcctaaacctgcacatagttttagaggtacttgggtacatgtgacgagagacagtaagagaagttggagagattatttgggcccagattttggaggactttatatgcccatacaaaagtattttgacattactttgttagcgatggaagatgtagaaggattttgagttgtgccatttcatgatcaggctggtattttggagacagaactttgaggatggattggaacatggagaatggaagtaggggaacctgctagaaagttttttccctgccagatactctggtatcagccactggagggaaaggtcttttttctcacctcttcacaccctgcttcccctcccccagcacactcaccactccaaagcttttgttgatgttgccgcttgtccccatgagtacgcgtcttctttgttcactgggaagctcagattcattgcggggaactgctgttataccatctggcaatctgtgaattttttagtagcctggatgtttgtgagaaagcagaaactcaggccagaatccaaaccatttataagtaattctttagaaaagagggagaaagacgaaaaccaactcaccatgactagcattctctcattcaaagtgcttgcccaagacctctggatcaattcccagtgaaaatcagaggaccaactggatggacgtggttattagaacagatgatgccatgcttcaacttccagcttcttccttatgaaattgtgtgatgtgattaaatagcagatttgctaggaagtggatgggtcaaggagcagaagaacagtactctaaaattgtgctgtgctggaaataagaagtaggtatttgtttttagaaaagacatctctttgcaaacttatccagctggctttaggaggaacaaaggtcgtggagcctgggaaagattaggataagactatatatttatccaaagaggacctcccaaaactgccagttattatcttcttctattggagtgaacagggctggataagttctttgggcccatttttgacccagctaagagagtggcatgccaaatggttgggaaatgagacctatataccaaggagagaaggaagttatccacagatgattcgcagatttaggattctacccactagggattgactagatgatttgtttgcgaattagaatcttgtaagaattgttctttgttgctgtcttctacacattgacctagagttgcagctggaggggacatttgatcagaaagagaggtagctgagtgatgagaggctccaagcttgtcagccagcctagaccaaagcctataaggagtcagcatttcatcagtctagactggctcattgatgaaatggttgtcctccaagaagttttgttgtaacctcaaaatttccagtgaaggcaaactttcctggtcccctcgagaccaccaaggagctggagctggtgagaaatgcagcagctgcccccatttaacaagagcttttgagagggaaataaggggagaaattcctaactccacggatgtgatgacagaaatggaggaatttgcagagatggaacaaacactttgggactagtaccttaaaaagcccctaagtagccaggacttttaaaacagaggactcacaagatggcagtgagatgagggctggggctattgtgtctctgaatgcttctatttccatgtagcccctccaaaaaagccccaaggtgtgggtctctctggagataaatggtgagctgttttggtgctttatgcacaattgtacaggacatttttctaattaattgaaaacgacgtgcacaactcattttagctacagactggaaatgttatcccacattacagagcagaaacccaattgaagatcaacaattttgggagctgtgtagctggccaaagactcagttgggataagagacaaggtatccagctcccagaacaaaatcgaggtggtctctgcaaggaaagggacaagagaaacagtgggattcacatagaatagattgtggctgaattacaaggcttctaactgtactgaaggcttggaggatttcctgaaggtctgaggattcattacctttcaagcacatggcttggggcaaactgatggcatttcactttactataatcagtgattttgtgtggagcctgtttcttacatgcaaaaagtattctctcacttcagaagatacacataggaaatagatttctgacacatgagctgaggactcaaagtggctgctgttcttgtagtatgataataaccacagtaaaatttggcatcagcacgggtttgcttactcctctgtcattcattcattcatccattcattcaattcttccctctcattgaatctagagttgccatatttagcaagtaaaaactaggatgctacttaaatataaataccagataaacatgaatgatttttttagtatgtatatccaagttaaatttgcatttcagataaacaatcatttttcagcataagtttgtcccatgcaatatttgggatatacctccacagaaaaataattcattgttatttgaaatttaaaattaactgagcatcttgtattttatctggcaaacctatctgaatcctggtttcttatgtgaggagttggaaagcagtggccctttctcagcctgtggagggggaagagagatgttgtgtggccataactgacttcagacccaatcagcatatgctatggctcctttattttagtgatttttaaatctttacctggggctcataacctttgccttctgatctatacagaagctgattcacacgtaggagattcacttaaaaggcagacaggtgagcagaaagcattattgggatccatcagcattttcccctcttctttgtcagtttctcctcacagactccctcctcatgttcagtctcttccctccttttttgtcacctctcaatgccttggtctcatggtctgtctagaccctgctttatggacttgtcacctcccctggattgtttttgcttagtgtccactgtccagcccctgtgcactttaattctgacttccctaaaaccctttgtttagcattctccaagtctccttctccagcactttaaacatgtgggattgtttaggctcgagtgataaattgcacagagttaaaggtgaaggagaagctccactctctcttcttggttgtggctgacgcttgaacaagagccagactttacttcgatttaacgctaacagtccgctcgatacttacccaagcaaatgtagagtggctaatgcattttatcctccagctggcaaggcacaggatgaagagtaaccaccctttagacctgtatctggataatgtagagaactggagaaaaaaaaatctgactttgaaaatgtgatgtcgtgtagattcaacctacatagcaaaagggacagcaaagttaaccccacccctgcttcctctacttgtctttaatccaccaccattgtctccatccccttctttttcctttgtttacctttcctcttcctgccttcagtttttgggcctcccttgctttctatccattgccctgcatttctagtgggtgtctaaccttgattcctactcaggcaatgagaaacatttcccttagcgacttgcaccctggtgcctttctcctaaagacctccctttcttcttttcattccccgatgaagaataaaatgctggtttcactgtaggtgtcccatttataactctgggctggcggttttcacttcaagtggcgtccattgagcttgtaaattgtattggatcagtgagcccataatgagacctccaaacccaaacactggaagtctgctgggattttattgttcataaagctccttccccggggagggatagagtcattaggtgtgcactgtgtttaatatttggtcatgacaggaagcagtaattttctatttttatggtggcttctgagtttttaaagcatttgtctaattcccatcactgagactggaagcaaattaactagacagtgaggaaagcctgagtaagggtggtttgggttggggcacatctttcttatctttctccatcctgtgcctgacctgctccacctttgatggttggcacctgcctacacatgggcacaccttatcctttgagccccctgaactcttcctgtcaggtagaaacattccttctctgcagagaaggtggagctgtgcctccccacttctcaacccctgggaaagcaggcagttttgagcatgatgtccattctgaagattttcaacttaatccagcttaaaggtagctccaagttgcagtgtaagttctccctgcctcttggggtgggagatggctttggcttagaaacttctgaaacagagacagacaagttgctctcagaaaccaagcacccagagaccaggagagaaagaactgttggtgagtttgcatggtcaccatcagttgaccaggctgacctgtgatgtcagaacaagaggtgggaatttctgagtacatgggctcagctgctgtctagtcacatctgtacagggccataaccagcagatgatcctataggtcctggggccaatgatctgttggattctggctgctggcctaccctgactgtgggatttgcagtgccatggaaccaatattctattatgtaattccaaggacaaggaggaagaagcagaagtccaattgcttggattgagatctattctgtctgtggaatatcttggtctcttcagagcgttttccctggtagaaaactaacattgaggcttcagagacctgcttcttggggatgccaaagccaacctttttttttttttgagttttacaggcccagtgggaaccagctgagcaaaattatcatgctggatctggcccttaaagctgtggaactaactcttagctgttaatcaaatgggatgaccttgagaaatacttcctaaaagcttcttggcatttgatgcctgaacttgttgcacattggataattccagggaaagttaagaaaccttggcctgaaggcagaaagcctgacccagggagtaaataaaagcctctcctttccaaagtgaaaatcatgcatacctatcctctgaaatagtatgttgcctgcaaagtgagaggatgcctaataccttcccagtgtttgggggttctttgcctttttttttttttttttttttttattgccatggatcccactgatggtccagtgaatacaatggacccataatactaatgtggcttgtttacatttaaaatggaaggaaatggtaaatgttggttgggggtcagtgaaaataagatgtaatgtttatccaagctcagggacctcttcacactccaaatgcatgagaagtgctaccaactacacatcagcacacggtgctctttttcttcctattccatcagcagccctttgtttctctctcacttctttttttttgagatggagtcttgctcagtcacccaggctggagtgcagtggcacaatctcggctcactgcaacctccgcctcccgggttcatgccattcttctgcctcagcctcctgagtagctgggactatagacgcctgacaccacgcccggctaattttttttttttttttttttttttgtatttttagtagagatggggtttcaccatgttagccaggatggtctcgatctcctgacctcgtgatccacctgcctcggcctcccaaagtgctgggattacagacatgagccaccgcgtccggccgtttctctcttacttctttacagtctctctgctcccttctacttgcagccttttctcttcttcctttcctctcattttatgtctgtcttttttttctgtctctcctccctctggctcccatcttccactccctaagttatccagagcttctagggaagccaactgacagcgtgcttgtcagtaacttagccttggctgttctgtggctctcaatgggccatttgtttgctcctgcgaagggagagaaaaaaaaaaaaacttttccaacctatgaggtccgttgtctccctagggatccttgtttgaatctttgctgtaagattttttttttccttctatgaagtaccaaagaaataattgccttatcgttaacaaacagaacctggctcttatcaccccataccccagagccttggtgcgaaagttgggctgcgccaagtgcatgcattaacctgatacgcgaaaccccctttcaaagccagtccttggaggatgctcattgagggcgtttttgtcgagaggtggcacagtgaaaccccttcttatagctctaggtgccaaaagagattggctggcgtttacacccctgttacaacaaaaaagagtgtatttttctgggaggaacattttcagattgttctaattgtcactggcaatgagcaatacttggaacttgagtcttgcagtggccttgctggagtttccaagcatcctttggcacaggagattttttggttgtatgggtatgctgtggccggtaaaagcaagcggactataaaaaggatgagggctggctgcccacatggccctgtgagaggacagaacatgccctagaactcagacccaactgtcagcatggttctgcgtttgttttgggaccccagagacctcctgtgagggctcatttgcatctaggaacagcccctttgctctgacttgttcatggtctattttatcaaaaacagagatcttcctctggaaactgggtagattgtggcatctcacttaaatcaatggtatcattttcaggcaaaccgactgtaaggctgctctctttctcttaccatctagtcacagagcaacacaacttctggggtcttttgggtatttagacagggtgggcacatgagggacctggaaaatcttcactttgaggtcaacatgaattgtgatcctttaaaaaatgttttccctttgagtctttttttttttttttaaataaggggactgcatggcaaaacacacacgtaaaagatatacagtgtacaggcattagatactgacaatgagtctggaaaggtccttggggaaggttgtgtttggggtggggggagaaatccttctcttcagcgtttcccagcattccttctagacatctggttctctcattttctctctgacttctgccttttaaaaaatataactccactattgtcattattttttattatttttaaccatttaactaaatgtgctgaatggtgatcccacatgacatcttgtctaaaactcatttgaccttcaaaagtgatgaccttaaccaatttttactggcaagtgtcttgactttattactcaggagacagtttatttttattccttaaagagagagtgagcaagagaaagcgaggttttcttgagatcaaaagaagggagggaaagagtgaggaggttctacccacccatctctctactggagcaacatttttctctttcccatcctgttttattattattctcagtgtccttataaaagcataaataaataaggtgaaatctcacccatgcctcctgtagccacatttccctcttaaagcattcaggccctcctctgcactttgaaattggattgctgagttggagtattgtctaatgtaaccattgtattattttctttggcccactaagtagaggccaagttggttaaattttaaaagacgaatgaatgtgtgaataaatgaatgaatgaatgcaactgggttgagtagttctgcaatccaattttagtagacataggtctgagttagaagaattaactttgctgatatctgcctcctgctggtctgtatcactaaaatcaaatatgatgaggcacagtggtgtgcagttggtagactctgggtagaggccccaagtggaatgagcacaatgaatgaatcgctgctctatgctcagatgaagtggagtgagaaaaatcagtagaatagagtaagactgtgttacctccttctccctgcactaaagagctggtttaggtttctggcatcataaatctcaaagacctctgaactactggtagacaagaacacttaaactttagcatcctacctgggaatgaaataattttaacctttctaggttatttgaggtgatgtgttgggaaaaacattagggccttgatctagagcatttttcttttttggagtggagcttctttagatggcagcaggggtgagggcattgtggtgctggggaggcaccacatcaggtcagggctaaggagctgctatctgcttaaagctgctgccctcagggtctcttctgtcttgagaatgtaggcttcattggcctaggctttgccacatgtcaggaaatgcagtgatggttggacaaaggcttgaccaagtcaccaggagtttgtgaagaagcaaccttcattatagaccaggctaaaaagaaaatctcctttgtgtatgtagattaaagtctggattgctggagcattaataaatatcatttataccatttgcaacaagagtgactggcttatagcagttggagtctcagagttaatctccatgtcgccctatccgaatgttcttactctcataccatcccaagttattgaaggcaaacaaggctgttgattcagttaatcaactacttggtcaacccacaaatgcatagcgagcacctagttgcactcagcactgtggtagtaatgtgggggtggtgagaggatgtgaaaactgctggttaaagatgaaagggcatgcccttgtggcagggaagaggaggatttatgcattcttgattctatccaggcttatttgtgtgtctatgaactcgtaagacacactgcatgtctctggggctcaaacttagcagtgacttctggaagtcatgttgatattgttgctggattgttttttcttctgtggtcactattattttcttggcctacccatcacaaaacagaggtcacagcaccatgaccttttcctggtggaatggactgcttaagaagtcacatggccaagtttctatcgggggtccacatttgtttcctccactcttttaatcagaatgctcatttaattctattccagcacctgttcagcaattaacaccctacgatttgcatcttaccctgacatttgctatctttccaattagtttttatatcagtataattaggtagggttattacagtgcatcaagcagggtcatggttattcccaagcctttaagcgctttcccagatttgtttagggaagccactaagggcaaatggttgattaggatcactgtttttcttcttcattcagatcaggagaaaactgtttccccatgtggctcatgaaagatcagggaaatatgtcaacctataagaattagtattatgtagttcacgacttttgggcaaatttacagaggattataaataaggtgtacaaggtgaatgtactgcaggcattttctatgctgggatcatgacaaggtcctctccttgcttgctttgggtgatcagtggcaaggacaaagagaaaatgttaagcaaaatcgaaaccctcaaagtcaacttttcagtattcttgtgtttctgaaagagaaataaatgctttcttcctaatagtgcaaaggaggaaagaaaaggcaaattcacattcagccagtatttgtatttaaacttaactttgattttgtaatttttacccaccttgggagtacctgaagaaacaaaaccaaaaagtctccaccaaaataatactaatactaatactactactaataataaaagtcagagggcagaagctttgtgagatccattggcgtatctctttatcatatcctggatacttggaacaatgcctatatttataatataagcaggagggaattgttgcctgttattaagtggagtgtccagagtgaatctttgataagttaagatttaaaatatatgccattcattaatattatatattataatgtgtatatattatttctccatatatgccttatcaaattcatagagttttctcatgtaggtataggttattcataaatgtagaagtcaaatttcatttcacctaatacaaaagtcctggaattttgagagttgataattgttggaaacagacgagggctttggactcttttggaagagcttgggttttggtgggcccagtattgtctgtagtggtgtctgacttccatggtttgaaggaaagagcctgatggtttgggaaggtgttatagcaatatccggatgctgcctctgatacagttgttggagaaacaatgccatgattggtgggggatgtaataatgccagattcctcagggagagaattttacactgtctgatttcatatcgacaaggttttcttttacctgtgatacaagattgcatggagtcatcttgttgtgtcttgccttgattttttttttttaatagtgggtggaaatgtgatttgagagtagtgtggatcagaaagccaggaaatccacattgttataactggagcacctcaatttgctatttgggggtacctgaaatgaaaaattccaagtactgagttgggatgctctgaatgtttctgccttaattaaggagagaagagagttttgcaggatggagggaaaagacagatgattagaaccgcctgatatagcagaagtgcttccacactgccttgatattccttcttcaatgcactccacttagagcaggcacccagcaagtattagttaaagggatgatggagccactgggaagaccacaggaactcacgagggcagtgtcagtgggagaagcaggaggaaagagtgtggcaaggtgtgatctagtctcttaaaggaatatgggaagaaatagagctgttttgcccctggctgtgatggaagtgataaaaactaatggggacgtcatcgtcatcagttaattcacatctattaactggaactgtatatttcagtgtgaagtttggggtcagacgtcctttggattttaatgtccctttagtgagatactcctcccaaaaccagcacttcttaacccccttccagacttaattttcttcctaacactcttcatcaactaggatgccatatatttgactcatttacttgttgattgtctatatttccaatcccccaccaactcccactactctgctacaggtgggcagggatttttatctttgtttatccttggcatctagaataatgcctaacacctagtaggtatcgatgagtatttgtttaatgaatggataacagaaggcctgcaccatggaagactttgtttgatgcttcacagaaaaggtcaacggtatggggctgctgagtgtacatggcacatgctgtgagcaaggagacagggacagcattttcttcgtctgtgtgccttgctaggatcacctgtttgaaatctggcaaacaccgcaaatatggaaaatgtcttagaggcagagaatgcatacatgcataaaatggtaactctgtccattagtggaaaagctaagaaccttatctgcccatctctgcacacacttcatctttgtcttaatagatttcattttcgaatgcaaatgctcttggtataaatgaaagggcctgttttatataggagatacccactctaagaagaaggcaagaatgagaatagagaaataaatttagtatgtatcaggaattactgaaatgattttcaatttagggttaaggcatatttctccagctatttcaagttagttatttttgattgcatttttccttgtgtaatattcctaaaaatccctattttcatataaaggacatttatttcgatgttccctatgctagtatgatatgaaccttaatatgtatatttatatatactaagcaaaggcaaccttccacagaaaatctctctcgtatgttttacctgtggctttttctcccccaacccacctttggactttaaggacaaaaacaaaatctcattcctttaacaaaaatctgtgacacaggaactctagggaaatgatacgcttgcaaagaagtgaaaaaataaacagggcatgattctttctttctgtcttagaataggaacaaatggattggcttcctaaggtgatgaagtttctctccctgcttcagttttctcatacttcgggtctttcaaggctccctttgttaagttaccacagtgaggtgggaaaaggttaacccactcaggaggaggcattccaggaggggacgcttgcccgggcatccatttatgattgatgtcaccatgctcctggctgtgcatgtgtcctggaaatatgataacacattgcttttttttttaaaaaaaaagttcaagtaaattctattctccgttaagactgctgacagttggagaatcatagcagggaggggcaccacagagcggtagcagtgaatgaggacttgattttgcaaagacacatttccaggtcttgctcagggtccttttagtcaatggtaccatcccatgtttacttatgtgtcagtttactaaagaccttctgggaagcagatccgcattttagctgatgtctctctggctttgacattgtggcatggtcctggttgcagcatcagaccgaaggaatacctggtcattagtatttattattggcaaacttgaaagttgaggcagggagaaaaaaaaaaagccacctgaagagaaatgtttattgggaatccaataggtgaggacagcatttaaagctatttaaaatgaaatttaaagccaggcaactagaggcatattccccacacagaaaatatgaaaggaaaatgattggtcgctgctatcgctttcttttactagaacaggttagttgtttcacaaacgcaacctaaaaataagaaatcgtatcatgtatgagtgagagcaagattagcaacgtaatcaatataaacaatatttccaactctatgcaatttccttgggaacaaccccaagttactgggatgcaatttcaattgctttgataaatgtggtttgcctttatccataaagtgctaagctgatcaactgctgagctattgcttagagtccgaagcagtggagttattaacttttgctgcaaagatgtaggtaagactaccttagagatgtgtgtgtgtgtgtgtgtgtatgcacacatatgcaagcatataaaacaaaagtttatgcactttaaataataatgtttatggactttttctagtgcaggcaggtaaatagctacacatcggtgcccatatttgtcaatatctttcaagtatccattcatggaacgctcggtgatgaaggacagaaagagccgctctttgggtctgatgtatctgcaggcatcagggaatgttcccctcagcgcggtgccctcgtatcgagggaagaaggcattccaagatgtcataaataaataaataacatttgccgttgtttataaatcaattaatttgtaagttgaaaggtcatgcaaaatatttagagctttccgaggcagctctcaagctgcagcacggcggcccagaagcagctgtcacgattgtgctcctctcggtgctcagctgcgcgtcgctgggtattttctgccgggaacgggtgaccgcttgattagccgctactgggttttgttcaacggagagctctgcatggttgcattttaacaccttctccactaagcaggaggccagcacagggtgctaaattcctgtctgtggctgtctgtgaaataaatctgtgtgttgtgccgttccaagctgtcagcagtggttcgccctgatgggcccctgaaaggagtttcctttcggtctgtggagcagtgagcagccactagggagctgtctttagctcagatttcagagttagttcattagaccaataacagcagacactctcttaaacatattcacaaagttatattatgagaagggggaaaaaatgccacggccagacaatgctaatattgggtttccccttcccttttgtaccagcccagataggagacaggaggactccatgacctcaggctccttttctttctgttccccccgactttccgttctgatgtgtggcctatctccatgacaggtttatttataaaagcaaagtttcttcccttcctgggtaggcagtatctctcatccattttctctgttccttcttaataggagttcgagccaatggtatctgaagtggagggcgtccagtgaaatgattattccatgtcctggcttctctccttgttctttaaatgcatgtttttcttcttggcttaggatgtcagcagtctcctcagatatttatgtgagattcatgaaatgaagccagtcactgaatttctaactggggtgtttccctgcaaaacagttttttcttctaccctctatttaacttgttcagctcttctgctttaaacattccagaacttctctgcccagctgttattggcatgcgatcgctataatgtagtagataccacacggatgccgtttgccaagaatctcggatacttttaatttgcgggcggtatttcttagagaatcgtggctggaagaagcaaaatagagtcaatacccaagttgcccacgttttgcagcgtttgcatttcagtaaaggctatctaccttttgcataattattcaaaataattttatacatcaaattctttttggctgatgagtactaagcacatgcttgctttctgattcttgcagttatttgtcattatgatgtgtgatctgacttgtgtctggtaatgctagttttacggttacacatagatctgctttaagaattccctggtgctcacttgtatagaacatgctgaatacgtttatacttggctttagcacaaaggtgattctcttctttctgggggaaaaaaagagaaaactcaggcaaagtatgttcagccattgtgaagtaattcaaggaaaaggaaagaaagagcaaaataacttttttcctcttttatgacaaactcaaacacccactccatggtggttttttttttttttttttttcgcttttactcatggataacttaaaaatggctcaacttgaaattttccatgtgtccacaaaagctcctgggacttctgaggatatgtaggcaggaaacacttcagaatatataagcaatcaaaattttgttttcagtttgtgagcatgctgtataaaatatcacaaactttttggcttaacgacttttcctacaattttacacacacatagcatgtgttgttgtttttatttctgctttactttcgtgttttttttttttttttgagaggttgataaataggggtaagagtagtttggttattctaggcatggacagttaactatgtatttctatgcagagtaacttttttcctctttttgtttggtttctaaggaaacaaaggcctgggatataaaaagcaaagatgataaaacgctgctaatttaatattggcagtaaaatttcaggcaaaaggaaaaaatcaaatgggaagccttaattcttctaactgcacttagcactttgcaatcgagaatttttccctattaattacagtgatctcagtgagtactttagtggttaacgtagtaggttgatgggctgaatacatcttggagtccttgggttccaaccactgtgtgtctctgtggcaccactacactaggctgactttttgctcttaaacagccacttaaacatttatttaatgggcacggaacatgaccttaccaggtccttcccagctgaggcttctcacagtgatcaaggcaggacgtgttttgcagtattattggtcaaatgcagaatagaataaatgtgaagggaactgcaggaaaaggagaaaatatgggaatgcagacataatgcatattatgatttttccatagacttcctgaggactagccttgtacttatagccgaggagaggttgtgtgctgtaaatactgcttgggaaacatagacccatacccgtgtatcactgaagtccatcttgtatgcagttggtgaaaactattattgacctggaagatctcccaggccctgctggtcatgatgattgcattggaactggggacagagtctcccaagtggattcaaatattagcctctgtgaacggcccaaatgtaggacatttaaaactatttcacttggaaactatgcagtgatgtcttcttttttccgggaaaaatgctgagataaaattattatttttttttttttagggaaacctgctatacttttcaagttatatcaggctagtttatatctgtaattgggagctgctttctctgtagtgtgtgtgtgtgtatgtgtgtgtgtgtgtgcacatgtgcaaaagttgcaagtgtacgggaaagtgatggttctttaggggtgaaaatctgtgtctgatccgggaatccagggtgatcccactattgcagcctggctccagctctgtggtttgaaggcttggcgtgagcctaggagcttcatgcaggggtgatgagtgttattgtcttttagacttctccatattctcagtgaaacccttccccagcaaccttgactcgtgcttttgttttctaaatgagactgttttagtttccatccatttctttatctagctgtttgtttgttttacatatggaccctggattagatgattaaaaaaaaactcaaatgaaatagaggagaacaagcagtaaatgacaatattggcaggagaacatgatgaaacaaattgcatctctagtttcccagtgggacccgataccaaagtgattcacgtttcatgaatggagaatgtcagaggccacagggggtgttcaggggccccctcaaggctgtggagtgagtcagtgcccaaggcaggacacacagcctggcgtcctgtccactcaccaagaggccaggctctctccctgttgatccaataatttaaaacatcagggatggaaatgatcagatcgcagaagaaaacttcactgaagcaacatggctccaaagagccaggagaagcaacagttctctttaagtcatacttcatctctcagtgagaatatttcttaaggattatgtgcattacctccatcaattcctttgcttctgtggctgtctagaagggcctgctccttcagtaaccgaataacttatttatcccttctgttgaggtagactatgctgtcatctgacaaaaaggtgaaaatgtaaatatggtcagaggagtgtttttgatagtagctatattggattattgaccaaaaagtatgaatcaagtgggtcctgctgtgttcaaattactcagtcccacagcctttaaagggaaaagaaattgcagtggttctgaagaggaataacacagaagttaaaatcctatttccagtctcttaaaaaggagggatggggacttggccgtgtgccctgtctcactatagccaacatcagcctagctagtgggcttctgatttttgctttgaaaaaatccctgctgggcactggcaaggagacagtgtcatggaaatgtaattaattggacgacatagttttctcatcaggaagaatatagaaggttgtttatttaaatatagagtcataaggaataatgccacagaaaattacaaccctacatccatgaagatgttcattccattgcttattatctagaatagcaaagacctgagcaatctatttcgtaagagaagaatgactaagcaaatgatggcacagagatttgatgcactattgcacagtcattgaaaagaattatagaggttgtctagcaatgtggaaaaataaatgtttggtgaaaaaatagaacacatgttgatctctgttgtagatactactctgtaaaatgtgcctacatatgtgcatgcaggaagcagagaaaatgaaagagtcaatggtgagggtggtgtgatgatgtccctggatctgtttgttactttctgtttttattttctatccctaatgtaattataggcagtgtttcaaaggaagatcacctggatcagctttctgaggacctgccttagagtatgttttaactttttattcccactctgcatttgtctctgtccaaggatgtttggctccttgtgaaaatggatgtttgttctgcagaaagggcatttttttcttgcgctggggagggagcagagttccaatggagacatgctgcatggaggccctgaccattttaaaaccacaaattaaactgcggctactttgggaaggatttgtgctttgaagtcagtgcttcaaagcatgagtctttctatcattttaaaatctttttttttttttttgagacttggtcttgctctgttgctcatgctggagtgcagtggtgcgatcttggctcactgcagccgccacctcccaggctcaagtgatcttcctacctcagcctcccaaacagctgggactgcatgcacacaccaccatgcccagcttatttttaattttttttgtagagacagagtctcactatgttgcccaggctggtcttgaacttcagggggctcaaccgagcctcctgccttagttcccaaaatacctctctctctctctctctatatatatatatatatataaaatatatataatatataatatattttataatatatattatattttataatatatattttataaataatattatattttataatatataatatattttataatataatatatataatatatattataatatatattatatattatatataataaaatgtatatatatcacatatagatatattctatatatatatatctccatctcccagctcttcttttatatctaactaacttcttagcagtgttccataggttttcccatgaccggtaggaagcacaatagacaagagaaaattctgcactttaatttgatttttttgccattgtacttgtgtttctgggcaagtggttcttccctttgtacctcaatgatcttctttctatttcttgtctacctcaaaagaagactagccactatgcgactgttgtatatggatcccactgttctagataaatgaagaaattaaagataattctgttctattctttaggaatagactctattttatggaatgaggtggggctcagtttgagctatggcacccatctctcagccctggttacgaagtcaccatttggaagttgaagggtttaggtgccttttagtggactgttattttttttaaatgatatgattaattttggtcacggaattgtttttatagacagcattatgaaagggaccactttgttttaaacctacttttttttttttttttttttttttttggagacagtcttgctatgtcacccaggctggagtgcagtggggtgatcttggctcactgcaacctctgcctccctggttccaacaattcgtgtgcctcagcctctcaagaaactgggactacaggcgtatgccaccacgcccagctagtttttgtatttttagtagagacggggtttcaccatattggccaggctggtctcgaactcctgacctcatgtaatccacctgccttggcctcccaaaatgttggaattacaggtgtgagccactgtgccagacttatttagtcctatcttaatagtcaaagtaaattacactttgagtacaatttggaagttgggcatcaatgtaaatcatgatacattctactctgctcatctttcttgcaactattttaccaaaatttagccagtttagagacagatcattcactgggcttgaaattatggtccaagaaaagccattgtttaaaagatttataatattggaaccaatggtgacaacaaactccacatgtagattttattttgagtagttttaatccttttttttttttctttttttaacatgtcagtcttgtcctaaggtctttggacatggggaaaataccaattcaataattaaacgacacctagaagtgaaagtcctccacagagtggaaggacaacgcctctcctaatgagacagaaaacaaagatgagagagttccagagacaaagagctttgctacaaactacccctggtcccccaggagcgcaaactcttgctggcaggagcgagcactttggttaatccctaattgtcctcctggtgcttcgccagagaggtgatttttcaggagaaggatataatggtccggctcagaggatgtgtgaatttggtggggtgggtcagtaacgattgccccttctcagttctcaataatcctggctgtcacctcttccccagggatcatggccagggtggaggattgatggcccaatgttctaagcataatgaccttgcagctcctcagtcagtttacctgaacaccttccaggtggaggttgcctcttagggcatcagatttcaatctgagcttgtctcaagtcagggagaggagcccccaccccaccagtgctcccataggaaccatggtacaagctccattgtcctgaagccggatctgattccagaagttccaatacaggagactacttacctgctgccttacctacataaaagtcatcgtaaacaactttcatctccttcttttggggagagggttgggagtaacaagaaaagttgaagctgtaagaaacattttgaaaactctggctcacagaaaataatctagtagcaatgatggaatagggatggggaagaagcagcagctctcagggggcattcagctcctttctaaaagggcctagaagttttgggcactttttgcaagtttttccagaggctcagttcccaatacataattagttatccatggtaccctcccagtccaatgttacccaaagctcccagagactcccagagtggaagcggaggagcaactctggatagcctcttggaggacaagtgacccattctggtttccacatgaccagtcaggaacttcctgtgttccttgggatccttgtctgcaaaatgaggctgagaacagggatgagaccttccccagatgagagctgtctgggagctgtccagggccacctgcctgcctgcctgcctgcccgcctgcccgcctgcccgcccgcctgcccgcctgcccgcctgcccgcctgcctgcctgcctgcctgcctgcctgtcccgttggctttaacatcaaatctgcaaccacaagcagccacattctgactttagaagaggcttcacacccagggggagagacgcagccgggaagaatcgggccattactaccctcattatttatttctcacccagcactccaaagcctgcaaggaaaagaagtctaattccctccgcatttccatcctgcagtatttactccaagcccgagcctctgcctgttaatgttctctctgaggaactctacttgctttgaggaagggccgtagggagatagaacacaaagggaaaaggaggcagagaagtgctcagccccgggcccttgccgaagaactggcgctgtcataatttacacaccttgtctaatgcacagcacatgtctgggctacaaaaggcgttgggtaggctcggcgctggctgcctcgcagtgagcctgctgggaatgtgtcagcaatactcttaacgatgacaaagtagttcatcaataattttttcccttacacccttatccaagaacggagcaacaaaataaaattcgtctcccatctagccctcccctctgcatggtcctcacagtcatccctcaccccaccagcagacttcatgttgccttaggcaagatgaccacaagctcagccccagaagtgggatcctggccctgggctggcacctttgattccactttcaggcaagcaagtggcctgggatccttatgttcctttgcctgaactcccggttccctttgtctgtgctaaagtcgggtgatactgaggcctttctggctattgtgcctcagaaaaggaagctctcttagttttcatcacaatcctagtgagtttaatgcatttcagttcctttttatctgtcatccccattctggagttcctatgtgagcagcatcattaggatccagaggctgtgtaggagtgggcatgggggaggaaacttaggtagagcagttcttttaaaaatgcagggctgggtgtggtggctcacacctgtaatcctagcactttgggaggccgaggcgggcagatcacttgaggtcaggagttcgagaccagcctggccaaaatggtgaaaccctgtctctactaaaaataccaaaattagctgggcatggtggcgcgtccctgtaatcccagctactcaggaggctgaggcaggagaatggcttgaactcggaggtggaggttgcagtgagccaagatcgcacaattgcactccagcctggggacaagagcagaactccatctcaaaaacaaaaaaaaaagcaaataaacttattttcctttatatgtatgccatgtttaatggagagattatttagaattatagatactgtaagagaaaagaaagcacatctgctaagactaactgcaaataatatttggcaaatatgtagatatctgttcagctagatgttgatagatgtcttcatagatctcttccaagtatccatttagttaaatctctttccatcaacctctctttcttcctctgtctcatccttcctcctttcttcactttttcacttcctcctctcttaacttttttttgaaggcaggagctggtcttataagacacagactgtatgtcccttcccttccccttccagtgctggatgaatgtcttgtcagaatggtgccctttgagggcccagtgagccattgccaagcacagtgcctgccacttagcatgcacttggtgctcattgggttacattttagcacatctttttaggtaccccaaagaccataagattgcttcccatgctaggagtcatttgctaaagactgcattgtatctcaagcttatgttaacatttatggcccctcgttgaggtaggtttgatttttgcgccaacctccactctctaatttcaattccttgctcacttcctgcagcatgaccattggcagtctatccataatacaacgattttcctttatttattgggttagctcttcggctggcatttttacggttatgttgtgcctgttgattgttgttggctaaagaacaaacgcctggctaatgtccacagggaagaacaatttgcaaatttattttatccttttgttgatatttcagttccaaaggctcaagattagtttgcttaactaatgcgttatcccttgatcccaggtgtttccatatgacagtgtcatctgggcttggctccctcgtgtgacattcaggacttgcgaggatgcacacatccttatgaaatactaacaattccatttattaggggttacagaaccaagatatagccagttgattaaaggaacaaatgaatagtgagtttatttatgtgtcaacaggggccagttattgaatttgtcttatttttctcatacaatatggcctcagtactggtgatcatggttgctgctagtttccaggctgtaagtgcagagacaacagggaccatgtcttctccatcttccccaagacttaccactggacccaaaatatgtttgagcttcataaaggccacttagcgatattgatgatgatgctgtagctagcatttgcactgctttgtaatggagcaagccaaactgtggtgcccagtgacaaatatatacatcaccctttgtacctggacaacataaagccaaacagaaggctgggtctctcccaattcccctgtgtgaggaggatttgggagtaaggactcaaatgccagattctcattcgactgtaacttaggaagttctaggactccagaaatatcctgggacaataaaattgtgatgtctacaattttcatggcccgctgttatgagtttctggctgctcaggagttttctgccagggtagtcaggtcccttgtttttgagttgctagtgctactgccttgagttctgaggtcccatggactggggctagatacatttcagagacttttgatgtcttggtccaagtggagatgggttttgagccacacggctggtactagagaaatttagtgggaggcaggcagcaaagaaaacgatgaggaaatagagaactgcagaaatgtgatggtagaaagactaaacagagaagagctgagtggacagactgaacacgacgatagaaagagaaaatggaagggaggaactttcacaggagagggcgtgtgtggatatgggggacggtttgggaagatgggaggcaaagacaaaaaaaaaaaaagaggaaagacaagatccagagtaaaaacatgaaagaaagcagaagacatgtagggaaatgcagaaggaaattaaaaacccagatgtagagagaccaagattgcggagggaagaaaagaaaaggaatggaaaatgagtataggaaaaaaaattgcaagttctctttgagggaggtaaacagggcattcgtcagatgagagttttcatgagacatgctacattagcaaataactccagaaagagagggctggaaaattcaaatacatcttcatctgatgagtttttaaaaataatatttatttatatcttcattggcccccaaatccacagaatgcgaaccaaatcatcatgaatgtgtgtcttgaggagaagaaaatagacaaaaatgatggtggcaatagattgtttttcattttccatttcagagacaatttaataacagtttggctctgatggttttatttattttgctttctcttctcaagggcctattgggtacatgtctgtttttctctaagcttgtttataactaagagggaacctaatctttcacttcagtaacatcaacctgattttctctaggatcctgagtttctctctttcttctccagctcttctacaagaaattggccacatgtcaatcttttccttttcttgaaaagttttttctttccctatactagttactcagtggcgctggcaagtgggacccgaaatttgtttattcaaagagagacggtggtgacgagtgtatttcctgtattgtgaaatctgaactcatctgtgctcttgtaacgagatatcaatcttttgtgtaatgccaggtagtgtgcttaattgccctcttgtaatgtgttatccctgagatgataatttgagttatttctttgttaacctttacacagccaataacaaattaaacatcattatctgagtttaaaataggctgtaaatctctaagccctggtaatactcagacacttacaaccagggagtcataaaatgacattaaatgacactctgaaacacaacccagaaagtactacaaataaatgggaagaaagcagaacgtcaccactggagtttacatggaaggatccatctgaatcaccatgtggagattattcaaattacagcagttttgccctaacaaaaccaccgaaaatgcacttgcttcatctttcttcctacggctggtgtccctttcagagttggacattccttcttcttctatggcttgaaatagtgcgagaaagattgagtttgcttcttttgtgccaccagtttctctcttctcctgacactgatatccttgtctgtttccttcacacctattgcttgaaccacccatctggtgacttctcttgttttccctcccactgcctgacattgtaagtcatctctccttcatgacactgtgagcttgcttgtagaattatgtcttgcccttattttgtagagtaagtgtgccacgacccagggatggtgatggcagctaggagggatggggaagaaggcctaagaagacctaaaaaacaatttcattaatgttattcacatcttctccaactttattttttagtctattttgtttgccaaagagcaagagggataagttaaaagtctctagttataattttttttctgccaatttatccttggaattctaatacttttaagatgtatatattttgatgtatatttttatttatgattactgtgtattattattaatgttagctctttttattattataaaattagcttttttacccagtttcatgcagaggaaactgctatttgaaccaacattgctgttctttttctcagatttgtttgaaaactggttctatgggattgccccatagtctaactgagccttgtatatccactaagggccagagagagaaactgccttctcaagatagcactgaaactatagttaatgatagaacaggtctagaactctagcttccagctcccaatttgaatgttctttctgttatactccatgtcagatggagatggttagaatgggtctgtttgattactttttttttttttttttgagataggatctggttctgttgcccagagccagagtgcagtggtacaatcttggctcactgcagtctcaacctcctgggctcaagtgatcctcccacctcagcctcctgaatatctgggactacaggtgcacaccatcatgcttggttaatttttgtattgtttatagagatggggtctcgctatgttgcccaggcttgtctcaaattcccgagctcaaaccgtctgcctgccttggcctcccaaagtgctaggattacaagtgtgagccacaatgcctggcctaattttttctttttcttaactattgcatgaacaatggtgataatctgagagaatgtgtctttggggcttaccaacctcagtggaatgaaaccatagcatgaaatagagtggattttagcacagagtgggcggtagggagtgggtcacaccacaccacaccacctgcaagttctgctccagctgtgctgtctccaggattgcatggtgacccatctccatgacctcctgtgctttttgtttttttgctcataggctgcttaataaaactcttttagttttatgaaaattgttgcaagatcttgaaaaagttttattctgaaatttagtatttccctaaaaatagtggatttagtcaacatttttatacttattagcacatgattatacgtagtattcttcacaatttaaaaaaatctccactttaactgtaaattctgaatgtttttcattactaatgaggtacttgcctttgtgttctctttttctctcattctcttaccatctttcctcttatccttggcagaagtttttccagtttatatttaaattatttaattttattgtcaattctgcttaattatggtctactttaatctttgttaattccattattctgctttctgtgggtttatttcacttttaagtttctttgatttaattcttagtttattttttagtttttcttttcttatttttttaaaacaaagcactttgggctatgcattttcctctgtgtgcagttttggccatgatttttcatgagtttcagtaattttttttctgataatcattttttgtaagtactcaatttgcagttctgatttttaagtgactgatttgttaatttgttaaaatttaagagattaccttaaattattcagtttggttagaaaaagtgatttgaacaatttttgccttttgggatgctggaaaaaatttcattaatgtttttcacatcttcttcaaccttcttcatttttttttttttttttgagacagggtctcactctgttgcccaggcttagagtacagtggcatgatcttggctcactgcaaccttcacctcctgggctcaagccatcctcccactgcagccttcccagtagatgacaggcgtgggaccatgcctggccaattgttttactttttggtagagatggggttttgccatgttgcccaaactggtctcgaactcctcagctcaagtgatctgccagtctcaggctttggcttcccaaagtgttgggatcacaggcatgatccattgtacctggccctaccttgtttattttttagtctattttatttgccaaacagcaaggaggatacgttaaaatctctagctataattatttttctgccaatttttctttggaattctaatactttaaaatttatatattttgatgtaatttatttatatttatgattactatgtattattaatataaatgttagctctttttattattataaaattagcttttttacacagttaatgcatttttttacttttaactttatatcgcctactattagttttgtgacctctgcttaattttggtttatgtttttctcataatcccttatacatctttttacatataattttttatttgggtgttttttaaaaacagtttattgaggtgtagtttacataccataaaattcattcattttcagtgtgcacttcagtgatttttcataaattcatggagttatggaacatctgagtgttcttttaaatagcatacatattttcgatctaacatgaatattttattcaattcctttttaatgcgagagcttaacttatttacgtttattattatagcagatatttttgctcatggatctgtcttccattttttattgtttttatttctttcatctgttgtatttttgtataaatatgtttgctttaaatcttttaacatatgttggaatgtatatatcatttttatttttatttctattttttgaggcagagtttcactcttgttgcccaggctcaagtgctgtggtgcgatctcagctcactgcaacctccgtcttccaaattcaagcgattctcctgcctcagcctcccaagtagctgggattacaggcatgcaccaccacgcctggctaatgtttgtatttttagtagagatggggtttctccatgttggtcaggctggtctcgaactcctgacctcacgtgatctgcccacctcaacctcccaaagtgctgggattacaggtgtgagccaccacgcctactgtatatatcttctttaaaaaaattttttttttcattacaaggaattgaaattttattccaggtatatatttatttaatttttttccttctaacttttattttaagttcagagggtgcatgtgcacatttgttacatgggtaaattgcatattgctggggtttggtgtataaattattctgtcatccaggtagtgaacatagcacacataggtagttttttttgcctaccctccaccctcaagtagtcccaatgtctgttgttcccttatttgtgtccatgtgtactcagtgtttagctcccacttataagtgagaacatgcagcatttggttttctgctcctgtgttaattcacttagaataatggcctccagctgtatccacattgttgcaaaagacatgattttgttcttttttcatggctgcatagtattccatagtgtatatgtaccaccttttccttatccagttcaccattttggggcatctaagttgatctgatgtctttgctattgtgaatagtgttgcggtgaacatacatgtccaagtgtctttacagtagaatagaatgtatatcttctttaatattactattaaattgttttcaagaagtttttttagcctatatttctattagtgtcagtcataagtggaagtcctatttctgtttggcacaatagttttataaaattttgccttacatcattcctattcttttcttctgttgccatttcttggtctttttaaataataaatttggctactatatccagactaatataattgtatcaagttttcgtgtatcttctattttgatcattatttttaatatgtaagttttatagtcatatttatgttgattattaggcttacctctattttgattggttttagtgttcctcactagtccccttcatattatgatatctgcattttaagcttttaatttttctttatttttctaatgttggattgcatctttaataatcttgtcaagcagggtatataggtcctatgttttctgacactttgaataccttagagtctttctctgaggtcttccttttcaaaatagtggctataaaactcttaggccatatccttttctaactatttagacattgcccagtatattctagcatttaatgttgagataggaaagtttgggtacacctagattttcatcgattattcctggaacataataagcttcccccacccccccaaaagacataatggacatttaaaatttgcatacatttcttcagctcagaaaaatattactgtattacattttttaatgcttcttctattacattcctttgtctcacccctctgtgttctagggagcatctcaagcttgcattccacacagtggttgcagtttcccccggttgctgcgtgaagaatgaactggaaagtagcttgagacagagtgtagcagaaatgcaactgggagagcagtcaaggtggctcttacaaagacataaaaaggaaatgggcatggctcagaccaggagggtggcagtatagatggaaagcagtgaatgaaattgagatgcatttcagaagtaattttcagtgttgctatgaacatctttcctttatgttgcctctctaggtcttgtagtaagaggcaggggaaactgcataggggctgttagcagaaggtcattttgaactggaagtctgctaacagatgtggccaatttatagggaagaggagtcctaatagctgggcatttgcaaagtgcttaaaaatttattcagtgatgtctcatttgcacctcttatccaaaggtggttgacagtgcagacagagctaagaaaactaaggttctgggcacttcattgacttgcttgaggccaccacttagtggaagaataatgacctcatcttctgtttttcaggggagtggattttccactttcccagtgtattgagagcctttggtgtccgtagggactttggaattattatgtcactgaaggaggtgggggcagggaaaggtggtggatcaactcagcacacaaagctgggtccctttccacacattgaccagcacagctccccttttgcctgtgatattcttttaatttccaaatatgattttttttttttttgagacaaggcctcattcttgtcgcctaggctggagtgcagtggggtgatagctcactgcaacctctgctccgtgggctcaagctatcctcccacctcagcctcctaagtagctgggaccacaggcatgtgccaccaagccctgctaatttttgtatttttttgtagcgatgaagtctcaccatgttgcccaggctggtctcgaactcctgagctcaagcaatttgcctgccttggcctccgaaagtgctgggattacaggagtgagccacccaccgtgcctggccttaaatatgaaatttttgatttaaagaagttctgttgcctttgggcctgatgggtctgtggctttaatacaaacgacacttgaatcctctccactctcttaatctaggttctgaccaagcgcaccaccaaatggaggtggcatgacaaccatgagacacgttgtgcagttcctagttcagctccactgagctggtgtttggaaaagactttctccactcctggcttgcatctggtcttggcctatacactgccttttgcttttttttttttttttttttttttgagacagagtctcacgctgttgcccaggctggagtgcaatggcgcgatcgtggctcattgtaacctctgcctcccagattcaagcaattcttctgcctcagcttcagctggcattacaggcgcctgccaccatgcccagctaattttctgtatttttagcagagacagggtttcacctgtcaggccaaggtaggagaatcacttgaactcgggaggtggaggttgcagtgagcctaaattgcaccactgcactctagcctgagtgacagagtgagactctgtctaaaaacaaaaaacaaacaaaaaaagattcatcatattgatacctgtatccacagttgttcctttttcattgccaagtggtattctgttgaatgactctgccacaatttgcttagctagtctattgctgctcagtgtttgtcatcatgaatgaagtggttgtgaactctcccttttgtttttgctgtcccttacttatttttttgagacagagtctcactcttgttgctcaggctggagtgcagttgtgcgatctcggctcactacaacctctgcctcctgggtacaagcgattctccttcctcagcctcccaagtagctgagattacaggtgcccgccaccatgcgtggctaatttttctatttttagtagagatggagtttcaccatgttggccaggctggtctcaaactcctgacctcaagtgatctgcccgcctcgacctcccaaagtgctgaggttacaggcatgagccactgcacccggcagtcctctattttctgcccccatttccagacccctcccgtctttgttcccagaacaccttcagaatgcatgagtaaaatggaggtgataatttccaactcacaggattgtggtgggaagaaagtgagaccatctataaaagtcttccagttcagttcctggcatacaatgggcctcaataggtggtggttctgattagacagaataggcacaaaggcttctctctgtgaggcttattgtgattggatttctgtgatatattcttgctccttggcttttgccaaatgaacccccacctacgtgccttcatttattcccctaaaatctctccctctccccatgaattaaataaggataaaaatacaaactttcccagtattattggaagagaatgctgaggaaaaatgatggcagaagagtttgcaaaagaaacagcatctcctttttttttatttttttcacactactcgagttttgcaagaaattgcttcgagatccttggatgagaaaactgtattcaaaagccaagagctacagtttgagggatatccttttcccagacccattagctgccattcagctaggacttagcagtttccactggagcataaagaagtttattttaccattttaatttggtgctgctttatttaccctgtttgtgctaacccaaatttggcatccactctgtactccaagtgctaatttaagtgacatatttccgttctgcctgggaagaatacacagaagagctgaaagacgtgtgtttataattataaggtactgagttggctcaaacaacatcgcgtagcatatgggaactatgtgggctagttagcaaaagtttatgctgaagcctgatgccatttggctgagttttgtaaactcagagttgttaagttgtatctaagaagacatgggctgagtcaatttaatatttccaggctggtccattgtggtggtaaggactgccccttttcttggcttgaaaggacagaggacttggattctgtgctggagctagtagattttgttgggataagagagacaggctgttttcttacagcacagttgtagaatctgaacatgagtgcttggccccaagctggctaaatctggcttttaatttttcatcccagattgacattgaggagggttcttggattatactgaacattgctcattttaagctttctgtttaaaacaacattacatatgatcttgtaaagttttgacttaacagacctttcttattattatgtaatataacaatccacatataaatagggtattttaaactcagaggaaggatgtgctggtgtagaaatgtgtctattgattttatgtgtgtgtgtgtgtgtgtgtgtgtgtgtgtgtataacccatagctctgtattatatacatgcagatgtataaggacatttttttatgtaacatgactggctgtgtaaaactggagtttcagtaagatgtctttgtatacctactgcgtgcaggcaaattagatcttgcttcctgatctcaggtttccttttctactgcaaccttcaaggctgggaagaggagatgacaggagagagccactagggactgaatccccaagccaatcctaatgcagctttaggctctagaagttgacccctaggccaagtgaactggtagagaggaaagccattagctctcagtgtaaggcttcctggtgaggctgccttgctgctgctgttgcttctgatgtttactcactggtgagtataggagcaaggccacccatggctctcttatccagaaagccaaatccacttagcttacggaacgggagactcatgtgcccatcttcctgttatttacatggaatacacaatgtctttcaattgcaggcatactggaaagagacagggtcagaaatttaaactacttgtaaatgtgggagagttgtctgcaagccatttgcgttgtcatgtatctgaatcatgctgattcccaagcgcctccggcatatgaggacaaatgtaaaatgtctatagtctctgaaaccccttgtttacatggatatttatttaaagaatcagagcttcctatgccaaataacatactttataaatcatgtcttttttcatctttagaggggattagatgaggtcttgcccttttacaagtttactacgacacagatctttataatccagatttgaatgtattgcaagccaaaaccttgccttaatgtcacatgggagatggtgaaagctgctgtgatgtggcattggcccatcctatgagtttgttatctgtcaacacccagcagagaagggcctcttcctactatttcaccactcattcctgaagagtcacatttaattcatccttttctgtttctaaagcattctcacatgcatttatgcctgtaataaccttctagggaagctatcagactcattttatggaacactgaggcccaaagaggctaaggcatttgtgcaaagccaaatattttgtcagtaagtgacagagcctaggttgcctgactctaagaccagtgttctttcctctacaccgcaactgtcccttgtgtttggatatcacataattaattaaatatgataggatgatacaatgttgctagtttagtttttgtgtattagtcttgttttgcagaacgaacatagttttttggaaagagctgtggatttggagtctaaagaactgagtagaagttcttgcttttccactatttagttatgcgacttggggcaaatcaattctgagccttggttttccttatctgcaaaatggtcctagtagcaaatgtcttgtgaatgctggaggatggtatctgataaagcatttcgtaaaatagaaaatattatgcaaaatgtaaaatgttacccttataattctctcttcaactagattgtagattcctggctggattagatcacattacttttctatttctataacttagcataatgccagctacatggaagttattcaataaatatgagcagatgatttattcattgactgaagctgagatcatatgagcctcctagttcccttgtttctcatccccagtgcataatgtggtaacaccccagagataagttttggcagattaaaatatgctccttaatgcatgtatcaacattcatatttgcgtatatggacttataaaactcatttaaatgtgtgcatgtgtgatcacctagaatatttctgcatgtgcatggggaattctccattagtaggggctcactaatggctgggacatagggactaatggagccttgggaagatcaaagcttgtctgcttgtctctggctcagtgtggctctgtgggcagctctttgatgagcccagggctctcagaactgtgtgaagagccccagggtgggagtatgtgctctaccctctttatttctcttctatctacactccccaacctgctatccagtgagtggccaaatggatccatggacaagaagtgctaggctgggaggaaccagcaatcctgaggaattaggtcttttgaaaaacccctggacaccactaagctgtccttggaatgcacctatgttatgaaaaaattcagtgaattatgagagtctctataaaaaacctagcaaattggtagatctcctcaagacatgacaatgaagatgattatgagttttgtatattactgtagtatatacctgtgtggttgtgtgtctgcagacacacagctactacctggagcccacatgaatgcttgaagcccctgagggcaggggcttctagggagcacaatgaacaccttttggagggcattggaatgggggtgggttcttatgcagtttgtgttcaagaagagtagcacgatacagaagcattcaacctggaagttaggagacctgggttctggtttgattgtattattcttgataaaacttaatctttgtgtgcttcagtttcctcagctgaaaagccaaggcagtaatcctcactcatgattgttgaagggcatggatatgatgccactcatagaagttcttagaaatctgtaaagtgtcgagcacataaaaggtgatacgatggttgtgttttgaaggtgtaaatgacttggagagccagccatagagtgatgaagagaaggactctggagactgcctggggtcagctcccatactgcttaccaactgtgtgaacttgagcaagctactgagcctctctgtgcctcagtttccttatctgcaaaatggcgggaaataatagtaccaaccagtgtttgagcacacagttaaggtctcaatacatgttttattttatttaatataaaaacattcctatatctgtgatgttcatatatgtatcatattatccaagtcatataaaactaatatccaataaatatgactctttgctaagtcagattccaatattgttgctctttctgtccttaccctcacctctgcttctttagccttatcttcctcttctgcttttatgagaaagatgcaaattatcagttttttttttaattccagggtaaaatctagaccagtggctttggggttgtgctcagcagagcctcatgggttacagaaaagtgtcacagagctgatgggggtgagggtgtcatggccaggtggaggcctgggctccccatgttgcctttggcagagcctttgtccacactgggcttctttatatgattttatttaacaagagagttcagttgcttacaaatcttggaacatgctggcttacaatcaactctattcttatccattcagcttttatcttaggaaccgtctccacctatgtctgttacaactgacagagtattgttagtgacattgatgaatcacagagtattgtgccatccccctaaaaagtcagtttttttttaaagttgttgttattggtgtatcatatgaggaaagtagaataatccaattgaaaaagatttacaaaataaaggttgacataaaaatgaactctcaaatgaccagtaaacaagcccactgagtttaaccaagattttcacacagtcaagcatcgaacaaggtgtatatattgagaaactggtgagtttggtgccgtggtggacatgacagaactgcccctgtctttgggagtttataatctagggagggtgacagtttgggggcacttaacagcaattcgaaagtcatgtgattccacattcaacaatgcttctgtaaatactacagcccagtgagagagaagttagagtagactgcattaatagtacaggaaagcttcatgaaggagctgggagttgaatatggtagaatttaagcaggtggagggcattctaggtgggggctattgcgtgaacaaaggcaaggaaagtggacccagcagtcagagacaactgttatctgaaccataagcttcaagaaggcaagaaccatggtgtatacccagcatataatagttgctcaacaaatatgtgttgtacaaataaatgcatatcttaagtctatgtcacatgtaatcattaagctcatgaaaccttcccaacccctcatgtactttttttttttttttttttttttttttttttgagacagagtttcactctgtcacccgggctggtgtgcagtggtgtgatcacaacttactgcggcctcaactttctaggatcaggtgatcctcccacatcagcctccccagtagctgggactacagacgcatgctaccatgcccagctaatttttgtattttttgtagagatggggggtctctctgtgttgtcaaggctggtcttaaactcctgggctcaagcggtcggcctgcctcagcctcccaaagtgttgggattacaggcataagcgaccgtgtctggcctcacttccttgcttaaatagcaagattcccgtaattcctgtccacctcaatttctcctctcctggctggaccatgaataatctttcagtgaatgtcagggatttgagaatgacctttgttatatatctggtccaacactttgttttacagaggaggaaactgaaacccagagaggttaagtgacttaccgaaggccacacagccatttagtggcagcactatagggtttttttctgttcagaaagtatgttctcaagtatgtgcctggcatcgtcattagagcgaggctgactctggaaacctctctacttccccagaccgttggttctgccttgctgtctggaggcctcccacctgggtttactgatggggaaattttatgtggatatcatgtacaaggaaatctgctgtggcactgtatattttatatgtagccactgggtatttcagagaaggcagcagctaaattcccagccaattctaaagggcactcttacacttggtgttggcagagaagtgaggggaggtctagctgcatggagccctggagggctttgagacgttggaggcttgagttatcctggttaatttccagtttggtagggttcttcctggttgcagcccatgccttgctcagttctgttttatcacttttcaaatataaaacaatccccctgtctcccttaagagcagagtttacggtccctaagatcttctggagacagaagaaagataccttttcctttgcttattgtagagccataattttttttttttttttcagaagctgagtttttaaagaagtttctcagtttcaggaggtgggtggataaaaatctttgagaacacccaggaagggtggctgtggatctgagctgtgcagatctcactctgtaaaaatctcaaggcctccactggaagcaaaaaccttgggctgttcccaaaatgtagatatcaaagaatactgggcaaatttcattacctagaagcaggggtttctgaggtgcaatcaggcaaatgggtcttttttttttttgagatggagtcttgctctgtcgcccaggctggagtgcagtggcaccctgtcggctcattgcaacctccgcctcccggtttcaagcaattctcctgtctcagcctcccgagtcgctggaactgcaggcgtgcgccaccaggcctggctaatttttaaatttttggtagagacggggtttctccacattgaccagctgttctcgaactcctgacctcaggtcatccacccacctcggcttcccaaagtgctggggattacaggcgtgagccaccgcgcccagccgcgaatgggtcttatggattttttttcaggctctgtgccttgtaaatgttggaaaacctgggttttgggggtatatttacatatgctcttaattatatagttgatgcaactgtgtgctaatctgacactcacattaagtcagccaatattgtttcagtaaaacagtggttcacagtgctctgtgaaatgcctgagttgttacaatcttcccaaatttgggagacccagctccttctcggtttcgcattccggaaataatttatttggattctagtttacacacaagtacacatggaatcacacaaaggtacacaccttttggtttactctttcctgtctttgacgttggtacccgcagctatgtgctgttaaaggagaaagccccgcacatggcagggtggccaatgttgagggaatgctgctatccactgctaaagaaatgcttagttgtaattttttgggaagcagtcattgaacagttattttggggtatcttttaaatagcgccccactgacgtggaaggataaagttcgcaaagcaaagcttttgatttttaaatcgacattgataccaagcggtgaagtcctttgttatgtcttcagcactcgggtgtcagctgatccatatgcaccggtgggcacacccagcgagttttcataattcataagcagcgaggcccctgatgagcagaggctatacacagctagagcccggggttgtgctgaggaagctggggccggctggggtgaatgctggggattggaactagggagtcctggcttttcctgtcattccagcttcctgggtagtgttaggaacccacaacccagtcccaaattagttcccagtagacagctggggatgagggcaggagagtgaatgacactttctcattggaggcagcgctgagcctggagtcagagaacttctgtttaaggttttcttttaaattataaaacgaaataacaaaacaaaaaagtctggaacatagaagaagaaaaaagtcgctgtaactttcagcccttttgcatcattactttcgcttttgtgtgtccccttccgtctttttcacaggcgcatttttacacgtttgagtccacatgattttgtggtgttattttaactttcacactcaatgatgcacattttccatgctttcatagattcttcatctttcttaaatgggaaatactattccattgggtgggtagatattacataatgtatgcgaccatttctacactatttttgatatatgggagttccgtctttaacttgtaaaaatgctgtgatttgaacgtgctcgtgcatgcggaggggatgcgtttgtgattcctggttccactggaggttagctaagtgatttgtagaaagtcattggaccgctttgaatcttattttttaccagagaattgagattattgtacctattttactgacaaatataagccttatacatagaaatttataaatttaacataatatataaagatatattgatatgtaattacacatttgtatatactatgtttacatatgttacaaaataatagagcacagatttttgcataggtcactcttttgtgtttctgtttaattacatggtgggttctatagtgtgaaaaccaaaataatttaaatcaccctgaactttcccccagcacctctcagaggtggaggggagacaaggtgctgggaaaatcaggcagcactggtgtgttactattcttaaaaggttaggggccacagagtagcttcaatggccttggaaggtggtataaatgcagatcaatgaaatctgcatacagttctccaacctccttttagatagaagtttctttcagtgtcctgcccatggagtcttacattaaaactcttcccctgggaatgatctgagtttcacctttcactccccatgaccacttactttttggtggaggttcaaggggcaaggagtgaggaggagggtgaagggatgagggagcggggccacagctccctggctggggcctgtgctgtggactccagctgacatagtgttcaggctcagtcccacccagccagcattctgggaactgggagaatcagcagttcagtgtgggtgttctaggcagttttctcaccacttcccatttagcaaatgtctgaaggaatagctcacagaattggcagtggagttcagaacattggtgtatgggaaaagaagaacttcaactgtttttgaagcataaatgggaactgaagcccaggtgtctgagagcagagaactaaaaatgcccatcccaatccaaactctaattgggtcaactttatatataatacgaggggctgaaatcacaggaaacctccctccgtgacaaatgcagctaggtaccttttgtaaaacttagtccacgagctatgttagactctaccagatagcctttggtttgcaaaaaattttattctattatccaattgtgaaacccttaatttgcatttaactgtcagattattttgaaaatttacatctagatctttccatttaaggaaaggagaactgggcatctattccatatactgttttgctggatgaataactacacagattttttttttttttttttaagatggagtctcaatctcacccaggctggagtgcagtggtgccatcttagctcactgcaacctctgcctcccaggttcaagtgattctcctgcctcagcctccctagtagctgggattacaggtgcctgctaccactcctggctaatttttgaatttttagtagagacgggattttgccacgttggccaggctggtctcaaactcctgacctcaggtgatccacctcggtttcccaaagtactgataggcgtgagccaccacatcgggccttccacaggtttttacactgggaaatgcaggtgcatgttgtctgactgcattggttcatgcttttccttcccacttccattgccctatccatttcattttggaacccagatactccagttccaaaatgaaatggatagggcaatggaagtttgccttgcaacaattgacaggaatcacagagcatcgacttcgtactcttgatacagtgctaggtgagggaagatgggatgggggcaggaatctggccaaggtctaggccactcctgttgcttagaagttagaagcaaggagatgaaaaaaatgcatgtgtaaagggagtgatgcaaggcagcagagcattgagacctcactgcgtggttggcacaggtggtggcagccaaatcaggggtcatcagggagggtgaagaaggaggcttcgggggcagagcagggaggagcaaggcttagagaggaacaaacgagatgttcttcaagtttcaggcagaagcaaagccattcctggagctgggaaccaaaactgtgtggtagttgaagttctctgttcatggactttctaccactgagctggttacaccttccccaggacaggtcacagttactccaggggtgagggggccaccccccaccacagtgctggggttgcagttttctcatgggttcccaatgacacccctcccccactgctttcctccaaggcatttggcatctttttttttttttttttttttttgtggtggcctcccagtgtcattaggcaagtcaaaggtcatcggtctagaaattgacacacttgacccatttcctttctgcactggacctggagtctggagcagctccccctgggaccatgtgaagggcttgaagctgagtcttcagtgctttcttcccatgaggtgtataattcgatatttattgcctctctccccagcaaggtctatggtgccactgggatccattcggtaaagaatgctgatcccccttatgaatttttgatggtggaggaggagcattggaggccactgggggaccttgtgaaatggaaatgttttttctttttgatctttcttttttcttttctttccttccttcctttacagcacgcttaccattgttgcaatgtctggacttctctgaatgtcagtgtgtactctctttaaaagaaggaagaatcatagttctttaaagcagcagcctcaacagctccttacacgtttaactgtgtttacaacagtggaaacgtgttgtatctcttcaggaagagagatattcaggtcaagaaacaaaaattcaaaataaaacagagcaacaaataaggttcactctggaatgggagagggtaaaggatgcccctcccacccccgcttttccgttttttggtggtctgagggggtagcacccaagggaatgagagagtcaggatctgtatttcattgctgagaatttgacagctacagtgcaaagcaatacagtcctgctttttattagcctgtgtgagtccagcacagaatgaagctttttttttccttttcatttttcagaggtagaagtttttgccaaactatgagatgatttaaccacaatttccttcctgaattttttttgctaaaagggggaggggatggttgggtgggtgttattgtttaataagatttaaacagggtctctattttgtggccggaacagcctttcatgccctttatctgtactgggatttcagctgggtttttattttggtgacatatggcccatcgtataataaaaagagacgaaccattcagatttaatttgagtggctaaggacgtcagaagggctgcaaggggaggctgtacctgagctttcatttgtttaaaaaaaaaattgtacagagaagttgagaaggtgacttttggaattagtttggtttggaggcattaagtcccagatcaagagagaaggtcaatttgtaagtttgggagatatgccagccctgctctctcttttattggagaattgcctgtggggcctttcagagtatctgcccttcaggggtcctgtgttccacctgcttcccccttaaacagggaaatgggcttttaaaaatattacgcagcacgccacagccatctcctgatccgaatgccgtgtggcatgacacaatgtgactcgagggccgggggcagggcgagggtttgcagctgccacatggtgctcgtcccgtgcagggaccgtttcttagcccagcgtgcagttcccttggaggacacggcccacctggcctccacatacccctggcagcctgcccaaatcattttctctcctttcaccctcaaacactgtcgtggaagaaatgctttttgcatctgcgggacacacagcaacttgggatggttttgtgggctttgggtgtgacagtgacagagccagcagagagattcgtgcagccacacaggaatctcaccatcattttctatgtggatccttcacaagggtgtgtgttcagatgagctacggtattcggagaaccctccgtgtcacaagattaagggtgctgcgtggtttgagcagcccgttttccagcctgaagccactgcaagctgcagagtgaaccaacccgcaccactccgccccccgcccagcgtcagaccctttatttaccttccatgtcataatgcacgtctttggcatcgtcttttacaagctttcattaccgcatggattgtgtccactgtgcaccgaagggcccctttgtgttgcttctgattaactgcaatgacagcatttgatactactccatgtgccggaggaaggcgccttggttatgtttccttgggcaaagcacatgccatggcggggttgagtgttgtgggggtcccatttcctaggtgtgctcaggttctgaacctgcagccagagggcgaagcgcacctttccgctttcattcatgtggggctcaggagggctgcaccttgttttctttagctcccagaaacagcttggtttggaccattgctgcgatgcccctcatcgccatcatgggataaccaggatgaccatctcggtcgctctcccagccagctgccaatagcattcctgatttatttgcagcaacttggagatccgcagctaacagccatcttgatgggaaacagcactataattgcttggggagaaaggcaggcatttagcagtcgtaaaagaaaatctgcccaccaccaaaccaaatgccgctgctctccttccatgtggcgcggccacgttacccccaacccgaggcccctcaaggtgggcctggggcttccctggctttttaatcctctccattttgaatctggggtttgcgtgattctttcttcttccttttggggtagacggagcacatggggagggggctgcagtattcaatgcatagtttctggggcttccagtgtgacgagggttcggtgacaggagctactgatggcctctggggctgtccagcagcctgtgaccacagttgatcagctgggggtttgtggtgctatctccctcttcaaagtgacaacgggatagggtcaagaaaaaaaaattgcagtaaagctcaagtcaaaccaaaagtcaggctagaggggaaaataatgaaataataatgatccctaacttatcccccttctgtgggcatcacagacgttgctttcttccctcaggtactcatgttatcttagtctctgtctgcagtccccaactcaccttatatttctgtagccaggaaaatgtgtctttgacacgtgtcatagaagaaactgtcagccaatagcatttgtacatgtgcacttcgggcaaggaagtcaaagctgacttggaatgaaccctgttcatgctaggggtgagatcagagaggaccaccacttccttgtccgggaacaaaggcataactagcttgtttgaagaaggtgctttcttcatgctcctgacttcctttctttctcttcttcttcctcttcttgctcttctacttaccttcttctatcgtggtcagaacatagctgggggcgagagagaagattgagggttttgtggcttggaaaatcaattatcactcctcatgcctttatcaagcacccctctgcatgtggggtgctgtgtagaaaatgtgcaaaatcacaggccctaccccctttaactgggggaaggaagctcgtgtttgatagaggaattgggttcagctgggctcaagtgtctactgctctgtccaggattaaatgagataaactgtggggaagtacctgacccgctgggagcatgcgatgtgcacgtattaaggggacagctctgaaaccccgccctgcccttcactgtaccccgagccacttctcccttgcacagagctgcctgatagtcagagatccgtgccagggaatgagggcaggctctgggtttggaaatgcctctgctgtattccctaatcagatctcagtcagataacagctcagacctgggaacatgagattttaatgtgaaatgaataagtaccctgagactgaagcttgtcactgctgcacatctggaatcacttacagctgggtaaattcactgggagctgcaactcaagagaacatggagtttaaaaggaggtgcacagagcgttccttttaatgtctaaacagtctgatgttgacaagcctttcacattaaccccaaagtggcaaagtttaaaccctttattatccgattctgtttggcaaatcatttagaggcttaagagtccatgtttaccgggaaaaggccaatctttatttttgtcttcttccaacacaagcaaccctaatgtatacacatttatgtttacttagaaggtttaaaagaccttcagcattaagtgagaatcaggctagagaaagaagatttttgttttgttttgtttttaagaaagcccctcatctctttagaatacaaaaggcatgagcattgcaaactctggaaactatatcagattaacaaataagtaaagaagaaatacaggaaatcatttccaaatattattagtcctcagtcgaaatatactgtgtcttggcagctcagcccaactctgtgtcattttcctaaggatttgcccagaatgttatgagtgactctaaagacggtgaatggtagtttgggttctataggggactacaaaatattatggaagttagaaagcttaatagtcgagcagtgcttaataaccatctattggacctgtttccaaattggcaaaattttacggatctccattacagcatgtgaaagaacatggaaaaagactgcaagtggtttcaagaccttgattcaataataatttaataatttcaaccacatctatgaaaagcgatgaagacattttaattcatcttcataaaaagcatgatgcaagagagttgaatttttaattttcattggaggagggttttcatagtaattgaatttattattattttattttaaagaagaccccaaactaagaacatgagtaaatctgactctacagaagggatctctgtggacgtttctggctttggtttgaatcctatcgaagaagttcataaagattaagattgcagcatagtttggaccacagctgttcatcctttagatgtaatttttaacttttctttggcagctgctcaaattcaaatctgaaatcaccagttatcagctttgctgaaacagaattttcagattctgggataattttctgcctattaaccctccccagtaatcgtgtgcactgtgtcaatttttacctctcaggatactgtagagttactgtagaaatgaaaataaaactttttaaaatgttgcttgggaacataaatactcatttaacataatcctgcaggtttgggttaggcaagcaaaagatgaaagactcttagaatcttgtttatacaaaaatatttcctatagcacagtttttaaaactgaaaatgaaatcaggctctgtacatttcaaatatttcatttaataaagccagcgtatatgatcagcatattaataacctgcaaagcatattattcaacttataaaggcttagctgtctacttaatcctgtcgcactatttaaccgggaaaaatgtacatctgaattttatcctgaagaagtgataagaaaggaatctgatattgctttcagtgtctgtctacattacattatgtgcctgtggtgtgttttactgagacagttgattctgtaccaactaaacttcatcgagaatgaaacctccaaggccttttcagttttgcatgatgttaaactgctgtaaaatttgaaacatgtatcgtttctttcattttcccctgtagtccctgctcacccgggctgagcagaggatgtgattttcagcgcagtagttcctgggttaacaggcgcttctgaggccaggatgtgaagtttcattttattttttctgacttgggtgtatggtgttttaggagtgggatttcgagccgaggttgcaactgctttaactttgtggtctctgattaatctctttgctttgtttctctggtagaaacaccaccaccactgaaggtaatgcttatttgagaaattgatgtcagcttagtaacaagaggggcggggcagccggtagcttgattgttctggatgagctatcagggatctgctgggaatactggtgcttcgaccctgatggccctcaaagtgctgagtgtggaaaatgggaagtctccccggatctcaaaatgcacaggatgtcagaaaaatgcagttcttggaaaactgtatttttttggctacagtaggatgggggggcagggggagtttggcaggaaggaaagcagggactcataattattttgccgtccaagttccagtgtctttattgttactatatttgtatattgtcagaaatagtttttaaaatactaactaaaatatattttaaatcacttaattgaagagcaaaattctaactcagttttttgtttagtccacaccacattaaaagttcaaactaagattttatcaagttttctggctctaggcactaattgatagctaaatcagcttttcccaatcaggtaaaaggatagaagttttcactttgataactgggatacttctccagcaattgtttcagctatagtcagcacaaggagatacagtgtacttggatcaaatctttcatttactcttactttctggagatggtcaggccagcaggatgaactcactcgttgctcaaatcagcagtgggatgacaggaagtcagtgggagatgctggcaagagcaccaggtgaggagtcttgggtcctggagcctggtctggttttgcccactccatctgtgacctgtgccacttccccttggtgcttagtgagctcatccgtaaaatcagagtcagacaacatgatctcacctgcctcttcctactctaaaatttgcgtgtttggtaagaactgtaaaatcttttgcattgtttccatttggaattctcatagagatgtggtgctcagacctcacattttctggaaatgagcagaaagccctataggttttctaatagaaatgaaaagcttaggctgggtgtggtggctcacacctgtaatcccagcacttcgggaggctgaggtgggtgaattgcttgctcccaggagtttgtgagatcagcctgggcaacatagtgagaccctgtctttataaataatacaaaaattagccctttgtggtggtgcatacctgttgtcccagctactagggaggctgaggtgggaagatcgtttgagcccaggaggtggaggctgcagtgggccatgatcctgtcactgcattccacttgggcaacagagtgtgaccctgtctcaaaaaactaaaaagaaaaacaaaagaaaaacagactagcttcaagggggaaaaacaatctaacaaagcagacagatttgaggatggaaatgtgatttgagagttgtttgttttcttttaagttaacttttattaaaatgtagtttgcatttttaaaaagttaagtttgcttcatcgctggttttgcacacctttggaaatatcacctcctcctaaattttcaaagggaagtcaaaaatattgcttaactgtgcattcaagccagtccagtgtggtaggaaacagaagatctgccctgtaaatatgatccagattagaacaggatcaaaggcactgaaatggcttcagtaatattctgtttaggggaatgaggctgggcaggggaaagaaaggtatctagctaaaaggatggaatcagagtttaaaaatccctcaatacatatcttaatgttagctttttatttttatttttttaagtctgcccaagttcatatttacctgagagaccagttggcacctaaggacagcctggttctctcaggtaaataaaaaacactttgcaggtcacctaattgtgttccataccctggaaactgcaggcctcctgggtaaatactgtgctttggaaactcaatgaaaaaggaatacaaaaatgtgcagtccagctagagcccagggtagaacctgcagaggaaaccaaagctcccgctcttggagtgggacaagggtgggtgggagttggggagagagggacttattttgaaatgtaaggcaagttcaaatgtgctttatgaaaaaggtgattttcaaaaaaaaaaaaaaaaagccaaactgcattgtattgcatattgtacctgctagttttcatatgaaatatcgtctcccctagtctttgaaatacggcttatattgcctgtgattttacacatcgtggcccactcggccaccatcgccctcatgtatactttgagcttggggcacagtgcccgggaacattgggcgtgggtcccggcttcctcatcttcctgtgtgaccctcagcaaatcacttttcctctctggactcccttttgttggtctgtaaaatgaggcaggggtttccatagtctcttaaatcctttttttgctctgacagtctatgaaataatccaaggattttgtgtcaggcttaaaagctgttatgtgcccattagaagtaatcctacgctgcccatccagattctaaactttgcttccactgatgacaggggagggtcatttgatcctcccaagccacaccccatccccctccaaaatataccaccccaaagccacccccaaaggaaggtgctgtttgctgaaggaagtctgaggcagctcttcccatctcagacccaaggtgagggatggtgcctccctcaatccctagtcatgggtggaccaagattgtaattgttggctccctcggggtctacgaaggaggggaccttgtgatccgtgattgctgttgtcagggagagcctgtctgacgtgaggcctggaaagccccgctccaggtcagcatgctcctctctgttgatttctgcaccctagctctcttccctttgcattccggggaacagccacgtagtccccactctctgtccaggatgcttgtctcttgtcagctggagccagctctgccacccccttgcagagcactaaccttttgatttaactttatttgccgcagcaggactaccaccgaaaggggaacaatgcgccctggccatctggccctggccgcctgaggcgcccagccttgcagcccagggttcttggaggggccgctcgagctgtagagcagactcccaccagcctccctagacgggtgccctatttttgtttttttgcaaatcaaccttttaaaatccagatgcaggctatagccagtgactcagaaaaccataaataatacagcaggcttagctcgaggaaaaaaaaacacaaaaaggtgtatctatcattatacttagccagtaacaagccaaagataaagttttgtgtttttttttcttccctgtgacccttaagcaagtgtgacaagcattaacctatcaatattagtgagtgatttaaaataccaaccaacatttgcctgcaataatttctgttgtaaacgactccttctgggccctcctaccaataatttagcgctcataaatcagaacccagagcgcggtgcttggctcttgccctgggcaattcttgaggtctttttttcgggggcggggtctggaatccagtcacactgtagtgtttccctcttgttcccgctgccaccttcatacggggcattaaagagaacacggatctgcaaaatgagactgaactctgttgcccacgatgtctctgaactttattttggtgacaggaggtattggcttattttttcatcactctttctggacacgctgccaaggagttaagctggcttttggtgggaggaattccatctagatttttccacattagccaggtgtgttggaaggtccactccaagaagggaatttttgttgaggtgaaactgctaagagtggtggttgctgggtgcagtggctcatgcctgtaatcccagcactttgggaggctgaggcaggaggatctcttgagcccaggagttcaaggctagcctgggcaacatagttagacccttctctacagaaaacataaaaaatattagccaggcatggtggcatgtgcctgtagtctcagttactcaggaggctgaagtgggagggttgcttgagcccaggagtttaaagctgcagtgagctgtgatcgcgccactgcactccagcctgggtgacagagcaaaatcctgtctctaaataaataaatgaaataaataaataaagtggaggttgcagataccagaacataaagggagaagaacagcagcagtgagtgacccagcatgaggggagcaggcacagggaagtaaggggtgatagaaagttatggacaagcaataatgcaagcaccaacctggccagaaccagcaggcctcatttctgcaggctgcatccttctgacccacattctggcccgcagaggcagcttgggtacagtcatgcaaccgaataacatacccacttcaaggaaggtaatttctttagagttaagagatttattaggggagcctgaagagtggggagggggtgttggggagggactgagacccatctggtttgttgtgggtctttttttattagaagaggaaaaaaaattgctctgtgggttcatatgtctaaggagagctcaattaaagttatttgctggagcttaaaatatgcccgcacctgcttcagcgccaggctccgagaccgacacatgctcccagaaggtggagcagatgaaggctcctgtcgaagcgaatggaagagcaggggacagactttcacttacgctttggtaccagcctaggatggggatgtcagcaagcaatctggagcagcatcctggttcatctggaaaccagagcctgtggtcagccctgcctggctgcagccctctgcaactgcctctctgggtcagaaggatgcttctctttctaagcagactagaaagaatagatccagcagagggaacgacatagagagactgcattaccctaaccaagtcacttgcttctctgggtggccctttcctcttgataatatgaaggtcataaaatctgttccaaaactctgtggtgaggatagtaaataatattggctaacatttgccatgcatcaggcactgtgctaagcctgccttacacatcgcccctttgacttttcaccacaaccccaagaaacagatattgctgtcaggcacggtggcatgtgcctgtagtctcagttactcaggaggctgaagtgggagggttgcttgagcccaggagttcaaagctgcagtgagctgtgatcgcgccactgccctccagcctgggtgataaggaaactggtgcctggatccatctgtccccaaacctgagccttgaacaaccctgcctcaaaggagactcatgagtgagaaggaaattccaaataatacaacgataaatttactatgccctaagatgggctctagtgaagtaaacacgctctcattgaacacactctttgccctgttaccatctcagtttagaaagtgtcctcccgggataggtgctccatggatgtgggtactgcacttcctgtctcccaggagggagtccagacctggaggaactcagaagcgtcagcaggcctttactcctgttctcaaaagcacaggagaaacctggagacaagagtctcgattatcttctattttctgaaacaggtgattgatctcagcttccctttctagctctcagggcttgatgaattctttattcctgattcctaggctttgcgcaagaaatggagccagttttagacaccaaggaaggaattcatgaatgggacagagaggaatttgttaactctcattgatggagtttgtcattacacagaactgaacctaaatcttcttagacaattcctccttcggggtttcactttgagatgtcttaagaaaaggtgtctccaatatgggggagagaatccagagatcaattaccattaatctccatttgaaggggactttctgattgtgtgattcactgagattcttttttttttcaatcaaaatttttttttaccattttaagttttttaaaaaaattatttgtggtaaaatacacttaccaccttaaccatctttaagtgtgcagttcagtagtgctaagtacattattgtgcagccatcaccatcatccagcctcagaactttcatcttagaaaactgacactctgcggggcacggtggctcgtgcctgtcatcccaacacttggggaggcctaggcgggcatatcacttgaggtcaggacttcaagaccagcctggccaacacagtgaaaccccgtctctactaaaaatacaaaaattaggtgtggtggtgtatgcctgtaatcccagctgctgggaggctgaggcaagaaaatcacttgaacccaggggggtggaggttgcagtgagctgagatcatgccacagcactccatcctgggcaacaaagtgagaatccatctgaagcaaacaaacaatctgtacccattaaacaacaactcccattttcccctccccccagctactggcaaccaccattctgctttctgtgtctatgaatttgactgctctatgaacctcatgtgagtgggattatacaatattcgttcataactggtttatttcactcagcataatgtcctcaaggcttatccatgttgtagcgtatgtcagaatttccttcatttttaaggctgaatactattccagtatatggttataccatatttttctatcctttcatctgttgatggacacttcaggttgcttctaccatttggcaatggtgaatcgcactgctttgaacattgtacaaattactcttcaaaccctgcttccagttcttctggggagatagatatccacaaatggaattgctcgatcatgattcaccgagattaagtagctgtgaagtgtcctgtccttcattaaatagcccacctatgtgcagaaaaaaatactgactacagcctatactttggggacatttaaaaagtttttctgctgattctttcaggtaagctgcatactgtaagtgcatattgtatgcatctacaaactcttgagtacatattgtgtgtatatattctgtaagtatacatactatagtaagtgctttacctggctactggaaacctcatttaatcttctcaatgacactcctatttggcaggttctattcttacccttgttttacgtgtgagtgtcctgaggctgagagattaagaaatttgccccagttttaagtggaggaacataaactcaaacctaggcatcacaactccagagctgcagtctgaattgctactctttgctgcattcatggagacagagtaaggaaactagtccttcaatgcatcctcacccttgcccccaacacacatagatttatgatcttttgatttgacaatggtgtgaaagtgatatgcattcaatagaaactatacaagttcccatacaactttgctgtttttcactttcagtacagtattcaataaatgacatgagcttttcaacactttattataacataggctttgtgttagatgatttagcccaactataggctaatgtaagtgttctgtacacattcaaggtagtttagagtaataagctatgatgctcactaggttggatgtattaaatgcatttttgatttgtgatattttcaatttatattgaatttattgggatataaccccattgtatgttgaggagcatctgtacatggatccaattctctacccaaaaaagagctccgtttttctttgtatcttctaaaacttagctacagattttcaagctcttgccttagcctctgttcttagcaatggtttaataaacacatttcatcttttcctttcctgcctctcccgatgttagttcccctgtagcaacatgctgtgtgcaccattagttggagttttgatttcccaaatacatagacccatctgcatttcattccatcatctctgatgatgaatttattcattagcttccttctctccgtttattgtagcagcatccatggcagcttttccagggttacttctatgcattgttgacattggctctaggatttatatatgttcagggatggtgtctgggcaggccctctagtgacagtctatagaaaagaatctctggccaaccatgtggcaggaagggcaccacagcttgttgtggctgtagctttgttaccttagtctggagaatttctccttgccttctcatacaccccagcatgctggctatctggatttggagagaaaggtatgcaggctgcctggctttactggctctcttatcacccagatggcaagaaggtttgcaacagaaggcaggaagatcaggctcagtcttttctgaggaactcaaagaggagatgggccaaggcattgtctcattaggattttgagaaagaactcgggcttgttcataaagacagttcagaaacctctgtcctatactttatgtaatagaataaagcccctttggagttaacagcaaatctctcagattgcatttaccttcttgcatctacagttccgtttctttctgcctaagtagatatgctattgctgtttgcaagggtgtggatgagggtagagtccggaaagtgatttcctctgagtcccaggagcttctaggaacaggcttgggatggtgtgggaaaagaagggaagaaaagcagtgccctgcaatacattgcaactgcacccctccttccttcaggagcagggttgagcgacttatgccaaatacacctgttcttaaattgccaggtgaatgaatcaaaatctccaaaagcctaggcagcctcatccctgacttggaaaaccatggatcatctctaagcctttagatgctttgtctctaaagcctcaggccttgagcaaaagccctcttgccctttgagaaggagccagcctggcctgcagttgggtcaaatgcatacctctggctggatggctgaacgttacctgtccttttttttcttcaacttctcccaccttgcactgttgcaacctatgccccaaatgatcagttgggtgagagattccttgttcatagagtgcaggggccaactgcagtcaggataaccgagggcaggacgcactttgctgatgccctggcagaggaaattgcagctttgctgccctcggccaggtacacattgttggggttcactctgctctacttaatctgctgtttactgttctagtaaatgccctccccatctttcactgtgggagagctgtggtgactgcctcaagaggtgactctagggccctacagtgagttcatgggtgaggcatgtctccttcagcaagggaccctaatgtcttctggtggccttcatagcagttgtccacccttttgtctttagttggaatggcagggatcagactacccacagtcagtctgagttggtaccatctctgctgtctgtcatctcctgctgaaagttgacagataggatttctccctgagtgcatgcttacgtttgctacattcacttttcacttcatatattatttttggcaactgagaaaatatagaggactctcaatctccaaagtcgttagcatttccatgcacagtggatttagactcagccttgcccttgttggtgagctagatgagatcaaaagcaccccaaatctgcatataagcaaagcagtctaaccaagatctgtgagtgagcgcttttaatgttgcttaacaaaatatgttacacaaaatcgttatagactgaataggtactttgagttccaacaaagtaaagcaaagtaaacattgctcttttgggaaataaagttctatgtggttaggggcagggctgtgattaattcagtggcaatgaaaagtccatgaaaatatagtaaggttactgactctgcttgagaaacaatttaatatctgctatgtattaaatatatatgtgtatatatatgttttaataccaaataatgggtggtgggagaagaactgatatttctcatctttaattataaattaatgtgctgatgctctagatatcatagctccatcaattattgatattgacctcactacagaaatcagtaaggaaaacagagtgatgaaaggcagcattgaagagatgaggactaagcttctatgacagtccctctgtgtgtgcatgcatgcgcctgtgtgcaaacatccgcatgtgtaggtacatatagataactcagtttacctttacaacaattatctactgaactggagatttctcagagctcttggactgtagccttgtccaaagtgcatgccttcataatgtgcattttaatgttaaatgatttttaatattctacatatggtttcatggttttaactctcctctctgggaatgaacagggctgtggtattatgatgaatagtggaccgtgtccaggacacccacttacttccctacatatcaaacatgtggcgctcccattaaacatggaactgtctctagagattacagttgtcctatctaatccagtcctgttttgttccctcgacccagattgagaaggatacattgttctcatacattctttttttaattaaatgtggtggatatgtcacgtccatgaaatattccaggtctgttttcacatctgtggtcattttctcctcctctccttccatttggctttttggaaagaaaaccaatcctaaacgtatacttggattaattgattggttgtgtgcaatttgccaggacagtttagatatgatcttaattttttgtttctaatcccaacagaatgttctctgttgctgctctttgcagacactcaccgaagctctcgtcattcctatccaatgattgtttgagtatgatattcttattcaaattggttcatccaaattcacttctccctccccttgtactggggtgtgcaagagaacctttaggtgcggggtatgcctgtgtgtgttttaagttttaattgctaggatcatttgctaattgatcctattgatacaaagtactgttaggagccttctatatagacagtgcttcatcagcagcaaggaaacctgatatcccataaaattctccattcaattataattttaaaatactggagtaaactcctagcaattcacaagaggctaaactagagccccattagaagggtactacaagtaaacattattaattataaaaaattgcctaaattagatttttttcacacctgcttcttgcttaattagctagcaatccacatattccattcaattgaactcttactatttattcaagcatacttgacattaacatactgtttgatgtttgatatcctcagttttaatttaaccacatgacaacaaatggtgtttatgaagtaccagtgagctggaaaaatatcctgcattgtagtcgcacatgggagtgaatagagaatttttcttttggaagggcttgatggcagtaggaaaatgagaccctcattttgtttaatttttgaatgttttcattcctgttctctatcacaccccgtaagagggctttggaaggtcctacaaggacagcaccggggctttgttgcaaaaatatccttgagagcattaatgatggaaagaagtattgtgcacctgctggcactcgggaagaattttacagaactgcctttatgttaaaaatgccatggccattctttagggattaaagaagagggcaggtacatgaagatcttgcagctaaatggggctgtctggtatcagggaggagaaaaatgagatgcagaggccaaaggctagaagttggccattatcaatgagtcattttccctgtgccttggctaagccaaggtgaccaggtaattcctggggtggacctggcactaaggacctcttcactgtgttgcttccatatctgagagtccaaactgatgcccttgaaagggatatcaacaacaggaacgggatacacaagttcaacataaacctgacaacaaaggccttggacttgttatttggagactcccatgtctaattggatttattccttaaacttttcccctgcccctccagaagagcacatgagggagttagtggttgtgattcctgtcagccactttgtaatgcgaggaccttgcaatctggtgatgaaactcaacttggaaaattccctgggccaagagacaaaagagaaaattgtctccataatgtattgattctgactaatgacataacttgttgtaggggatttggattgatagccactggcttgtctccagtaagacaccatgtcacatctgactctgatcaaactgtctgtaaatcatttttaacttgggtcctgtagattttgtgttcacaccacaactatggcttgggtttgacatcattattcttcgcttggactgtctttgtttaagagccacttaaaatttttggctgctggtgaatagagaagcctgttagctgaggaaaacatgttgatgtcacacacttgcaggattttttttttttttaattttggtcaggctgtgtggatccaagaaagtgtgtggtgttacccgtaatagggggatggctttaggttcagaggctagattcagatatgtctggataatagttggaagttggaagccatctcttgggaccccgcatatttacatcagggctgatacttcttgcttctggaggggcttgttattctgggatgaacttgttttccaagacagccctctttgcaactggggtccacacaaaaccaggtgtgtcagagaaccacaactaccaacaccctgcactcatattgcttacaatcctcaaggaaatgggtcttggacaggatatggaatcaagatttagaccccctttttgcttttttgttttactcttcatgcacaggaacacatgaactcaaaatacatgtttgaatggagaagaaaacaagtaagacgtgtacgtggcattcagaatgcacgttcctccctggccccctccttgttatttgtgtttaaattaggctactctaataaatatgtattccttatgcccaggtcagttgggcaaagggtagaaggacatgctacaactgtggaaaatatggtttggcttacacattttttaaggacagtttggagaagctgtaatctccagaaagataattttattaacaatgagcttttaacttgataagaataatgggcaaatgaattttccacctgaaggggaatagatacctctatttggttcattttctactgtaggtgcccctggcgcttgagccccttccaaaacatatttcatttctgttaaagaaaaattcacagtttaggaaaaccagcattatgaggagtcatctccaagttggtgattatttgatttttttcttaacacctcacattagggctgggcgcggtagttcatacctgtaatcccagcactttgggaggccgaggtgggtggatcataaggtcaagagttcaagaccagcctggccaagatggtgaaacgctatccctactaaaaatacaaaaattagcagggcgtggtggcgggtgcctgtagtcccacctactcaggagagtgaggcaggtaattgcttgaacttgggaggcagaggttgcagtgagccaagatcgcgccactgcactccagtctgggcgacagagtgagactccgtctcaaaacaaaaaacaaaaaacctcatatttgaagtgagtgagattggttgaaatatcccataaatagcaaattgtaaaatttattttaattataccagggaaatggaattcctatcttttacatttaaattttaagccttctgttatagaaaattttaagacacataaaagtagaaagaataatataaatgatatgtactatatcattctagcttgtttcacacactgtctttttggtttttacttgttactttctgcgatttttctttttcacgcatatgtgcaatgcaatatagggtacaatacacagctcttccccaccatgtgccatacatataatgaaagcagagccttggggtgtgtttttatattgatcaatataggtacttatgaatacacacatacttaacacttttatgcacatatggataaacacatttttatatttacgtgtgtgcatttatatcagtagcattattctcacccacaggtttaacagtctaacacaggggaattgaaagagataaggaagatacctttaagtggacttcattaattacatattataatctggttttctaaagaatttagcagtgatttgtcgctgtgagaaataattctgaccaccccaacagctccatctcttgaggctttttgacgatgctctagagacgaaacagcatcaaagaccaaaggctcttgaatatgcacaacagttttggtgggccatttcatctttcattaattcatctagtgtgagacgcatctacatgtgcccccagcaaagcaggaaatgtatagtaactggaacattttcactggggcccatattgattgttgatgtaaccaatggcgcctctacaattttaatccctcattcaatatcccgaggagatctgatagatatttattctggctatttgttcatgtgtacataaaggttgttttccaaggcagtggttttgctctgcctcccatggttgggatgatgggcagtactacgtgttttacaagcttgcttttaggggctctgtgctgagctctgtgaagagagccaccgctggccctgagggcataattggttcttcgataggaatcccatttctttagaaatagactgcccatctgacaatagactttccttcactcaggaactcaagtaaggccatgatgttgaggactctttcatctttgagcaagggtggagtctgcctatcctgactcagagatccctaaaactggagtaacaaagagtgggtgttcattttctctgggtggccagtgaagttctccctgctcctcccttccttagatacatgaagatcactgctttagggaaatagacacactcaaagttcacccgaccagaacccaggaaaggtgaataggctgggaattgggttatttgtgtttattctggtctaggtttacccttggatatgcccctgagctgttggtgtctcatccatagaatgggaccatactacctagtcctttaagtatttgggatgattttcttttcttgctgttgggtgccatttgcttctcagacctccacattcctgactgtaagcccttccattttggatgccatgttttgcatgagactctggagttgtaattctaggcaatgaaacccagagggaaagggtaaggaacagaacttgggggtagacacatcaggacctggggcaaagatgtttgcggcaaaatggctacagtgctgacacagctggctgctgagctatggatttaggaaaaagaaaacccaaatcaaaacctcccccaaacaacaaatgagaatcagtcccactatgggaagaaaaatggccgttacatttttacaccacaattcatttgcttataaaaagatatcttaggccaggccttgtggctcatgcctgtaatcccagcactttgggaggctgaggcaggtggatcacctgaggtcaggagttcaagaccagcctgacgaacttggtgaaatcctatctctacaaaaaatacaaaaattagccaggcatggtggtgggcgcctgtaatcccagctactcaggaggctgaggcaggagaatcacttgaaactgggaggcagaagttgcagtgagctgagatcacgccactgcactccagcctgggtgacagagagacagtctatctcaaaaaaactttaagcaagcattgtctctccttagaagccagaaaaacaaccttatgtttgctcctggctttgtagaacaacccaacatattgaagaaattcctgagcaccagaaaaatggaatggccattcctccactttacgaaaagtccagcctcagctcatcctcccctcggggtctgcatcattgtcctttggctcagcctaaccttatgaggttcccaaagccctcgtcctgacagcagccgttcagctttgtctgaggctgatggtggcacttagagctgggtaaacaaagcttccagacttgattttatttttcctgtcaaaaagaaatggaaagaggctacttcagattctaccaaagtcataataaaactagacctactgggtcaccatatgtggggaaaagttctcctgggccttagtgtaaacactcagggagggaaataaagaaagggaaagccgccgttctactggcaactgtcgttaggtagtataaacaatggcccgtcactggcatggagtggaggctcagattccaatagcactcaacagggaaccttccttaaaaaattagaagaagctgggctggagttggtccatgctgggaatggcagaagaagcaaaaacaagagtaaatgaatggaaattaagcagcaggaaatggggatttggcacaaagctggaatttgaaactgcagagaggtgtcagtgataaggttgtataaagtttctggccaaaaaaagagagagaaggaatgcagatgtgttcattgaataaagtgcagatggagaaaggggcaggaagaaaaaaaaaaatgccggggaaatcataatgagtggaggtgcatttatgtttagcaaaactttaaaaattattctccctgcatgtctggatgaaattacaggttggttcagattgttccaatctattggagagattaagaccacgtttatttacttttaccttttcctgctctgagcagactgggctgtttgtgttgggaggctctgggcaggcagaatccaggtatgagtctctgtttggaatctgctcaggaactgcagccatcagttcctctttagatagaaataaccgggatgcctctggagagtttaaatctttgtgcgggtttgttatctgtctgggaggctcatgagaagacatgcagcaaagagatctgaccccttgcacacatgagccctctcccttggctgtgcaaggaagcttgccttttgcgttctgcctgccttcctcactcccatctggcagggctcagttacactgctcactggctaaagatggtctgtgcatcacagggcaatcctatgtttaaacaccatcttatttggtaactaacaggctgaaattggcctctccagttgtaccttggtcatgcaatcatggttcaccacgatcttgaactcctgggctcaagtgatcctttcatctcaacctcccaagtagctgggactacaggtgcgtgccaccacacccggctaatttttatttttatttttgtagagatagggtcttgctatgttgcctaggctggtcttgaactcctgggttcaagcaatcctctcaccttgggctcccagcttgctgggattacaggcatgagccactgcacctggctggtcccctctatttcttgtccagccttggatgtagttaaataactcaagggacccattccaaacactgttgctccacaggcagtggggatgggaggcagtgggaagtggtgaagaggtggcctgcgggggaggggaaaaggtctgtaaccctgaactagcagatgggatgctggcccaagtcactttaccatccttagatgtcaatttgtcattttcccaataagactaacacctacccagtgtattttagagcctttgtttgtttgctgaaactcttgtgaagacatgtgtatgaaagtactttgcagaataccctgtattatcatatgcaaagcatcatgatcttcattatctgtgggaaagaaagatttgctcttgggggggaaatggcagttttagcaaagagctgaggtgtctcgaggctggaaggcagtctggacataaaatttccacagccatccttctttcaaacagtaaaagtgggtgcttttggatgtacacttctgacattctggggttttaaaagcaatgtaaggcacagcaataaatgtggcccttgccagatattctcgatctgtcagtatggatattggtagatgcacaatggtgggtaatgcgtcaatctggcttccttccctagatgagcggtgtttccttggggacaagcacaaatgtcatgttttctatatcaatgctgttgatataatagtctggattaccttcagttctgattgtgtgtcatcttgggagagaatactgtttaaatgttagcgctgaataatgaaaattaggtgaggagtggatggtgggtgaatattaaaatgtcgccatcacaacggccccacctgccctgtagggccctgtccctgtccatctactttctctgctgattctgggtcagaaatacaacatgttctcacttataaatgggagttaaataacttgtacacatggacatagagtatgtaataatagtcattggagatttgggagggtgggagagggcgagggatgagaaattacttaatgcatacaatgatacaaggtacactattgagatgatggctacactaaaagcccagacttcccactctgcaatatatccatgtaacaagagtacttgtgcaccttaaatttatacttcattataataataataattttttttttttttgagaaggagtttcgctcttgttgcccaggctggagtacaatgatgcgatctcggctcactgcaacctccacctcccaggttcaagggattctccagagtagctgggattacaggcatgtgccaccacacccagctaattttgtatttttagtagagacggggtttctccatgttggtcaggctggtctcgaactcccgacctcaggtgatctgcccgcctcagcctcccaaagtgctgggattacaggcataagccactgaacccggccagcaatttttttaaaaaaggaataatgctctccctccccatccctgtgcagacctacacacctgcccatttggtaccacacatatttggggggacaaaaggtacattcatactccaattcctttttttaaaaaataaagatggggtcttgctccattgcccaggctggttttgaactcttatccttaagctgggcttacaggtgtgagcccctgtacctgactaacacctcagttcttgggagagcagtgtttccttggggacaagctatattcccaaacacagaaggtagtctcatccaaaatattaacttatattcaccaaacacagaaggtagcacttaaatgtaagccagaatgagactttcaaggggcaaacctagacacaactgcagttagggacaagtgcccctaaacatggcttgtggctcaagctattgggagcataaacatatgactccccaagctctctcctttttccttccttcaaatcctttatttcttctccttttaaagacatcaataagctatataaaagtatagaaaatgtgttaaaataacagtcttttaagactatctttagaaaaatccgttttcattttttttatgtgcctggacacaggagtatatacattttttatagtggtaaaatctctattaggttattaatttttaggcccctctaaaatgcttagagtctcacaaaatacataatgctacccacaaaatacctctggagcttctccctctcctctaattctcaaggcccccacctgaatttagggccttcctctcaccttggtgaatagaatggcttccaagctggtttcttgcctctaggcccttcttatacccccagaattaacttcctagagcacaaacttgaccctctgtttaatgcctggcagcaactcccagcacctttggagggaagccccgtccccaagggtccttgtctgtgggcccagccaggctccggggagtgtggcgctagagtggtatgctcttgtcgctgtgatcagccctggtttcttgtgtctgccgcagcccacactgttctggggatgcgctccgtgccctcctcgaaccctctgatcctcccagagcgtgcagcccctgggcgccttgtttacagcggctgcacaacctggcgcgctgcgtctgagtcctcgcagcacagaccccaggtccctagccagccgcagtcactgtggtgaacaaattaggcacagctcctaccttcgcagaggcagcaatccattcggggaagccagccatggtataattaaaagtgcactgagtatccatgtcctccagcactgcggggtgccatagcagcaaataaccaggggacccaaacaggcttggggagccgcgagggctttctgtgccaagggagggatgtcgatgagagttctgaaggctccctgggggaaggggcgggggcggtgctggaagtgagtgggggcactttccctgagaagagccttgaacggtgagtacaatccaaataagcatgtgggaaacggtggtgcaacacgacgtttcctccgcattgattcccttcactgaaggccctcaaaatatgtgaattttgtttttcttagtgcctcagagcttgaggcatttgtgaaagccaagacccattgcccttgacctctgggggtctttctctttggacctgtgctctctgcacctggcagagatgcacccaacgaagtaggaatgggctcatctccctgcgcgcgaaggtggggccgctgagcagagcggcaaggtgccctgtggctctccagactcaggtggtgcatttagcagcaggaagccaccaacgggcagccctctgggatgctgtggatgccagaatggaggctccaggaaagcagtttgggtttccaggtggcccgatatcactcttactccgcctgaactattttgagacactcctgccatccttctctctcccacacatacccttaatatgactagaatatagctagttcgagctaacatatgttcttataattatgttgctagcatgatagattatttattctactcactttttttcccgagtctctgcactgtgtaaccaagactaaggagcttgtttaaataaagagatactaacacaccttgacagcagcctataaaaaaaaggaaagcccaacctttaacaggtctcaaatctgcatcccatctgtttaatatgcaacctaatgtgctgctgggaggctcagtttcctagcagccgaagggagaaccagaggctctgtctactaagccgctgatctctgacgatggaggatttgagtgtccagctctgtgtgatgttgccctaactagggactgtcattcacctggaggggtgctcagtgagtgggctttggagccaataggcactggagccagaaggagtctccacagcctttggggccagccttctcttattgctgatggggaatctgaagccctaagcacagtgtcttaggtgacactgtctctgatggtgacacagagactcagtgaagggtcagatcccgaatcagctgccctgactgcattcagtgtcttttttcctctgcggtatgggactggaagatcaatggaaatgggttccaccacccattctgggaggcaaagcagaagccaggaatcaaccactccatccatttcctatgacttctctgaggaggagcttattctctctcttctttaatttaaatgcttggaaatgcaattaaatgcaataaaagcctatatgaccaccttaaggaaaatcatgtttccattcattcctttaatcgttcattcaaccaacatttactgagtgtctgttgtgtgccagccattgaagacatggtgatcaatccagcagagctcctgtcctccagggctttccaatatggtgaatgaacagctaagtaaacgaggcattacagtccactcgccatggtcaagaaatgccacagtggtgtatgcagagctgtgaagcacacatggtctcatggaggcacagaacaggggcccctactccaggctgtgttagagctattggtcttagggaaggcccctttcttttggagatgagcttcttgatctgtaactggaccaaatggtctctgtgaagtttgtttgtttttctgttctaacatcctgaataaggtgtgatgggaaagaagaggatgggaaagaagtacaagaaatatctcagactttcataagtttcaagcctaattgggaaaagaacccccaatacttatagaataagtagaggaaaaaaaaaccccaaagcctcattctatagttcaaagctatgttatttgatatgtacaatagatactaagaaaattcagaaagtgggaaaagtagaatgatttggagttggcagaaagagccctgtgggagagatgcacattcacttgggtttgaaatagagcataaaacttgcatagatgaagggctgattggggaggatatctagacatgaagtgtaggggggagattagcaaagtctgtgaaaaggagtgagcagggcaggttgggcatgagccagaaggtgaagtgatttgtaatagctccttacctaatgactgcctggccacttcgcaaaatccccatgtagacagggtgagtacatgttcctgttcaccctggacagttctggatcacatttctgttggcctactgtaattattttatttatacattatttttatttaaaatgcatactatataaatgaataaataatttataaatagataaaataataaaataattacaataggccaacaaaaaataaaaatgtgtaaataattacagtaggccaacaggcatgtgaacatactagagtcttgctctgttacccagagtggagcacagtggccaatcatggatcactctagcctccaactcgtgagcttaagcgatcctcttgcctcagtctcctgagtagttgggactgcagtcacaagccaccatgcatggctaattaaataatttttttttgtagatacacggtctcactctgttgcccaggctggcctggaactcctggcctcaagcaatcctcctgccttggccttccacagggttggaattacaggtgtgagccagtgtacctggtcttttgtgtaatttttaacagagtcccctttgaacacttttcaacatgttcaaatttaaaaatgattaatatgattgaaaatgattaataaaatattaatctttaataaatgattaatgaaaaatgatttccgacgaattctgaatgttcatcttgaccttgcttgtttctcttagcatacagtcttgaagtcactgcttttcctttctgtgcttttccatacctgtctataaaatagggggaatgcttggtgccttcccttcttcctgggaacatatggagccaaaagacatcttcaacctcattctttccttggtagaatttaacaatatacccttagctacagagaactaaaaactctctcatctttgccctagctaagtgtgtgtattctctcccttcccaagtgaatttccaggttctcagagagtcctctttgtctaaaagggttggagcactgagttggatgacttggaaagtatttaaaaattatttggacagagccatcatgaaaataccaggtggccattgggaagtgagggggtggattccatccagtggtgccaccatttatcatgttcaattgggtgggccaactagcattctggagcagagaaaaaaggactgtacgttgtgggacttggttttgctctcccagctggtaatctcagctgggacaggcctgggctccagctcacataaccactcctcaggctcccgtctagccagcagggaagattctagttgctggcactgtcgatccaacacctatttatgagtactaaatttgcaaaaataatacatgaaaatgaggttgtgtgtcatttcagcatgtgttctctataatgaaataagatggtgatatcaaattactggctaatttaattgcctggaaaaattaatttctaaaaatgccaaataattttcaaatcagaaggattagggaagcagcatctatttttgagtttcatttggggagaaagctatacagagattttattttttatcctttaaaatctataaacattactttgtccttggctggggtatcagctcatgaaaaaggaggaggagaagcccttttatcttcatttcattttgaattgtacttatttttaaaactctgcttcctttttttttaatatcaatttgtgttaaaactgtagaggatttaactcattagttaacagctttactggcctgtgaattatgcatttatggtacaatttgaagcaccaagggatgaaaagatggtctaaagtttgcccaaacccaaagatcatggttccatgcctgagacagaacaactaggggaaacctttgaccctgggtcagtagtttaacagactttaacccattcctccttgaaggagacccaatctttttgtttttagtcaggctccagtaaatcttagtcctgtgcaaccacacttaggtgcagcaatggttccctttgtcccctctttgatgcgactggatgagattctcaaggcagtggccagtggcggcctgggtatctgcctcagcagccaggaactttcaggagcatggaagcatttagattctgagggcccctgcattgcagatgcgttctttaagcaaatacttcacttgtgctttctagccttttaccggaattgagagacaagtccaatttcattgtacatttccattacttttaataaaagtgtgtaaatctaatatgaggtaggcatcagtaatggtagccatcttgttttaggaaaatatggaatttgagagcctgctgaaagagcttaaaagaagagaggtctttgcaaaagtaatgtaatctagcgaacattctgttattcatcagtgagtgattaaaggaggaaacagctcagtggggcacctcgtttcagatgctctgattaaggtggccatggtttatagaagctggtcttcggatgatgttcattaatacggttctagactgagactgacaagcgctgccagtgttgtcttcctcaagtagaatcccagatctccttggcctcgtgcttgttggtacagttttcatttctaaaggtgatgaggttaatattgctagaaataacaatttagcccttacctgatttaaaacatttcaccaaaactgtcatcctgtgtggtactgatgaatgcctgcaggccagctcgaggcaaaactgtgaagtaggccaagtttatttttgactttcctgactgcctccccaagtggtcaccttccattcttttcagggcacctgtctctccttcttttccttcactcccatgaccaccctccctcaactttcaatactatttttttctcatgtccttactttgtttttttcctgataatgaaggaatgatttggaaacctcattcatactaaggtactaatgtcttcttttattgcccttcttagggatacttgcattttaaaaggacctcatggagaggaccaacttcaaactcatggaagggatttttggtgggcgacttttgagcattggtagaaaggatgttttatcagggcgcacctcttgtaaactttttatctagcccaattagtagttaatgaatggttaatccttgagtggtttggttttttccaaaccaaaagaggacctatgttaaatataacaaaatttttaaaaaatgatcaaacttccaatgtgattatgggggtacttttagtaaccattcgctgaaaaggggaagacagcatgacgtagcagttacagaacgtgctgaaggcagattgcctggctcgaattgtagctccacttctttctagctgtgtaaccttgggcaagtttacctgacctctctgcaccccaattttctcatccataaaatagaaacaataatgattatgaacctcatggggtagttacaaggattaaacaagttaatgtgtagatagtatttgagaagtgcttggcatatggtaggcattcaataaatggtattgatgatgatggtggtgatgatgatgactgcaaacatttgaatagtagaagagtatatctgtgcaagacctattattttttcagcccatgatttttggcgtgtatttggattcctggatgactcacacgcagtaacgcacagccgcccaggggtctgcaaccatagttagagtttggattaaagccacacccttgctggcctcattttgcagagataaggaaaagctgaggcagccagagtcaacgtaggattagactgtggagctcccagagttcccaaacccgggagttctgtgagatatattcatctttcagttaaggctccatttatttcccttgtgttcaggggctcaaggagggaaccactgtttcctttactttatgagtcatggttctgttctgtcatttcgggaagggcctcaggcccctcaacagtgtcaccactgtgcaattatcttgagtgaaggcacacagcaaagcgcatttcctttttaatgtagttataaatgtcgcatcacttggagatttaggaatccgatcaggaattccatttcctagtcaaatagggtataattagagtgggactctgggcccatccctcaccaggcactgtaactggggaagaggaagcaaggagctattctgcttcctttggatctgaggggcatctggaaaaggagaggcatcacctaagctcaaagccatagaactggtttgcttccccagagaaatgaggcctgctctccagagaaataacaagttagagttttcattcatccacagagcccttgcgctggggtggaggtatgcggcaggaaagacggtgcaccttgtcatttttggtttcttcaagacaggccaaggaacaaccaagtcattttagaaacttgttccttagggattagcccctgatgagatcctatgtccaatgtacaggaggcctatagaatgactctatgaatgaatgaatgaatgaatgaatgcttggccacctaagccttttggaggaaacttctggcatcgtgcgtggccttaggacacgtttattatgcatcttccatgtatcaaaccctgctccagggataaagttgtgtgtcattgtcttctgctctgcagctagggaaacagacaaggaaccaaaaatgacaaaacagaaggtcattgtttatcaaggtctgccccgaatttataagaagggcttctatttctgcctgggcaaaaagtagaatcctgggtaattttccagagtggttgatgcccagactgggtgaagatgaagaagggttacctgggcagggaagaaaggaacagcagcccagggggaaggaacatattctccttgtgcatgtgcaagaaagaaggggagtgtgtcgtgttgcaacacttccaatagggtgcacttaagggtatgcagaacactgaggctgcagaggctggcaggggccagaccatcaagggactcctaggccaagcaaaggtgtatggatgctggtctaaatgcagttgtgttggatgtgagtggtcaagaactgaaagtctgtacatggaagtgtgacctgattgaacttccctttgactagggctacagcatgcgtgtattagtctgttctcacactgctaataaagacatgcctgagactgcgtaatttgtaaaggaaagaggtttaattgactcaccgttacacacggctagggaggcctcacaatcatggcagaagacaaaggaggagcaaagtcacatcttacatgtcagcagggaagaaagcatgtgcaggggaactctcctttacaaaaccatcatgagatttactcactatcatgcgaacatcatgggaaaaacccacccccataattgaattacctcccacctggtcccttccatgacacatgaggattatggaagctacaattcaagatgagatttgggtggagacacagctaaaccatatcagtgggtcatgggttgagcatcggggagacagcctggaggcaggacaaaaaaactaggggaccattatcagtaattcaggcaagaagagctgtgtgaggactaaagtgaatcaaattgtattattgtattagggatatttgttaaataagtagaatttagctgtgctagtcacaaaaaaacgtaactctgtgagatgatagactaaccctctccactacagtaaccattttaccatcttagtgtgtcctataatatcatgttgtaagcctcagatagatggaatacatttattgaaaaacaaaaagaaatgatggaggcctgaacaaagacagtagcagcaggggttgagactaggggaggattttgaaagagattttgaagttgaatcagcaggatttgactggatatgaaagggaggcagagggagttgtctgggctgccgtctaggtttctcccgtgatgcacaggtggtcaaagagggtgttgtcattcaatgaggatagtttaggagtaggagctggtttgggtaatggagataaggtgcaaggagggaagagaaggataaacatgatgacatctctgcagagtccagaagaatacatattttccattagtgacaattgcccctcacctgccaccccagatgactgctgggaaaacttggaggtctttggtacttttccattttcttctcagtcacttcactctcagcaagcatatttaggtctggggtaagataccatgctaggcattagagataccgttatgaagaaggtataggtcttgctcccatggtgtttgcatgctggtctctttcccatgcacactccttggcctgcttatctgtgtgcacagtcccatgccccactcccaaagtgattttcttcttagttattgcctcattccacatacagtgattgatgagaaaggcataggagatttggctgttctaagtgagtttagagctttaacgggagattctagaagttgaagaactcattatcagaaatgattacttctgacagtggcatttccccatcacgccaggcagtgagagaagtggctgtagtctgggataacttcctgttgctccgacaggcagactgcctaggtggtagctgttctgccaccctggagagtccttccagttccaactccttgctcattctgaaaccagacttcagcattctttattaatagtaaaaagttctcccacctttagaatgaaagaccgtttcaataggtttaggagtcctgagtgcttctaaagctccaaaaatataaattctgtctctgctgatcaatttagccaccctccagcagcagtaaaaatttaacagagctggaatcagaaccaccttccctccaactctgcattttcttttcataatttcagtgacagacctattattcagggacattcaaaggattgcattatcagaaacaaattccacaggctctcattgtacccccgaaaccaaacagaccaagcagaagaggtctacagaaagaggaagaaagaaatagttggttctgtgtgaatgatgccattcctcccatgtatcggtacttgggacaagagacaccctcagtattgagcaaacctagggaggctctttttacttctctaaccaggtgatgcaagatgcttcattcaggccaagagccagagaaaaaaatatagaaaaaatgcagacaagggaggcatctttgcctgggttcccttagcccagctacccacggagttgcagaggggaagaaatgctagaaattttctggtctgaactatagtactatataaatatagaatgggggagatatagcttaatagaaactcatgtgaaataaaatacaggtattgagttcaacttgggggatatagcagaagaatactgaaaaattgggggagcagttggaatcatgcaggctatgaagtcaggtgacaggaactgtagctcaggtcacaaggcctgaagaagcttggaacataggagtctggggtggggcgggggggggcaacagaacaatcttttcacgcttgaataattgtcccatggaataagagcaggcatcaaaccctttggccttaaaatctagtccattgctttgttttacttttgaaaaatctaaagcccagagggttaaacaactttgtcaagagcagtcctgaacactggtatcctgtcttatcagaggccacttatcagataccactgactccataactgtgtatacaactgcatgtaataattaaatcaccatatgtgtatatatgtgtatgtctatataagtgtgtatataaatacatatacatgtataattatatacacaatataatatataattatatatacaatataattgttattgtgtacatataatcatatgtatatataattatacataatataatttatatattatataatatacaatatgtaattatatgttaatatcatatataattatataatgtatattgtagattatatgcaatataatttatagactgtattaatattgtaatatattcaatatataaataattgtgtatatattctataatattatagactatacaattttcaaatatatatttatttgaatgcctaccatgtagaaagtcctgtgctagatgccaaagggatttcaaaccgtatacattgacctctgcctgcaaaaacttctagtcttatcaggggagtgaagactgaggcccccaagggatgagctggctcaccaggcaagacaatggccgtctgaagggagatgtaagtaagagatgctcttacaagtctagagatgagggagatcactttggtggaatgctaggttataaagagatgtttataaactttaggatatgagttcatttctagcttgctatcatctatgtcttttccttccattagctcgtagctccttccagagctggaaccctgccctatgctttttctcttatctccgtagagtaccaaatatcagccatacacaagtgcttagcataacttaaatagaaaactataaggagttgactttttgaaatggagatttcctctttcataaagctcatctgttcagataagagcccatttccggggatggttggagaccacgagtctgggacacaactgggaccctgttctcacctaggttttctccctctggctgaaagctgacagacatttgtgaggcctcaagctatcagggcagtcttggggattatctggtatcttattcggctctatgtatttccaacaaaaaaaatgggagggaggaaaatgacgttccaaatcaaagtaagcccctttgatagtgttttgatgtttcagctgagaattatactggggagaactgtatttttctggggttgtcaaggctccccagctaacctccacagttgccgttttaagggacgaggagttttacctaacccatggggaaggtccctggaactaaagcagtcaccatgttttctgagggtgaaccaggtacaagattctgtgctagcagggtggtatagagaaaaggacatagaactaggagtcaggaaccctcaggttttaaacatttatttaaaaaaatttttttttgagagacagggtctagctctgttgtccagactggagtgcagtggcatgatcataacttactgtagcctcaaactcctgggttcaagagattctcctgtctcagcctcccaagtagctggaactacaggtatgcatcagcatgcccgactaaatttttttctttctctttctttctttcttttttttttttttttttttttgtgtagagacaggggttatgtcttgctatgttgcccaggctggtctccaactcttggcctcaagcaatccttccaccttggcctcccaaaaccctgagattacaggcatgagccatcccgcctggccttgttttaaatgagatgtttcaactaggtggcctctgaagtttcttctagtttaacaattttgttccataggagaaacaagtatttaactattcactcaattcagaccctgcagagttgagacaatgtgctcaggcttgaagggagaagagccctgggaactttcgcattagaataagctctagttttcacataggtttcacggagggaaatcctgagctccaggaggttaccactgcactgaggtagaccatgcaccacgcactcatcagtgacatgtcctgtagttcattccatgcaaaaatctgcaaagaggcctgtgaacagcagaagagcgtggaaaattctcattaagctctatggtgccaaggaaggaggaggccctagctggggaggtaggcgagcccgcaggaacgaaggctgttccggttttcacagctgctctgcaccttggccactccaaactcctcactttactgtcaaggaaacgagatatgtgcagaatctccaatttaggctgaagtcgagttagacaagcctttcagtttttgttgccagaatgactttgccatatatgtcactctaaagccgcctgaggagggggctggggttagactctgccccagtgacctaagacagcagttaatctccatggagcctctccataagggggataggccccaaggggacattgtgtccatttactaatgactgtaaaaggctgtgaaaatcccaagtactggtggaatgctgctcacagcaaagggagaaggaaaacaatgtagttccaggactctgcagcctgaagactttctctttgctgggaggagcagtgtggacactctaagtgccctaaatacactgacttgatcactatgcattatgtacatctgatagaattgcacatgtactccatacatttgtaccaataaaaaaccttaaagaatacaggttgctggaggtagattttaaatgtctagttttccaatgggaaggcatgtgagaaccattgcatgttcccagatggggcttgtgcttccccctgcgtgtttccggtgctctctgtgctcacctctgtctagggactcagtacatcatcctcttacaattttcccccagtgttcatgctcactggacagggagttccctgaggacgggaacatggttttctatttccagcctctagcacagtgcttcaggtaatagatactcaagtaattgtttgttgactgaagaagtgatccattattaagccacagcatggactaaaatggacgagaaccctgggccatcttaggaatgggaatggttccctttgaacatccacattgcatttccacgtgtttatcagggtgtcataaataatgaattagcgagagcaggaggttttatatagcaggggaggaggaggagcagcacctgtaggggcaggtatgggtgtgggtcgggctctctgacagcagccagtggtccaggactgctgaggaacccttctggtcagtctgcgtgtctttcacactcctccgtagcttagggcacagactaggggctcagatggaggaggagtcatggttcccattgcaccttcttttctggactcctttgctaatctgtggtactatcatcccattccccaaaaagagtcagacgggaaagatgagcagaaaggagggagagcacagctgggcatagtggctcacgcctgtaatcgcagcgctttgggaggccgaggtgggcagatcacttgaggccaggagttcgagaccagcctgacgaacgtggcaaaaccctgtctctactaaaaatacaaaaattagccaggcatggtggcaggcacctgtaatcccagctactcaggaggctgaggcaggagaatcacttgaacccgggaggcggaggttgcagtgaaccaagattgctccactgcactccagcctgggcagcagagcaagaccctgtctcgaaaaaaaaaaaagatgggggagcagcaatcactttggggcttgggggtggggaggccccagggactgcagaggagtagccactactgctgccattagttgccttccactctccatactcatgagatttgatgtcatactcccaatgcatgaaaatatgttttagacatagagtgccctatcaataaaaaggatccttataattgttattaaatcttgccagagtgaaatatttcctctaggatgaagttgtttggcacatgggaaaaataatccctgctgtcagccttgcaaatagctagcaaacatttactagtctaccgtgttttgggggaagggggaggcactggtggctgggggtctgtctctgtatatacatattccacatgccttccctcaagaggcacatggaaaatgcaatgaatgaaatcattcttgcattcacctggtttaaatcattatttgccagatcaagtgggtgggttgcctatttaagatctttgaggaatcaagcagaaatcaaagttttcattttggatggcccactaagaagatgactgctccaagccttggttttgtggttttttttttatttttttttttaattttttcatttttattttttggtaaaatgaagatggaaggaaatgatcacagaggttgctttctatctctggtaactgatgaacctctatggctaataatgttacatatctctgggatgtggcaggaaataactaagactaagtgagaactattcagagatcctggaaagaaaagtgtcaaaggaacaagtctcctgcatggggtctgccctgagttccagccttgactcttccacttgctatctatggggatataggcaagtcacgtcaactccctgtccttggtttctgcatcagtaaaatgcgcagctagtaattcctacctcagaagactactgtgaggctcagaagaggtatatgaaaaactgttgtgtaaaatactcttcaaacataagtcatagcaaccctggttctgccactagctttagtagaatgtaggggctgcccgtatctctttttccttaaggtctcttccagttctaatagtctattctttcatcatgatattgccaagtgtttttgtgaaataccctattggctagctatgtgtttataatcaacaggtgtataatatattggaaggggcttagatatcatttgctccagcctactaagtcatgcaaaaattctctttatggcacccttgacaatgggttctttatcatgatggggaaatcatgcctaacaaggcagtctgttttgattttgagcagtatcatactttcacaggtttttctcatattgaatcagatctgctccctggtaaatcctacctactggccctcatttctgttctctggaactgtgaacactccaaagcaatcagtaatcagctttatctcaaactcctctctttgttaattattctttccctgattcacagataaggagaaagaacaaaagttaagtgatttgtccctggtcacatagagggacacattagagtatgatgggaacttggagctgtaggggtttgaggttgtttcttaaccctcctgagccacacagaaatagtctctgaacttatgcagagaagcccctgttccattttaccaataagcacaattcattgctttgttttagagtcttctgtttagccaaatgttttcattacattaattgtaaaaggttttttgggctgacccagactgactcacaatcacactagtgcacacacaaacacacacggacgcaaacacaaatgcaaaacacacacacatacacacgcacacggagacccaatatgtaaccagagtgatgtgtcaggaaactctaggaaaagctgtcacatgttaagttttttccattaagcttgaaacaatgtcaggaaaatagattatatgtaaacatagaagaaatatctctaagttttaaagcaatgttctcaactcaagtaaatctagtgatgtaaaagaaaggaactaagaaaagaagatcacagaatggaaaagtttgcagaatttgagctttgtttggataggatatggaatatcatccttggttgctgattttttagtttttgatttttgtcttgagcatgaagttaccacatagaaaaatgcacagtagtgaagtttgtgtagaacaacagggaaaagggagagactgtcccatttcctaactgtccatggaggggttcccaggtctctgggaagctcagctgtaagaggaagaagagcaacagtccttgactccttgacgtgaatggtgagctttgtgctttggaagattttgtagcatcctagagagagaggtgtgcgggtgacttaggaacccctgtccttctcccaataccagccatattttccaagtaatgaaattgaggccccccacatcacagggacttgtgacccaccattcagcagagccaagactagaatccagccctggagtcttagtccagggttctttttactgcatccctgagcagagtatttgacttccttcttactgcccggaagacggacaccctaaaaacagtggtcccttccatccttatgaaagcatgaagaattatgcctttcattaaggcacaaagaaaatcttatcatgatttctgtcaatgatcatagctcaaagtcacgattgtttcagatgtatttctcatatttagacttagtatcttacacggttaaggtatttgtcttctatattggctgtaaatgaaggaagaattttaacagctgtccaactagagcaagaaaaaaactgaaagacaaaaaaaaaactaggctttttttttttcaaagtaagagaggaaaaataacattaacacaaaggaacattcttactaagaataggtggagaaaggcatctgaaaaataatacctcaagatgcattgaaacattttagggaattagggaattctgatctcttgaaaaaaaagaaaattaatattaaagacaagctgtgagtttccatctggccttgctgctttccactaacgcttccatgacggaattcatctgtccatcaactgtcaaaaattctcctgtcagtaaatcccacgacaccccagcgagcccaccctgctcaaaatattccatgccacaaactattccgaattctgaatcctttttttcagatctctgtactataagacataaaagttactgctttttttcttcctttttttctctttcttttcccatcatctttttcacccccacactctgtagtatggaggtaaagcgaacttgggtggaaaatttggggagccctcagctatttgaagattatgttcccaccaagtctcttctaagctttttcactggagtctgacaacagacagcccacatctgttttaaaacaccaagtgcttgtgaagtgtgaactccccactgtttaatgtaactacatgactatttaatgtacacagtggtagagccactcagaatgccaaactgttgtgacatgcttgaaggacatatataaacataatatactgtggtttattgtgacaaagaacatctatgccacaaataggaagatctgtttgcttaccagtgtagtcaaatgaggaaggaaaaacgtgtacagtaccctctcccccgccccatcgcccatgtcaatagtgaaattgataccagattgatgaaacaataaatccagaataggcattttataatgttctatggtaataattttaagcctaggattttgaaatgagtcattcattaaattaatctgaatatataatgcagagagaatagaggggagatagaaagtcactacagggagggctgctgagagtttggcctcttctagaaactttgttcccttgtatgggtgtcggggacatttttggatggtagagacttgggtaacatgttggtgctgcttttggccaacttggagatcgtaattttctgtacattgttacccatggaaaaacatccacggttgcttcttgtgttaataaatgaagagaaaagacatcatggctttgcaaacacatttcatttttaatatttctcccaaaggtggattcttataccttctgacatctcattaatcaatcgatcagaatgtgttctcttacatctcattgttacaattctaattaacctttgctagttaaatacttaccaaaaatcagctccaattgtaatcccgtttcctctaacccaagcatttcaataaaagcttttctttttatcggtctttaataggaattaagtggagaagaactatactgtgtgtggtatctgttgctttttaagggattttgaaattctagaataaaatctttaggcatgaaacacagatgaagatgatacttttagtaagcctccagagtgtagacaaggctattcttatatatacttttaggaaagtattaaccttttttaaattcacagttatcatttctcagaaaataactacttccatggaagacataacatcccaaaacaaaacaacaacaacaacgaaaccctcttgtaaatgatactaagaaagagaacagagatctagttctataataaaatttaaactgctattgttgttggcatttaagttatactgttatggtacagactaatactcaacttcatccaatatttctagattgaaaataccagtgcaaagtcctggtcattagaaaaacttactcctgcctctgattattacaatttggggttcccatggtttggatattgctatatcctgtggctcacataatttcccataataatttagcagtcactaagggaacaaatctgagaaggcctttataaaaagtggtgcctgctttcctgtttgccttagaactgcagcccacgtcctggagcatcgggggtgctaaggacttttcttataatggaaattttaaaaggacagtttaaggaaagctcaatagaggagccaaagataaattcagcaatacagcagtgaggagcaaaaccacttttgcagagcagggagagttttagtataatgtcttttgggatcagattgttgctttaaaaatgtggtgaattagcctgttttgcttccacatgatttcatagcatactcttctctactcctctgctgcctctaaccacactgaacactgccattcctgagcaacacttcacatcggctcctaatgcgcagaagtttctggttacacggctgcaatttctgtctaacgttaccacccttccacagccgagcggacttgaacgggcttttattttaatttcctttctcccaccggtcgcaactttggaaagccacgcaagccttgccacacaaacagggttagtgcctctttaaggaatatttaaattgcatttcctactgtcagttaaatctcatcaatcatgtttttaattaaaaagaaggacatctacatcccactttcgactcaaagtgcataatgaaatcatagattggggcagggctggagagtttcagctttgctgggtgcattcagcagagatgcggggaaggtcaggaacactggtgcatatgcaagtggcaaacaaataacactcctgatagggccgggtgacatgtgtcaacccttgtcattgagaaacaagaaaggcaatgtgcccagacaaagggtagggtggaatccctacacactggcagaacctgacccacgcgcaagggctttgtgtagcagatgccgtttctcattgttctgtgcctccctccccagtacccctgacaacagccactgccgctggcattccaccctgacatctgttcagctttattgatgcggccctggaggaattcccagtgtaaacagggaattctctaagggaaccccatgttgtaaagggatgagctgcataatgcaaagatttaaccactatttaaaggtgtgacacttgattgaaagtgacttgcttttccccccctttccaatcccacctccctctccatccttaactgtatttggcaccaactggctgcagcaacacccccacttccccctccatcgctttgttttcctgatgcataactgttaggaagaatgaaggatggggggccttgggtaccaccatccaaaaaagccacttaaaaaaaatttctgggttacagtcaattgagtctagttgtcgcgttgggatcctgcccgctgcccacccacactcctggcgagaaacagcttgcaagtcgcttggtcctgtggctgaagctaatggggtgggcttggtgctccttgctagaagcaactgcggcagttcgcagtccctgagcaaagcctggtggtactagttctggcagtgctagaacgtaggggatttgcctttgggattttgtgtttttggcaatggcgccgtaggatattaataaggattttttcaaaaagcagacctgatgggatacgggatgcatccgtcattgccccggcaaacgtacgtgtgctctaaggcacctctgaagtgtcacactctcactcaacttcctggccgatgttcaagtacagggagtgtcgtgcgagctccagccatgcacattgtgtcactttggttgagcatgcagagaccggtgaatagggccctatgcagcaggaccgcctctattagcagtaaactcgacttgtgatacgacatggacagagtctattttgtgagtccatgggctgaatttggattcgtgtgcttccaactctcttcccttccaaatgactggtggagagacaaaatttgaaaacggcaatgatgtcttcctgcagtgtttcagaataaatgaggttgtgggtaccacaataagggcaaaataaaatagcagaattatcagaggatgaagtcaaaagtcataaagggaaatccgtctttctaaaggcctgaagtattgctgacctatgttttcagagaacagatatcaaaaacaagattggtgtgtgtgtgtgtgtgtgtgtgtgtgtgtgtgtgtgtgtgtgtgtgtatgcacatgaagtcaacaataagcagcagcctggtccttcacctggagtcctaagatttgctcttagctgaccattctttttccctcaaagggaggtgcacttccatcatgtaaggcagtgaagctttaagtcaagaagccagcacaccattcaggaatgcagactttccttcccattgccacagattgaatttttacttaaaacaaccaaaaccctctagagagattttatctttaaaattaatttatgtattttcttctgacccaaacaatgtatggtcattttagaaaatttagaaaatatggacaaataaaatgaaaatggcccagtaacttaccgctcagaaataattggtaattattccagttttgtctcttatctctctctgtatttaaacaaaaatgtgataatcttatgtttactgtttcgtatttttttatactagactatctcttggtattattagatgttattctataacataatttaaataattatgtagtatttctttgtatatcatagtcaattatccatttggggacaaatttgttttccaccatcgtatttattataaacaatgctgcaaggaacatcttttgtagataaagctttgggtatatccatgactctttttttggacaaatccttaaaatagaattgcggggtcaaaggctgtatgcatttttaagacttttgatctatatcgccatacagccagaaagattgaactaatttatactcccaccagctgtggatcagagttcccaaaatggaagtctttagggcatattcctgtgtgtccccataaggtggaagtctgtgtggtgaagctacggtcccttttccgtagattcgtggcagcatgtctaattaatatgtccattcttaatgctttcccatctgtatttctctgcatgcagtgactgaaaaataccatcaacagctcagcgctgatagatggttcagagtccagcaatgtcctactttccttcctgtccactttaaaatgaaaaataagttaactttgacatttttagcagtcacagatttaaagcaaactggaaatagaatccaggcccagttctaaaaaggacacgcgaacgctccagcatgcctacgagacctgttggaagggggagaaaacaaaacaactcacaacgtttccagtgaatgcacttccatcagaacgtgctactgatgggctgcccctttaagcacagtttgccttcactgagtttgaatataccttttggtattcaaataattttgcaacagtggatacagaccttctttatgtgttattggtctgggaacagcaacagattaaaaaaaatattaccaggtcaaataacagctgttattattaagttcagcttttattatcaattttgccagtagattctggcagtaaaaaaaaaaagtctgcttctgagctttttactaatcagtactctcattttgctaatattctaacgactgtcaatttacttcagtgctgccatttgcagaattttccaattagcggcaaacctgttccaccttctcctgtaattacgggggactcagttcagatcagctgcggccagacagcatatgatgtagttgccaaaatctgtgcaatgttgtttttaacctttgcatgtgctggcacagttttaacatctctgtttgtaggcaggaggcttctgccgtagtggtaagtgtcaaaatatcaaaattatttttaataaacacacaacgaggatgaaaacacaaataggagcatatttgggttttggatcaatttaatgtctgctccagattcagtagcatcccgtacgctgcccgttctttttttttttttaatcaagagacttttgatgaggaacaattgagagttgctgaattgcatcaatttcaacctgtttcctttcctagttaaaaaaatggttgaagagtctgaaaatttagaatggaggggtcctaatgatcacttatcataaacctctcatttttataaatgaggaaactaaggcttagaatggaggaaggacttacctaaggtcgcacagctagttatgtgcagttctggaactagaacccaggtcttctgcctccagtccaaggtttgttccactacatcatacattttcccccttctcctggtggcttctcaatatggcagaagacagagcagggaagcctcacccagatcccttgtttcatagaatgccttgctagcaagatcaaagccaatcaaactctctgaaagctgcctaaacagctgacattgcagtaataacaatagtgcagcaataactattattgctacatgaaaaaaatatatttaataataagctcattgatttttaacaacatctctgtgttgcctaattgatgggaagttgtatgtttgtgtagccgatgggcgttatgaattaaatatggccgtctttccttgaggcgtgcatgtcaatggacgaaagatggaagatctacatttcccccaagcaaaatagtccccttgtaccaaagcagggaagactgaaatgcgaacaaaaataaaaaccatccatcactgtttattaagtgctgctacttgaaggtaaaagggatattgaactgtttttaaattggaaggaatgtagctggacaaaatattgatggtaatattagctaggtgacaaattttattctttttgtccacattcatcaaaggagcaatttggagtgaattattctctctatgcccataaaccaatttttcttccctttttattttttaagcacacatgtttattaaggaacatggcataggaaggatgctatcttctggttcaagtcgtccaaaccttgctgcttgagtcaaaggctccacaattgctttagaccaggccatgcattgatctccaaggtgcttatattaatattaaattttatatgtgcttaaagattgaggcagactgagtctgttcccacaatttaaaagaaaaggggtgggtcagatttgatttcatttttagctgtggttttcaagtggaagttctgaagcatttatttatttttccaaatttatagtgtgccccttcagtccagtgttcactggctgctgttcaatgaaaacatccaagtttctatggcaaaatgggctgaggcagggaaatgaacattgaaaatatcgtctgacaatggggagaatttcaataaaaatttagtttgaagtttcattcgcttcaactctgttcaacttcaagtcatttttgtttttatgaggccatataatctctgagatgtttcatgaaaatcttaccaggcagtccatcatactcagtgatagagggggattgctggatttaagactcaatccaatcctcagtgttgttctatatgcctactgtgtgtccagagatggcctggaggttggcatccctaacttcttcatttggatttctggaatcaagcctctttcatcctcaaatgtacaggtagccaaaatgacagtctcattacttctggcagatctcatcatcccaaccaaagctagtcattgagcaacagaaagaggtttgtttgcaagtacatttataaacctaaaagtcccttgaatgaggctgctgtcaagccgagtggattttcttggatgtcattgacttccatagctatctctttctcaactaaatgaggacacttttaaggaagctggctggagttaattaatcagtcgatcaatcaacaagattttaatgagtccctgcaaggcactaagcggtggtaacatttatgtagcacttaatggttgccaatgcactttcccatgtattgtcttataggtagatattcttatagatagatatgagtgaggctcagagaggttcagtgacttccctaaagtcacacagctatgaagtaacgaactctacttcagatcttccagaactgtttttcctacactacttgagacagtgcaggtgaccataagattaccagccagcttcctcaagtgtcctcatttagttgcgaaggagatagctaagtcccaaatgagtagtatggtcaagaagtatacctgattctggatgagccctggagatgtaacctgaataaagccagaagtccatgtgtccctgccacaacgtgatgtcacacccaaacatttcagcagctgaaagtaattgaaagcggttctagtttttctctgcatttttcaaagaacattgaagtaattatagaaaattcacttcataagatactgcctcattattttgttctccattcggctcccgcatcagccaccctaaagtctataaccctcattctccattgtccttccccaggtctcccccttactttttcccttctgtttttccccctctcttgtgtgtaaaccttagccctttctaccccatttccaccattttcccactgatacccggatctgtgccaggccggcgagctcagtgatggggaagtaggtgtgtgaagaacaagactgtgaagactcaaccaggatcaacatgaccttactcatgtgtgtttagacgtcccaaggagggagtcattgtggaccaaaggatcctgacttacaagggagatagcatttgtgtgtgctctgaaagaggaatagaacttagaagattttttttaagcacacatgtttattaaggaagatttcaaaagtggaaaaaaaaagtacccgataggaagaaatgaaggcacatagtgaaaaaatcttgaaatagagaagctccttgccttaaaaacagagtaagcccacaataaaaagcctcgtcgagtgtctgctctcaataagcatcgtactaagtgctctaagtcaccatagaccctgacaaaatgttttcagaaggaaaaaatttgcactgattacttctctctctaacaggagttggattaggacagtgtgttttaaacaagcaaactgtggagccaggatgccctgttcacatcccgtctccaccatctggtagctgtgtgaccttgtgaaagttccttaacctcagtttccttgtctgtgtaagacagggatattgatgcgataatatctcacaggactgtcgtgagtatttaaatgaatcaacatgagcagatcactgctcaacactgaggaagcattaattgtattcttcactcttattagttgtaatattactttccattgaaatctgtctgcatagttctttttgaactgattataataatataatacaactcctggttattgagtgtggagatagaggcatctcactgcgtcagcacttaatacatgagattttgtttaatcctcgaaagcattctgcatgttagagccctcctgtgtagcaagtaggaactccttgctggtctgtttgtagtttggccaagcctggtccacttcctggtggaaagaggtgtcctctagttcctttctcctctccatttccctggtttttttttttttttttttcatttaaaaatcattttattattaatcattatcccatgtagcctagtgcctgacatgtataaggaatgttggtaaatacttcatttaaagcttctttgtacatatttccattgttaaactctgaattcacataaaaagttaaacttaataactcatatttccttctcttgtaacaggcacgtattggtagaatataaatattcttgggctctggcttcgttctaagtgaagacagtaattgatcacatggtacagctattgacaataaaaccaagaaattgtcagctggtgtcctggcatggactagtgctgaggtgggaaatagaaaattcacatttggtttctgggccaagttggggcaggaatggtcgtggggagaagaggacagggaatgagtcagatgggagcatatgaaagatctgcatgggttctcttgctgtctcttgcagctaacccagataagccttaagtttatgaagaccaggtttctaagaggttcttcaattcctgcagcatgtggaaatccagcgtgtgcaccttagatggcaacagtctaaagagagtgggtacatgtctcaggaatccacactagctgtacttctaatttttttcagtatgaattcaacctaaaaaaaaccttttactcttaccagattctaatttattccttttcccttttaattaggggaaacccatttctgacagattcgcaaagttttggctacctttgtgtggaggataggagaggagacaagccgtgttccttatctgatggacttttttataatatatatatttctattttaatcaagtggagtaaatacattctgggcttttcctgaggcaatgtgggccaggttttattcatgacagggctttcttattagagttatgaaatccttgtagaaaagtcggggatttctcagagaagatttttaaaaaatgcaaaacttgacacactttaattatttctgcactataataacaatattatataaaccccacactgtttaggacttaagttccaactgagtacattttagcatgatatatacaaataagagtgttctaaggccatagccaagccaatcacaggactcctctgccatcctctcccctgtcccctcttctaacactcagagggaagctcctgtgaggtttaatgtgcaccaggaactccagcaggagttgcccaccctagcagaaaggaccacattatttggtggttttacgttcttttgtgttttcaagtttctatagtgatagaagttctctctagagtggaaatttcctgttggtccttgaatcagccagggttctccagagaaaaggaccaataggaaatgtatatatatcatgtatattatatatgatatataatatacatgatgtgtatataatatatataacatacacgatagtattatatataaatatatatgatatctagatatataaatacatgatatctagatatatacaagataaggaattggcttattgtagggtggggtggggtgggagatggcaagtctgaaattcataagacaggccagcaggctggaaaccctggcagaagtcaatgctccagttttgaggcagaattttttttttctccaggaaacttcagtttttgccattgaggccttcaactgattggatgagacccatccacattatcaagggtaatccctctacttagagtcaaccagtttgtagatgtaccttcagtgtaacacctagattagtgttggattaagtaactgggtgctagaacccagccatgttgacaagaactaaccatcacaatcctgaaactctctttcatctacggaatccttggacttctgaatcctcttgctggcccggaaaagatcatgtggacctcctccttcattccagggggataatctgatctgttggagatcctttgctcagatcttcagggcagtttggtgaatttacgttgcctcaaaggtgatgaatagaactctcgaatgtactttcaaagtcttgctgagaaatcaactcctgtctgtgttgaatggtagtaaaatctcttaggaaagagcctgggaatgtggagaggactcatgcttctgggagtttttatgcctggactttgacaaagtggaacatatggaggaatcaatgagtgtcatagagatgggatcaatatgcagactttctggactaaatggacaccctcagtactgcacactgtgagtcagagaaggtgatgcatacagacaaagatacatccacattgtcgaagtataaaaccgatgtccagctcacagaggcaagagtcttcacctttctgagctatttccttagagacttgatcatcatctcatctaagcaatagtttattatttcttagccaacttgggaagattattagaaaggtgggggtgagaggagacacatcccaggcccgacacaatgtttccaaaatactctcttttcccaatggcaccagtgaaagtgggggagccagcctgccttggattcagggccagagaatacacagaaaccctcgacttctcaaccaggccaccatacggcgagagcaacgagatctccctcccatgttgtattgtggcccactggtacctggggacacagagccctcacctggtggtcttgcttcccggtagaaggactcatagttctctagttcccttaagcccttcgagctgaccacgtgtttgaggcaagactctttagaacacctattgggacttgggggctgagggatagcaaagaaatagacaaaagagggcatatcaaggaattggctggtacctgcacatatcagtcgcacttcagcaatatttataatcagagtctgtgaatttccaaacccaaatatagggacagtcacatttgacctttaaaaagcattcccccacacgggctataagggctctgcaaaaaatcttcctattatgaaaatgaaaaagctgaatgctttttcctttgccccagatcggctgtgaagggatttgaggccccacagcccatcgtgactcacaggcagctgctctgacccgaagtttgcacagacctccgaagaagactgtccagaggctcggctgcccagtgatgaggccccaaagagtgattctgtgttcctggctttgacacacacacatgcgtagacacacatgcacgcacacactgcacaaaggcagccgaagtgcattcatgacgattggctgaagtaatgtgatggtgggttggggggtgagagcatacactcaggaattagagaaacaaaggctgacaaatgataatttcctcggagccccctctgcaaggtttcaggtgctctgttcacaccttgctgtatgtctgcatgatacacttactgtaaggcacctcaggttcttggtggagcccaagactcttgacccattgccctgtttttgtcctcacaagtcactctgatgacccctctcagctccttctgtgcaccccgggttttctgaagttctcaggactatttagggataaaatatgtcatgagtataactcttcaaaattgcaagagttacaagggaaaagatgtcagaatttccaaaaaaaggagaaaaatattctcgggactgaggtgaaaataccaccaggctcctgagtgtagtgccccacttggttctgtaatcccaacagtaggaaaatgaccagggtcacagagctgctggggagctgtgagaacagcactggcttttgaaactcctgttaagactgtctccccaggaccaaagcaggtgattccaaagcccccaaaaacaggtcttggaaaaggctcagtcctgtgttagagtgatttccttattttctgtgcatctggtgtgtttctgggcaccagtgggtacagttgtagctatataggcactttaagtgtcacctggctgctctgatattcagcatgtatgttaaaggtacagaaatagctggacttgcaatgtcttgtgccaaatcatatatttgcaagaatcaaaattcaggtttagacgtctgatcatcaaaccacagaacttcgggattagtcatgctaatgaaagccatttggccctgttttctctgcgaacaaagctatctgtgttggttcatttaatctagcatatatctggcaattattgatattaaattgatttagtgtttccaaagatgtttcagacaccaaacacaaaactcccagtttattttacagctgaatacagaacatggattccttcctgatgtaatcagcttttcgtttaacctctaaagtgtaagcattgatccctccttaacttggtgacttaattaccatccatcgcgccctccttccgtgtaatttattttctggaaataaacagaaccctgtgggtggagggtcacttgcctgagctctggggaggatcacttttactgagtaggaagacaattgctaagtgtgtcatggttacttaccagaggctgattttacggtaggaacattaacaatatctgctatttcacaagaaagttctaaaaggtgttttaagctgtttcccaaagcacctaagtaattctcccagcatctctcagaggcattacccaattttacagggaagatatgtgaggggacttgtatgagggacgagagtaggcaagtgagacacagagagatgaaaatattgtcagtaatataaactgtaattgaacatgagtgccttcctcttaagttttatcctctaggtcacactgcctcctacattacattatcggtattaacataagcatgggagattaattttatagatcacatgaaaagtagatgacatttatcttcacttttcaatgcatcatctcattaggagaagcataaacattcagcccaggttaaaagagctaagaacaaaattaatctgctaactgctttatcattaaaaaaatgatcaaagtcaattggcctagctttgcctactaaaaaaggctttgttattgttgtcttgggttagaaaatattcctaacagaataataaacttccagatgaggacaaattgtgaaaaaccatgacctggccctcactaggccctttggttgaattctatcaaacttgaataaaaaatgctcctgtacccacaaccctggctaacaaagcagggagataggaacaccttttgatcagtttagaacttgtattgcaaaacaaacaacaacaaaaaaaacaaaacttgaagcaggcttatcactaggagtgacgaaatctgcttttttatagacatatatgtgtatacatttacaatagaatcattgcctggttgtgtgttctgcatgattttgatgtgatcaccctggcaagctgagagatggtaaagaaaacaaaaataccgggcctgatttttcaggttctgtcttaattcaaggcagagttctaccaggaggaatggtggaattgtagcttcaatttgggttgaatgaggagctcataaattctgactcatgtatgaaactagatgatttccttatcatggtgttgggccacaggactctctgggccatttctgggagtggttatcctgcctatgggcttgccagggagagcctgatgtcagatccctgcacagagtggcctttctcccagcgtggctggggcgactccacggtgcgccttcccgagggacctgtggctgtctctttcccatgcttccggaccctgtcctgctgctcacttgagtcctggcaactccctgagaaagcagaacaggctctgtggcctctgagtgaagggctgagatgttttacttccaggtcagctgctgattctccaacggatgaatttttttttttttttcctttagtagttgtattccattattcactgtgtagggagaaaccacaaacccaactctaaactccagggtcagaaagaatcatgtcagtaaaatggtctctggcttttgcagattattggatactgagcgtgtcaattaggcctttcccccaccactgatgttaaaacattttgtcatttatttaattctctgcctcattccaaaaagagcttgagagggctcatttggtttatcagcactcctttcaaaggcagtagaaggtgacagagccagtgacactgaaagtttcaacttttggggactagatgcaacttttacattttttgttaccctgccttttatgaaatatatggatgtgagtgtgttgacttaataatgatatctgttctggcagaggaaatgggtggctgaactattttaaagtttaggatctatgtagatatctaaaagccccacattctttttctcaagaaagcttttcttatttgactcatccttattatatgatcttaagtaaacgtactgtgtagaaacacatttctaccacaccaggctttgagaatcaatgtcatttgatgaaaggtaggaataagtacctaaaataaatgctaatttttagaaattatgcagatttataaatgcagatttataaaacattgtgaaacataaaaccaggtgttttttttgtttgttttttttttttaagcaaaaacagcctcatcagtttggaagttatttggaaagttgaagtttgggctgggctcagccaagcacttttgaaacttcaacataaactcaggttctggttttcagcaaagtggggctgatttatgggagtcccatgaatctgccccatttacattgagcctttctttgaacctggagtgagaaatcctagtgactccaaatgagatgggagatttcatgcctagcctccatttttgaaacaaggtggctcagtttcaccttgttccaagaatccagcatatttctgagcaataatgtgatatggcatgggaagaaagattagaaattccaggtgcacagaagcagtgcccaggggctgcgcctgttctcaatgggagcgtgctcaggtctggtgtaagctctggttctcccatgagacgtttcgtttgaggagcaattttttaaagagaaaatgaaagaagagattctggacatctacttaggagcaaagtaaaaattaattaggtagtgtcctctgcaagatgaccagagttagcacaaaatgcaatggggttacagagaataaagaaacgtgaaacagataacattctcttgtggtatatttaaaagaaagatttcatttttggtactaagatgtggaaacctccaaaaagttgataattcccatagagttaatagaggctttaggctcaataaagtttgaatgacaaaaagaacaaataactgattcctgattcctggaatcttgtacagatataggggttgggtagagcttagaccgatgtgatcattgtctgctctgttgactacactcgggaatattattagccttatctgaatgccttttgtatcaaattcttgacctgatttttgtcccagtttctcttttatatcatctaggtttagttcttctttaaggaaaaaaaaagaaagttaaaaaaattctaatgaaagtcggctgactctactatgagtaatataagaaaatctgttttgcttagggaatgacagaatattgaaatacctggttttatatttttacatgggtttggcaaatgcatctgaaagtggctaatatgatacctgacccagtgttaatagccaatgataattccataggtaccaactgctacctgttagcctacaggtgctttcttttttcctttttttggcacaaaggttatatgtactgtaaatgtggatcttcatggctgaaatggaggcaagccaccatagttttcagataaaattgagcctagctgtaattaccatctcggtttctctatttcagtcatcccttcttcccaatttactgctccccacccccaccaacttttaggtagcacataaaaaaagcacactacatcattcagaatttggaaacttgggagagagcaaagataggtgagaaaggaggaggcagagagactgaatcacaagaataaactagaagtgaggtgaatggaggaaaatcctcctgccaaaatataaaattagagaaatttcctggaatgtgtatattaggtgaaaaaaaaaaatccattagccaaagtgcagctttgttaactaactgctttacaccttattgcttaaatgccaccaaatttctttctccctcatagctgattaggaattactcaaaagctaactaactctgcgtgggtcacaatcgctttctctccacctgctctcactagtacatagtttgaaattgggtaggcaaagctgaagaaaatagccaaacaaaacacaaccccaaacccaacttcagcaaaacctcttgcctgtcaataggtgggacttgcttgaaggacctgcctagctttttctgactctcaattctgctctagtctcaggccagtgctttatggaggaagtggcgaaagcctccatttcaccctgtgagtttagccattaagcactttcttgctttataaaaacagacgtgcacatgttcctgactacagagaaaccaggcctcctattataaccactcaaaacgggatatgaggaatctgaaagaaaagcataatactttcaaatgatttttcctgaaaggtgaggacattattaaagatttccatgaccctttgtgtattcttttgagagaaaataattttggcctcttattagtcttattattccagctgctgtcatgttccttcaagaaactactagaaacacagaaagctctttttccttgaggcttaaaaaaaaaaattcctgaaccatttaatctctttagatgggtactgatgcaaaagctatggtttggcatataaaaactctccaaaagtgttatgtttccaaactacccaagtaatagcattgcttaactctgaaaacctgtgacagccttttccaggtgctttcaaaatattttttgcacttgagttagttgttgcaatagatagccccaggaggttgctgggttctccttccagataaggagaagagaaggcagctcacatgaacatctttcagggaagaagcagaaacagtacccctggcatctgctcccggctttggccaacagcctccgaggtgctggtgtacttttcaactttctcaactcccaagctagcttatcttgtagctttgtttaaaaaaaaatttttttttggctgcctggtattgagaaggtgtatttaagacagtaatgagcctgggaaaatggtttccattcttcagaaatttctttttatagactcactataaaaaactgaattaatagaaagctaaacacatttcaaatggcttcatctttttgacttaatcttttggccactgatagtatagtgactttgctgagtggaagggccagggagctctctatttgctctaaaattatatttctcctctctttgaaggttgactgacttctccttgccagaacatgcatttcctactttctttctggagtcttcctcaacttgcatgaccactaagcttcccttgcccttccagattcccaccctgctctgaattttctaacaagtgacctacccaaaccttgagctctgctgatcctggtttatttttgggagtcaaaatgaagcttgatgcttggttggaaaactctatagttttcacatttttcagtgcacagatgcatacttttctttgagactccactctccagcatgaaagagggacccttcattgtaataattaccgaatggatacagtcctaatggaacttaattgtttccactagatggatctcgggtgtttttggcagccaaaatgaaaatgattccaaataccatcaaaggagcttataagcacccagcatgcacagagtgttttgatatacagtggagtgttaatatcattatctctcctaatacaacatacggttactttaatcctttcccgcctctgtgatcttggaagatccgacggatagaaggcaaagaataaaacgttatatataaggagacaaagggagaattagaccccatcctctggatatgatttttttttgattgtttgaatgttggcttcaaatatgtacctttatcaatactgacttctgtatcttccacgctagtttgagtttgtatgcgacatcaaacataccttttcacacatgttctttccagattttttttaacacttacttagcagtttatagaaggaagtgaatgatctcctcaagctgcttacaaattaaaaaaaaatctgtgcttattaattatgcaggattagtctaattataattcagcaaattaattagcgacagaaggtgttctgaaacattggagtacatttgcatgttaaatggagaggctagtctgtaatatatgtaaatttatgcatggcttcatagtttaatttaaaaatttgcagctgcatatggtatgggagcaggtgaaaagtcagttttagtttaatgatgctaacaaacattggatggtgtcctgtcttagcaagagaatgcactcatatctgctaatctatgaatctgtcataagaatataacattacatagatgcacaatctcaaggtcattggagagtgaacccatagttgcgataggtagaaagctgaaaactgcagagagaaaatgatgccaggagaagcccacactctgaactttgtccgccactttctccaacattacatgatgcgtcattctgccttagttcagggaaagtaatgctccagcctgggtaaataagggtttctttttgtctcactggtatctgttctggcaggtgtgaaatagttgtccaaccttgattccctttccaaatctccacatttgcactccatttcaatttcctggagtcgtgggaaagttattaccgagttatgaattaatggtagggtagagagttttacacattggcctcaaccatctggcaaaacagtaaaaccagcggaccaggcagcagcaaagggctctgggtgtaattggtgttcactgctcagcctagcatagatgagctctgccgggagggcagagaatgggagggggaggggaaggatggggaaggggtgctgaggaaatgggacggtgaggacccattaagctgatggctgactaataacttcatttctctccttcacccgagagtcatggtactggcaagggaaatagatttgtattctgattctgaagtctcacggaaagatttttttctcaaggaagtccataatatgattcagttttgctgagttcttttttcttttctggatgagaagacagaggaaaggataagggcaaagaagaggacatgggttgtttcttttaccaaaaaggaaaggatggaaacttgtgctttgcaaggagccctccaaagacattttgtgagaacaattagaattacaaacatgctcttagtgtgtgtctcattccaattcaagcccaaagagttcaattattattttcattaatggtgtcagatttttatctgagtacaaaaacaaggacttttcctcagagatttttttccctgtgagcctcatggtgtcgaggaatagaattcagcagaatgaagatgcgtctgaatatagaaggggggataaaaaaaaaaaaaaaaccccaaaccacaaacacacaaaaacctcacaacatctaaccccaggtcctcagaaactgtagttaccaatcagaaataagtggagaatcaaattggccccttgtttttgcacttcagcagccgtttacagtcaactgcttgccacttgggctatgggagacattcccttcagaggaaataatgaaattcctttgaaatgaagtctatcggtatggagtcagggagtcagatttacatagtgggggaagtagctccttcctgatgtctaaatgaatgcagcagattctactcagaaggcagtgtgttgagtgatgaaggagctcttgccaaactgaaatgccacttccagggacttgagcatggaatagaaagtgactcgatggggcctgttgccagtcagaagccagcatattgtgtgggtagctctgaattttttgctggccagagtttactgaaaacaggaatgaggactcccatcgaccattttttgtgtttttgatgttgttttctcccctactatctgtgagagtggattaatgacatgtgtggtttttttttcttttactatctctctcttaaaaattaagggaagttcttccagtgtagtatatattaatattggagagataagcagggcagagaggaccagatttaaattcgtgacagctccttctggaataattttgtctggaaaatgggctgttttaaaatgtggtgggggagaaaggggcaatacatgggaagggatcatacgtatgtgtagcaaaaggtgaagaagcagacttactttgtaccaggcatttacccaaacactttgcatgaataactagtcctcactattggccttgaaaagtgtttttttgttgttgttgttttttgttttttttgggttttttgcttttttttttttttttgagatagagtctcactctgtagcccaggctggagtgcagtggcacaatcttggctcactacaaactccgcctcccagattcaagtgattctcgtgtctcagcctcccaagtcgctaggattacaggtgtgcaccaccacacctggctaatttttgtatatgtagtagagactgggttttaccatgttgactaggctggtctcaagctcctgatctcaagtgatcagactgcctcggcccccaaagtgctaggattacagatgtgagccactgcgtctggccataaggtctttaattgttactgaaagtccctaatttttacagtaaaaattgaatcatcatcatcattgccactgtagaagctatgaaatcacgtgggcttggtatggacaccccagttagctgccgcatattggactgaaattatctgctaccaaaggcattagcttgctggtctatttaaaaatctccattatggagatcctgctctgtcccttgggtaaatgcttccaaaatttagccttggtgacttgattcccaaaaaatgttttccaagatttaattcaacttctttcattccacgtttgattttcagctttttccctcccatcgtcttcatagacaaatggtcctgaatcttcctcatgcacttgagtaaccttttttttttttttttttccaaaaggctgaagctatttgggctatgccatctctttggacaatttgggttcttgagaagttttgttttctgaatatctgatagatttatttatcttttcctttgcgtcctctaaaatagtcacagaacttctagagagtgcactccctgataggaatggtagacatttttatttgtttgcttgttttattttgcaacatgaaggactccactcttattccagcagaagaggaagacaatgacaggatcccccatgtggatcagtaaggcagttgtcctgtgaaacagtgccgcgtggcaacatgttcagcctttttttttttttccaaagcttggccaagctcccaacagaccagcattttgctaagagtcagacagactacttccactcttattttttctgcttactagctgttttgacttgggcaagtcatttaacctttctgaatcttgtttatctcctctgtaaggtggagatgttaattttcctcctcccaaagttgagaagattacatgaaatcatacctggcaaataatataagctcaatgaatataggctattattaattataattactgtttcatcatagtcttttaggcaagaggaatttgagaagttgagtgtagttggaaataagaaaatttattgcttaaaacatttctgtaaagttaaatttttcagatcttaaatgggcttttattgaaataatctgggtgaacaagccttaatggtaataagtccctgccttaggaatgtctgtggagattaaagattctatacctcttctgttcatgtgtttatttttacagtttgagggattgtttaactaaatggattcggtagaacatcagcttacaaaaatgagtttaaacttcatttcgtttaagcctaaagaagccagtaagtcaaaactattaagtcatctttcctttccttgaatcttcttgggcttttgtgctagccaccatcttgccaagcagatctcaaatactaagccaagtgttctcagatgcgtcatcaccaagttactgtagggtgtaacaagagcccattgggagcttgacctcctggagtcttttcattcttgtggactttagtcagagtcttcacaagatcttaaaagcttcagggccctttgtagcctgggctaacacctcaacaaccaatagatgtatccagggcacttcatctccaggccaaggctgggtcccactgctaaccttcaccttccctagggctgcctgggtgtagactctgctgggggatcttgaaggaggaaagaatattctctgttgttggaagggtcaaagaagatattccagttaagatctagattacaactggaacaccaccgttaagattttctctggtctcaagtggaaagcaatcacttgcgagttttcttaccatacgaagcagagtgagttgctatgagggccattctcagagtgagaaaatgaactcatgggtgtggccacccagtaggcttctcagtctggtgtgagagcttggattgcctaatcgcccaaaggatgtaaacttgtggagaggatcctggaagaagagaggcaactgcccattcctttcaaatgtgattctatgacccagcctgtccctgtattgcatagttctcagaaatggtatgagagtgttttaagggaaatgggccatctccttttcagaggcatgcacaaacaatgaaactcaattgtattttaatttattgggctaaaaacaaggaggtttaacagctaatccagacagaaagtgtcttctgcaaaatcaatgaacacacgtgtttaagtccctatgtggtctgtgaggccatatcaactgtacgtttgactcagcctttagtgacctagcctgcttatgtgaccatcatggcagagaaagagaaccagatacagcatcccctctcttggtctttggagagcctggggtgttctcatccctgtgatgtataaaatgtggccattatcatagcagaagttgtttccagggtaggcagaattagattcttttttaagggagtaaggaactaagttttcagagtgaaaggcattttgcatattattttgtatacagacaggttctgtataatggtagctgttaactactactaagttcacattccttctatgtgaattcccatttatttttttttctgacggggtctcactttgtcaccaggttggagtgcagtggcgtgatctcggctcactgcaacctccacctcccaggttcaagcgattctcctgcctcagcttcctgagtagctgggactacaggtgcatgccaccacgcccagctgatttttgtatttttagtagagatggggcttcaccacgttggtcaggatggtctcgatctcttgatctcgtgatactcctacctcagcctcccaaagtgctgggattacaggagtgagccaccgcacctggccttatggacttcttttgtattaaaaattttaaggaggaactagatcttgtattccaatttggaggtaaattgaatggcctcttccataaatcctggagaaatattgtgctgggttttgtgatagaccattgatgagaattccagagtctggcaagaatattaagtagttacctttcctgtgatttcaagcctcctgtccccaccacggaaccttaactctgcactgtatttgtgcatctcgtttgagatgggtgggatggcggaagacatgtggaagccacctacacacttttactgtattcctgaatagtacaggatattccagtatgttagagattggaaaggagggtattcagtaatagattcaggggtctccagactcatttcagaatctggagaaatgtatttgaatagtttggtcgggggatccttggggccaaggactttgcttgccactgtgcctgaactttctggcacacagagcacaatacatattgatcaaatgagtaaataaatgaattcagcagttttccatattaagcatttagttccatgtttccatatgtctatctttgactactgatttcaacttgggacactgcagtctcttcaagaagcaagaatctttcactttttttttctcctgatttattcttcctgtttgtgtgtgtgtgtgtgtgtgtgtgtgtgtgtgtgtgtgtgccatttttagaccattttgaagtgtttttttaataacaggtgtattgagatataacttacatattacaaaggaaacccattcaaagtgtataatgcgatggtttctagtatattcacccagctgtgcagcaatcttcacagtgtcattggtgcaggaaacatgcaacaccacatggagcttgttgccacaaagatccaggctccaatccttgtgttcaccacttacaagcttatgatctttggcaagtttcttaaattcttgaggccttcgtttttcccagccgtaggatgattcgtcacccatggggttgttgtgagaatgaaatacagtgttgtgtattgggcagagtggctactcagcaaactgtgtttccctccactccgtgacccctgtacccttcagctgctggaccgtgcaggattgttagaagttatgtaggtggctctgatctgtgatattcctgaagcaccctccctgcctcagaagcagagagaaagggtcctaaagggacagtgcaactcacccaacaatctgcccatcagcctcagggcaccgcccactctgggcacggcgtcaccctggatgtcctatttcccaccagtcagctgtccccacttatttatttttcacagttttatctcagtgggtttcacctacatctcagaaaccctcactcccacctctgccacacccactcaggtttcaataagtcatggtctcttgttttcagtggtttctttccccactgtaaccctttttggaaggaaggttctcaactctgtacatttttctttgcagtcataaaatattaatgttagaaagaaccctacagatcccattcaactccttcgttaagagagaatgaatgtgaggtaacttggtcctgtggtcagttggtagccacagatcaaggctaacccttggggcatttccaatggatctgtagagtaaaggaatgctctggtacattctcctgccccactgacctagggaccggattgccatctgaaggtttgagttgccatgttgactcctctttccgatcctcttcatcctgtaacatgaggataaacctgtgattgttagtgttcgctcttaaggaatgggatcagaagctttgtcgtgtgtagcatgcaccgtggttatgatattcacgttgtcaacattgtttggagaaagtggaaatagatttcatcctgataatctgcacatttggtctgaatctcataatttatctgggtttcccgtttcttagtggagagtgccgacattttccaggcagctctggcttcaggagggatctagacccaggggatttggagagaatttgttccctgtaagttaccccgtggctaaatggatggtatgattagtgaaggttttgtatcaagaccctgagcatggtggatggagagggtggagggcggagaaccagaagacaccagttaaagtaagaggaaaaaaaaatggagatgtcagtaagccccagaatttcttttaattaatttttagatccatatattaaaaaatccaggccataatttctggtgcaagccatttagaagtagcaataccttcttttagaagatattatgtaatgcaagagaactttctgtctctgtcttctctcactcacctccctcttcctcctcccacttaacctccccttctccttcgtgaacccagtgctaagtcctcagagtgcacggggctgtgtaggttacaaattcagccccccagacaagcaaagagtcaaactaggtgttttccatccaaatcactgttaagggtcctaatttaaaatgaataaagcctttcagcaggctccatgtttccctaaatcaatttgattttatgtaaacatttatctcttttgcacttttccacctaccacaccattcatataataatgccttcatgaacattaatgttttcaccagatacattttggagcggggagtgggggtagtctaacacacacagaacacattacaaggagcacagttgtggcaaaactttccagaaatcaaggactaaatgagaaaaagccctccatttgggtttagcaggggaaaaatgtaagtcgtaaattgccgctgggagtggttgagggccagtgtggggtgcagcgggggctattgttcagaaacacacacaagtgggaaaaggcaatatttgcaagcattgtgagtgtccgtggctgactctgctacgagtgtacaaacggaggggatgtttacccttcaagaaataaaatgtttgaattctgatcagtctttacttacataaaagcaattctcctttctaacgcactctgacgacccgggcagagatgctactgccgttcagaaagcagcggcaggttgtgaatttgaacactgaggtcggacagccacgcacaacattttctctgccttatccttccgcaggtctcttccataaagaccccaacacctccggggcacaggaagcaaagcccaacctcccacccaccctataaaagattgaaagagagaagtgaaaagcagatgttataaaatcatgaaaaaaatatttagctgttgctttcaaattcacactcaaccttattcatgggagcatgtggccaaatatttccagcaaacagagtaaaagagcctcaaacacagaaaatactctgaaaagccaattccccttctctcctcctttatcatttactgtttatctactcatcagttttttaaagtgataaatacatttaattggagagctatctaattcttttgtgtgattgttaaacaaaaaataaaaatcagaacgtcgcaatgagaacatttcaccaaccattgctttagaatagaatttttggaagcattgttgatttctacttatttttgtttgtaaatcctgaggaaaatgtatatcttttcctttaaagttctaattcaagacatggatgtgagagttctgaagggactttgggactgcggtaaaatttcgttgtcatagtaacagaaagggaaataggcctagctcacctgggactttaacactgcaaaagctggattttttttttttttttaagggaaaggactctgcaagtgaaataaatgaaaaacttactgtattttgaaacaaattttcaaacattaactaggtgagttgctggaaaggccacttctgccatttttcttggttaacgtagttgcctgatgaaagatgcccaattttaaaattgcacagataggccatttaagagagaatattggcttcaagaaatatatatgacaaatgctaacctcagaccatgattctgtgctttcatgtttctctgaataatctatacatgaactgagaggatattcacacttcttattaatcataaaaactctggcatatacctgcacagatggactttgtctttggaagataacatatcattttctgattttgtaaacattagttgaatatatcaggccaccttcacgtatgagcatgaaggtgtctggggccagtggagagccacacagacgagacgccctgggattctggggccgggtcctgccatttttaaccctggagcaagactttctgtacagcaggggtcactgctgcatttgaagcctttttaaaaaaattttccagaacgagtgctctacaaactccgggggccagtgtacaaaccaaagcccaccttgtgaaccacttaacaatcccccacagtgatggggaagcgggtgctgggcttgagattgaaaacatccaaatttgcaaattgcagagggtcagcagtgttccttcacaggcagggcaggttgaaattccccagatctgaaatagaatcgctgtcaaatcaaatctaatggaatgcagctatattctccctttaaaaatgtttactgaaaaatgtaacacatcgctttctcttcacagattctttttaaaatttttcctcaagtgcaatcagaattgtttgaaaacagcaggaaacccaagggacatgagacggtttcaggtaaggggccctgcagatctttcctgttaaataagtcatcctgttttctctctccttctcactctttttattttctttttctttaaaaattactattcactgctactcctaacaataaaaaagacaatggtaaacgatgaccctcagccactagcattgagagtttcttcatcttgtagtgtttaagctttctgcccccattgccaaagccctatggggagaggcaccaaccggtgctggagatttgattttcagccctcgggctgcccactgcacacacagctgcccacagcaggaaccatgttcttgatattcagccaccttgggatttttcagagcagcttctctgtattttctgcaagcaacagctcctgtcttcccttttccaccgattaactattcagtggtcgctctctgagccttctggaaggcagcagcccaagcagcgtggtcactttaagatcgcagcgtgacaacaagacccacgggacggtgacccagctgcctggcagttaaatctgccaccggtttcatcacccttgccactgatgtactgaggagacgagctaataaaaacagagcgaggcaaagtgtatcaggctggagacgaaagcaagagcagctcctctcggcccccttccttgagctttgaaggacccatatttaattcaccaaatggctttcctgccactcacaccccgttctagatgtggcacctccttttccatagaaaaattaaaaacatgttaaacgatagtatgcaagcttgagacttcaaaaagtaaatccttgcagccatgagagagatggggaaccttagcctcatgtttcgcctgagacaagcgaggttctggaaggttaaataacttgcccctaatcacagtaagtaggtggtaaagcccggagccaggagccgggaggagttgtttgatcaaactctttccagcacactgtgggcatgcgacacgttgcagctgctaggtttatcttttgctgttgtcttcttgaaattctgaataattttttttttttttttttttttttttttttttttgaggcagggtctcactctgtcacctaggctggagagcagtggtgtgatcttggctcactgcaaactccgcctcctgggctcaagggattctcatgcctcaccctcctgagtagctaggactacaggtgtgcaccatcatgccctgctaatttttgtattttttggtagagatggggttttgccatgttgcccaggttggtctcaaacccctgacctcaggtgattcacccacctaggcctctcaaagtgctggggttacaggtgtgagctaccacatcggaccctgaataatttttgaacaaggaatgtgacattcattttttattgaaccctacaaattatgtagctggtcctgctggagagcttctgtggttaggccacaatcagacagatgtttaggagcagagccattcaagagttaacaggaagatggccatacacaagggctactgagagttactttgaaaaaaaaactagtagtagtattttttaaccccatcatggctatcaatcttgctgtgacaggaacatttttcattacaatacttaacactattaccagcctccctttaaaaagttggagactttttctctcttgggcaggctgtttccctgcctttttttgtttgtttgtttgtttgtttgttttgagatggagtctcgctctgtcacccaggctggagtgcaatggtatgatcttggctcactgcaacctcctcctcctgggttcaagcaattctcctgcctcaccctcctgagtagctgggactacaggcacatgccaccacgcctggctaatttttgtatttttagtagagatgaggttttgacatgttggccaggctggtctgaaactccagacctcaagtgatccacccgactcagccttctaaattgctgggattacaggtgtgagccaccgcttctgggcctactttcttgtatgaagaaaaacagaaataaaaccagccttcttgggggatcaaacaggaacttcgtgcatggtggaaattcactgtgctcaatattccaaataaaaatgtaaataatttcagtccaaagaagagtaaaattcaaaagaattccaaagtgcctccatgaccaaagcttagctttatttctagaagatacagaggcagagaaaagagagttggcagtttggatttttattccatcctactttctaccagcactttcaaagagttttaaatttgagaatttgaggatactcttgtaaatgtgaagaggcttccattgtaggagaatgccttgtcattttctttctcccaaagtttaggaatatattcacaaagcaaatgcatgctaatatttcctctacttctttagttatttacttaaatggggttttcatggtgcctgagtttttcattggcatagaataaatattgttgatctcaaaatgatatagaattctcatcctatgtgaaagtatttgacttttgcaaagacaagggcaaaaagaattgtttagactttgtggattctctgattgtcttatttcaagggtagagctaaagtcaactggcaatttgtttgcattttttactgagataaaattcatataacatacaattcaccattttaaccatttaaaagtgcagggtccagtggtttttagtacattcaaagtgttgtacaaccagcaccactatctaattccagaacttttctattatcccaagaagaaatctcatgtctcccagttcctgtttctccccattcactggcaaccactaatctactttctgtctctataggtttgtctattctgggaatttaacataaatagaatcatacaatatgtggcttttgtgtctgtttttgtctgttagcataatgtttttaaagttcctctatgtgatagcatgtatcaatacttcattcctttttacagcttgactattccattgtatggatatatcacattttaaaattcattagtcagttagtggacgtttggattgtctcactttttggctattacaaacaatgacactgttagtatttgtgcacagtttcactgtgtgacatatgtttttaattctcttgggtatacaactaagaacagaatttctgggtcatatggtaattgtttctttaagtttttgaggaactgccaaactgttttccatagtggttgcaccattttacatttccactggtaatctgtgaaggtgtcaattcctcgccaacacttgggattttctgttttaaaaaaattctagtcatcctatgggtgtgaagaggtatctcattgtggttttgatttgcatttccttaatgattagtgattttgagcatcttttcatgtgcttattgctcatttgtatatcttctttgaggaagtgtctatttaaatcctttgcccattttttagttgcattatttgtcattttattgttgagctgtaagagttctttatatattcaggatactggctccttctcaaacatgtgatttgaaaatattttctcctattccatgagttgtcattcactttcttgatagtgtcctttggtgcacaaaagaattggcaatttttatactgtacttagattctactaagaatataaccttcaatgaaagctctctcatagagaaggttattatgaagacaggcttagcaatatgctatcatagtcaagtaagaaacttagttcaggttccaaatatgaaacaaaaccagagagagtgtatactcatggtggtaggacagtcatctgaatggatggtgactttcagaaattcctagagtatgtatctcactcagaaggacaaagacaatcatttagagccatatacacaattccttcaattctctacttttgtgatatgatcaaacataaatttaatatgaaggattctttcgtgaggatttgatctgaatggaatagaaatatgaaaaatttctacccaaatcctgaactccataaaactctcccccctccttcccttacccccaaacactggtggaacctggattctttttacaaaaatcatccaatcagaccaaaattgttacatcaaggttattttcaagcttgaaccaatcctctctttaatttcattcaagtcctaagtattataggacataaaaaatactgaaacacaaagggttttaacccttttaaccctttttaaccttttttttttttttttttttggcccagacccctttaagaatctggtaaaagctatagtctgtatcccattgaaatactacgtttaaagttttaattaaaatttcaggggtctccagaccacttgaaatatctcaagcttccatggacctctagtctaaagaaatggaattcatttaaagcccaataggcatccttcatgtaaggtaacctttaacagtggggatctgtccacttaggacttttcctggtgatctctcatccactctcttggcttcaaatgctctctgttcctggatgatttctgtatccatattctcagacttctttagagctgcaggcatataatgctagcttccttctgggcatcttccctggatgactaatgagcacgtgttcaaaacagaactcactgcttgttccctgattcattccctcctctttcattgtcaaagtgtcgctgcctcctcctaagtatctattaaatccacctctctcctcaaaagctgccacagcccctgtctttttttttctgtttttgtttgtttgtttgtttgtttttgagacggagtctcgctctgtcgcccaggctggagtgcagtggcgcgatctcggctcactgcaaactccgcctcccggattcacgccattctcctgcctcagcctcccgagtagctgggattacaggcacttgccaccacgcctggctattttttttgtatttttagtagaaacggggtttcaccgtgttagccaggatggtctcgatttcctgacctcgtgatccacccgcctgggcctcccaaagtgctgggattacaggcgtgagccaccgcgcccggctgtagcccctgtctttattcctcccctgtctaacccgtcctcagcatgaatgccagagttacctcttaaaatatgtcagggtgctaggcacagtggctcatgcctgtaatcccagctcttaggaaggcagaggcaggaggacaacttgagcccaggagtttgagacctgcttggggaatgtagtgagaccttgttctccacaaaaaggaaaaaaaaaaaaaaaaaaacccagacaaaatgtcatgaggatgccccatttaccctgatgtgattactgtgcattgtatgcctgtgtcagaatatctcatgaaccccataaatatatatgtctgctacgtatccataaaaattaaatacatacacctactaaaatgggtatcaactgtccatggacacaaagcctggatttaaaaaggcatggctgagaaggccactcagcctctgcctaccaggaaaacctgccatgcctgtcccagaagttctcatctgcctgctgctcaccacacacccatctctgatttctgttccatctaggaagctttccatatgttcacccctctgcctgggaacccttcacccctctccaacttgtgactccttttcatgctttaaggctacagctgaatgtcaccaccttagtgatgcattttctgactcttccaaatggagctgttggttcctgggtctgtgctgacacacccttctctgcaggcccctaccctgccagttatcacatcatcttgcagttcttgtttgtctgtccaatagactgtgtgctgcttgaaggcaatcgatatgttttatttatttttgtatgtattgccaatgtctagcataatggcaggcattctgtagattattattaaataaatagattaattattaaaataattgattaaaataatggattattattaaataaatttttaagagagcaaaagaaaaaaggaaaaaagagaaaacaaacttaagatttccagggctcctcaaagtatctaaatccatgggtcatgcatgcggaaaatcacttctgccctccttgaaatggaacaattaggtgaaacacccagattaacagctcaatgaaggaaaagaaaagaaatgtatgtctagtttaagctgacaggcctgttaagacataatgaatcccattctttatttctttctgcttgtgtgggtggagtgaaggcagttgtaaaatccaaaagaaaatcaagctaggaagaggaagtcaggcacacggtcatttcccacattcacattctaaaaatcactaggaattgacaataatttagagcttattgttgctaattcactgtcatagataggatggctgggtctattccaagtcatagtgaaaacatagaggtactcattcatttattcatgcacccagccaatattactgatgaaattctgtgtgccaggcactatcctaggtgctggagatacagcagagagcaaatcataaaattcctgcccttgaggggcttgcatcctagtggaaggatataaaaaataaatgagtggtttgcatagctcaagtctgcttctctgtgacattcaggtgactttcctggaagcagtgggcttccgtacagtgccagctgtgtttgtggtgcttgctggaactcagcagcttggtcaagtatagatgtttgtggagctaaatgatactcaccattatagtaacagtaagtgtggatgctcttatgaatagttttctgagctttccacagcatcacctattataggacacaaatgtcagcagatctacttgagactgggaagcttagaggcctgaatgctgagtttttaccctctgcctcaaaaggacttcattttaaaaatacatgatcattggggtgttctctatcctgtgggcagcacaagcgtgtatattaggtcatttcagatgtagtagcattctggaattgagatccttgacacagtccaacctcaaaatcattaacttttttttttttttttttgagacaagatgtcactcttttgctcaagctggagtgcagtggtacaatcttggctcactgcaatctctgcctctccagctcaagccatctccccacctcagccccttaagtagctaggactacaggtgtgtgccatcaggcctggctaatttttgtattttttatcgagatggggttttgccacattgcccaggctggtcttgaactcctgagatcaagtgattcacccacccgtctcaacctctcaaaatgctgagattgcaaatgtgaaccaccacacccagcctaaattttttttattgatatataatgtttgcaatctttatggggtacatgcaatattttgttgcatgcattgaatgtgtaataatcaagtcagagtagttagggtatccatagtcatccatcatcatgagaattgatcatttctctacgttgggaatattgcaagttctctcttttagctggtttgaaatgtacaatacatggttgttaactgtagtcaccccactctatcaaatattagacgttacaccttctaactgtatgtttgtacccattaaccaacctctcttcatcctgcctaatcatttttttttagttttctcactttttttattttttattttattattattatactttaagttttagggtacatgtgcacaatgtgcaggttagtttttaatgaacttcactctaatcgacagcttacttgtaattaagataaagatgcttacctcaatttgctgaactttcatgagagacccttgggtgtctcaaatttaccccctaaattactccctttttagattaggtccaccagaataatcatttttaatttacagagtcatgctagggagaagactgagatatatgtgcaggtcgtgtcatccttggcctcaagagatatgtcagtagatatggaaagacagatatatttctttttctttctttttttacagacagggtcttactctgtcactgaggctggagtgcagtggtgcaatattggttcactacagccttggtcttttgggcataagtgatcctcctgcttcaatctcccaagtagctgggactacaggtgcatgcaacacaaaaaaccagctaatttttgtgttttttgtagagacagggttttgctatgttgcccaggctggtctcgaacccctgggctcaagtgattcactcgccttggcttcgcaaattgttgggattacaggtgtgagccaccacacctggccagacagacacatttctaatgaaagaaaaatcattccaggagtcaggctggggaagccttcagtgctgagttggttccaggttgcatgcaagcccaggatgggcctgctggaagggcatcttgatggggatttgaagggttcgagggaaggggttggagctttttgaaaacacacctggcgcatctgccaggcctgtgagaaagcaagaagaagcgcccggtgtgggagagaagggaaccaagggcagaaagatctgccggatgggaatggagaaaggaagtgaggccccgttgggactgactggcgtccacagggtggttggatcatgtgagaggcctcgtgcctgttgctgcaacatgctggatgcgacaactgcagaagaacgatggggcaaatgaatggctctgacaaagacacctcgtacacacagctgggcacgaaccattagtcgggtttactaaacgacgtgagagcaaagggcacggctactcatgtcttggaaaagagccaagctccatccagcaaccccttatgatttttaaacccccagctcttatataaaactttttaatggcaccaccatctattttccttaaataaaaaatgttgaatgtttctctcacacccgttggagagggaaacgagagtttaaattaactccaaatggtaaaaatttaatacagctccagctgcctgcaggtttcttcagttcacatctttcagtgtgagagctgctccagctgctctgtgatctcatctaccatttgaaatccggagtgctactgagcagcagttttaaagcacataatggaaatcacttgacttatggcctctctgatcagcaggtgagtccattatctgatgataaaacaaaccagatagtccgagttaagaaatcataattatctatttggagtcagaaaaaaaaaaaaaaactgtggagggtcggaggatctttctcttagtccaatgatgtaagcttggggaaggctctctggagtgacttcaggcttttctctgctgttagaaccttctgctgcctccacccctaaattttggtgtcttgaatggggacaagaatcaggatgacagaaatcttgactgactcacccaggaaatgagttttgagctctttgtaaaagtataaggtgagaaatgaaaaccagtagttgcctgggaaacttttgggagaggatatgtcagactgcagttagctggaaacacaatctaaatgctcaaatattttaagggactctaatttggacacaaacctgccgctgaacccattccaggactatcgaatgcagaacttcctggaaagcaaagtgttcttagtcctgcaataagagtgcatagttcctcagctgcttccagggcctgtgtgctcctgatttttgataggccacaggtgattcaggttgtccctggggctacagcttcctagacaagaatgcccaagccaaacaaagaactgcatcaaatatgttatggctcccctgtggctctcaaaacttttgctagtaaaatattgcccttgaccgtaaccatcccacttggcacaaattttagttgggaaaagtaatgggttcaatggaataaaatgagctagggtgggagtagcaagtatctgtggcctttaagatgaagagacattcagtattgcaaagcagatgaatgatcttcacactcctcaatgacatgaaaaactggtttttttttttttaattgccactggatttctcaattgggtttttaaaagtaagctctagaaggtgtttactctaaagccaaattagccaaaatacaccaacggagagctcttgggcatactacttcctttatgccaattagaattcttcttaggtgccagaataatcatctcagtaatctcaagttgtgtaactcccccagttcttcaaggtctgttcttaaatctcactttcttgatgaaaatggctgtgatagccttcaatttatgctgattcttcccagcgttgggcccctagagtacacagtggccacagtttaatcctcaatgacagattaccgtgcaataatattttctgattatgtctagtgtttgctatgctttgtccaccgtagggtgagctccttaaggctgcgacaatgtttcctataaacttccattgcatgtagcagagcgcctaggggtctcaataaatacccagtgactgatggaaacacagtgctgtctggttccttaagaaagtatcttctctagttaaaatgaaaaaaataaaatcaaactatcatttgacccagcaatcccattgctgggtatatactcaaaggaaaggaaattgttctacccgaaagacatgcacatttgtatgttcattgctgcattattcacaataacaaagacatggaatcaacctagatgctcatcaatggtggatcagataaaatgtggtacatagacaccatggaatacttcacaaccacaaaaaagaatgaaatcatgtcctttgcagcaccatggacacagctggaggccatgatcctaaacaaataaatgtaggaacagaaaaccaaatactgcatgttctcacttgtaagtggatgctaagcattgggtaccaatggacataaagatgggggtaatagacactagggattactagcagggaaagaaagggaaggaggagagggctgaaaaactacctattaggaattatgctcactacctgggtgacaggatcattcatatctcaaactgcagtgtcacacaacatactcgtgtaataaacctgcatgtatactccttgaatctaaaataaaagttgaaattacacaagaaaaaaaaaagtaaaatagttaaaagaaattttttaaactgagtaaattgaccagtgttggtttagtttatattcttgtcatcaagtatatcagtttaaacttgacagaattaaaaatatgtattttttttttaaaaaaaagaaaagagcacgtcttctcaggagtaatgccattgatgcccagtcccttctctctgctggagcaacccagaacctcccacatctgtctctatggcagtcaactctgtgttctcctgtctgggacttgattcttcactgaacagaaaatttagccttcgggaatatgaaacagccattgctgagaattctgggaattccttttaaagaaaatgacaaaatccatgcttgtggggtaggtgtttaaaggtaattttggagactctggagtcccataacaaagaagaatctgggccttaaatctggcttgaaaatatgtgtgccaagaataaagtggtagggcagaacaaactgcagtagcccatttgttagttgttagcctggattgaattaatggaggcttagacaaaactgtgtcattagattcaccttgtccatgatgagaattcgggattgtgtaaaaacccgacgtgtatttctccttgcaatatggaactgcagcttggtcgctcgccatagccagaagtctgtcttgattttctctgtccctttaatggtttctctgtccctttcctccttccacaggtggaaaataaaatcccacataacagttatgctttgggaaagctgaaataacatatatggcaaccgaacagttataagggaaaagcacttcatgaatttaattccatttccagatgtaaaatgtcataaagaattttttttcccactcttggcaaaataacaggaattttcgagaccattttatttagctgagtgtatgcacattcataagtagggtatcagagtcttcaatgtggagtgtgctataaatgcgatgtgttatagctttactgagattaaactaccaaaggccccacattcagctaggaggtgcatgaccctcattgaaagggtggggaactgtgtctgactaatggtagaacttggtgtgttttcaaagcaaagactctggcccatacggggaggtttctgaccagtgtaattattctctagtgactgcagacattggaattgtcgtctgtttcaaagagcagatcatttggtgattccacacatttttcattttgacttctctttttcttttagcctctttgtatgagacttagggtctttgtagaaacacctgggtaggagctgaaaaagcctagctgggagtagggcccaactggccattcctttggcttatgtaattcaactaaatcatacagttagagttttgagaaggataagtacttaaaacacacacacacacacacacacacacacacatacacacacggtgttccaaaaagccaaggacattttagagaagggctataaaaataaccaaagggtaggaataagtcagtttggtaaaagtctccatggcacatgctatcattctgataactaaagaaataactcctctattggaaaattagctgttcaggcagattaacggatgtgtccacctgaagggtgacccccactgtggccttttactagcaggaaagggctcctttacaactcagctcctgctttgtataaattattggagtgagggacatgggagaacttttggggaatgaaaagaaaaatagaatttgagaaagccgatcggttttcttgagaactggtagaagactgctaacgtacttgtagattccgttcttaaaactttcttgtatttttcatgggaagatacagactttttattcatgtttctatttctgtataaccaactaacattgccatataattaaatgatttaaaatggaacctaccaccgtcactctccaattggtctgtttattgagttggtgttactaaaaatgagagatcacatcaaagcaaaatagggaatggcagaaggcgaaaaccacttttatttagaaaaaaatgcaagcaatttcaattgatcctgatttctctctcagaaacttgggttaaaggtactttgtcctaaataaattggttgttgcttttgcattgcaatatatcagttgaggagagctgtcatttaccatgacttagttttcagatctgcaggctttgagctgtaatacagatgtatcaactctaagaaataaatgaaaactgtcaccagtgtcagcagcagaaactgggggtccatcccacacaaattatggacatctgtattcctaattggcattctttagggccatgccagcagaatggcagtgccaatagagtgacagccttagaaaagacgcgttatcaggtctaggtgacaggagacgatgaggcatagaagttcctttgtatggattactatccgtatgtttgctaatataatgctggcgattttcagtttcaggcacctccgaatggcaccttttatccatactacatttgcttcttttaaagcagatcagttgatcttaggtgaataagtggtattgatggttatatgatcagaagacccttggcagagatgcatacaaatagttaacaaggtaatggtaagaaatgttgaccttgatttgtttagctaagatgtaaagatttttgaaggtcaaaggtgtccttgtgtagtgttttggagtctaactgtgcctgaccctctaacattaagctgctgtggcctgcagttttgaagagtgaagcaaaccagggggaaaacgagaagggggagagaacaggaaatggagtgaggtgtttcaggaagttgtcaggggttgactgattgattccagatgggaagggtcagccttcgtgacccaggaaatactcactaggggaaagaagttggcttgtggaaggggaaggcctgggagtaagatgatgttggaatgcgcattccacttcctttggtcctaaaacgttcagaaatcttaacttctccaaatagacgaatatcagtgttgtcactgttcatcagtaaacagtgaaggaacttaaatttgaagttttgactgtaccaaatatatcttcacctgtataatgtagttcattcttccagaagtaaagcaaatgtatgtaaaagtcagtatttaagtgtgtgtctctatgtatagaaataaccaccaaacaggtctggtttcctgttgtggagtttatgaattaaatccatcacattttgaaaattcagttgaattggcaggctcttccagctacctcaccatctgagatatttggaatattaaaacctggaacttgcctcatatctatacgtacacatgcacacacacatacatttggacataatttaaaatcttgtaataaattttatggacactgacataattcaggttaattccctagctgtcatgagaggccagcgtgagccagcaagagattaaaatttatttctattgttaatagaaaataatgaagtgcatctgaaccatcagggtatgtcattcgggaaatgttcactttggaactaagtctcactccacccaaatggacaatgatgaaatcagctggcttgtgaaagccccatattttgtggcaggaatgtgtggggagtattaatggacagtatgacaaggagcttgtggagtgaattaaagcagcctcagagagaaggctctttacctccacgtaatcctcagacagggcccaggttccccttagtgtgcctaggacagctcattaagaattaatgcccatggctgggtgcggtggctcatgcctgtaatcccagcactttgggaggctgaggcgggaggatcacttaaggtaagaagctctagaccagcctggccaacatggtaaaaccccaaaaatacaaaaattagctgggtgtggtggcaggtacctgtaatctcagccactcgggaggctgaggcaggagaatcgcttgaacctgggaggcagaggttgtggtaagctgagatcaggccactgcactgcacttcagcctgggtgatagagcaagacgctgtctcaaaaaaaaaaaaaaaaaatggaagaattaaagcccaaagcaccctctccttgttttctgttttgttttttccagagatgacagttatgtctttgaaaatgcattcacacacacaatttataagagtggtttgattctttcttctctctcttctcctattattttcggggggtaggcaatacaatcttcatgttcatcttaaccttgcgaccatgaggctctgcctctcccttcgactgtaacatgaccttgtgttttgctgagatcactttgataagaacgtgagcacttacggggagtgatagatgccgccatcttaatgtttgccactatgataggaactttctggaaggaatttccccagattctaacatgttaacatggacacaattgaaaacagacacagcgctagacaggctgtacccctgaattgtgagcaattatattgataattttctgaatgacaactgaggttcctttaagtttattctttgaatctctgggccctgtcacatattagaaacacagtgaattatctgttgggttggatgactgacacttattcatgtaaaattttgcatatgttaccaccatgttcaagatgtgacactatatgagatgatttgtggactcatgggttttagggattttcccaaacctattatgctaaaaatataacttaaaaagatgtcatcaaaaaactcttcagggcaaagaaaaaaatcagaagagtattgctttgctggtggtgggggtaggatggactgggagggaacacaagatgactttttgggaagatggaaatagtctacttcttgatcacagtgtaaattggacagctaagatttgtgcatttcaatgtatgtaaattttacctacaaaaaaacccaaacctgtgattattatcattgttgagtagggggttgggagtgggtggtggtaaacagtagttcccccgtccactttggaggcttcactttctgtggtttcagttacccaaggtacagtacaataagacattttgagagaaaaaaagagaagccacatttatatacttttatttcaatatctttttataattgttctatttcaaatattattgtcattaatgtcttactgtgcctaacttataaattacactttatcataggtatgtataggaaaaagcataatatagggtttgatattctctgaggtttcagacatccactggggtcttagagcatagacctcttggataaggggtctactgtagctgagatgagaatggcgatattttgacaattcttgaagctgaatggtaagtactggggattcattatgctatcctgtttcttttgtttgcttgaaattattcataataaaaggtttttaaaatgctgcctcattccttcatattcagaggtaaggtagggctgggagctgtggctcacttcggtaatcccagcactttgggcggccgaggcaggtggatcacttgaggtcaggagttcaagaccagcctggccaacatggtgaaaccctgtctctactgaaaatacaaaaattagctgagcatggtggcaggcatctgtaatcccagctacttgggaagctgaggcaggagaattgctttaaccctggaggtgggggttgcagtaagctaagatggtgccactgcactctagcctatgcaacaaagtgagactctatctcaaaaaaaaaaaaaaatacgacaggatcaagccccctgccctccatttaataagtaaggaaggacaattacaagtagaatatcaactgttttaatttgggagtagacaggaagagtcatttttaaacacgactcttcattttgtacctatttagtgcccttcctcaaaaggtctacacatgtttgtgagtatgtatataataagttctttttttttctcaataataatggccatgcgtaactgatgtgaactgagaaatagacccatgtctagggtggttcgtcttctgggtcaagtgattcggtgggagctccacccaggtccactcccttctgctatgcttggccagcctttgctgatatccacctctttgagcttctcccccacccctgatctgcagtacatatgctggagctcaatttgataccagtctttgtgctacttgtttcctgtgttaactatgattctccagccagaaaataaactcttttaggttagggaccatgccttataactgttggtacctatttcctatctgcctcctcctaggacctccccctgagcttagaccatgggagaacctctgtgtgtgagtaatgtcatctgtcttatggtctggtcaagcccagcatgggcaaagcagttaggacgcaaactcatcccagtttggcacacaccaagcactgtgctgaatcctttatatgtattacaggttgagtattccttatccaaaatgcttgcatctagaagtgcttctgatttcgggttttggaatatttgcattctgtacttacttactggttgagcatccctaatctgaaaaatccaaaatccaaaatgatccaatgaacatttcctttaagcatcatgtcagtgctcagaaaggtttagattttggagaattttggatttcagattcttggactagggatgtgtgcctatatctcattatacctcatttcagcactgtgagatacacattgttatttatatcttacagataagaaaaactgagattagaaaaggtgaagtaatttgatcatggttgcaagttaggggacagaagcctgggatttgaattcagctctccctgactccaaacccatgttctgccactgttccacaccacctctcccctcaccctcattagatgctacacatcctctattttcaacactgaattatggcaaccttatcttctcagcaaaagtcgaggcatcgctgccaccactctctactgggcagcaacaccacagacaattcaccagccagcatcccaatgctgggcatgatgtcaggacctgtctgaagtgcaagaacccattcctgagcttgaagaagtgactttccagctggcgtatagatctcagcttccacatggcacaccagctttctgtggtggaggctccactggcggtggcggtccaggtcttttgatagagaaccaggtttctggaaccagcaggcagatggtcattttctccacttcattacatgggtgtgctttgagcaaaggttcttgacaatgcatggatgaagggcagccactttttctgtaaagttttgacataattacagaaggagaaaactctgttgagtcccaagttctgtcccatctcccctttgccaaatggaagtgtggcaaaacagaattttggtgcatttgctacttcatgtgaaactaattccactgcaccccctttctcctttttactttaaatatgcaggttgtgttgtcaacaacggtgaatgtggatggacacgtcctggctgtttctgacaacatgtttgttcataacaactccaagcatggacggagagcaagaagactcgatccatcggaaggtagggctgcctgcgctcagcatagcagacacatgaaattctccacgaatttccttgttcgaacttcaaatttatgtcttggagtcagagcagagaaagtacacagaacaatgtgggtttttttttttttaaacgaagttgtaaacacagactccagcctgctccactgtaaggcccacacgtctaccagcccgtgccaagtcctcatgcctcccactctcttccatcctgttctgtgttttcctttttgtgagacgggcatttcaggcaaacataggcctatgacatcttagttaaacaggaacattgcagtgccagacatgtatgaataagtgtcacatgtgcccttaaacagattgtaggcaaaacaaaacaatgctcagaatgaaactgacactaattgatttttgtttgcttggacaagaagaaatcatggtctgttctgggtagttttccaagtgcattaaagtaattagaaataccggtaactgttaaatttcaagttgtccaaaaaattaaagtatatcgatgaagataactgacaaatctaagtaaattccattttaattattccccttctgtctgcactccccaactcactggtatagaaagaccttataatacagaatgttggtcaaactaggctactattttagtgtgatgttttgttatatactaccaaccaacccccacctcccaccctaactcagccctgaaaatgtatcttgtatcattgtaaacaggaattaatgaactgaaagaaaatgattgaatcagtaaagaatttggagtggtgttaattctcccacagtgggcactgaaaggggagaagaaaatcccagagttcaggactaggaacccatccagtttcttttgactgattggatgtgattgactggctgttcaaagggggctcatgtttttggagtcctgccaaagttctcctctacctttgaccctgtcaactttggaaatggagtgatggattgactttagttatggcctgaaaaccatattgggttcctgttgggatataaagtccagaggcctggagcatatggaagaagtggggaaaatccttcctacaaagttagtagagtgattagaaattgtctcttgatagagctgaaaaaagccttcaactatgatagattttgctttctccccctctctctctctggcccattaacaggccttgtaaatcttaacatcttagggcagaggaggtggggagagaaaggggatttacacatttccagtgtgatcaacttataaaaatatgggcaaaaacaacagagtttttcaaacaccctttgcacaattacctaagtgttttactttttcatacataatggtcaactcattaggctttaatgactcggtgaaaaccaacagccagttagggaatgatggcaagtcaacaaatctcagcttgaacttcttggaatgaccagcagctttcaaaagcagcccatccgcagaattctaggcttcaaccaaatacgggtgtccagccctttgaatgcaaggactttttatttgtggtgtgtccaatcctttgaaggcaaggatttgttttcttatctgtggtgggggatatcacaaaaattatacatggaccttttttgtttgttgtttgttagctcatcagttatcgttagcattagtgtattttatacgtggcccaagacaattcttcttccaatgtgggcctgggaagccaaaaagttggacacccatgaaagaacaaacctgactttttctttcctgtcttcttagctaccccctgcatcaaagccattagcccgagtgaaggctggaccacaggaggagccatggtcatcatcatcggggacaacttctttgatggtctccaagtggtgtttgggactatgcttgtatggagcgaggtaagcagaggcaacaggcttactctgatttccttttgcccaaagattgttttgatctgggaaactagcacaaacaccaagggtaaaaaagcataaaagtcatagtaaatcaggcatgggtttcttaagaagataagtatccactgcagtattatttaaaatggtgaaaacttagaaatctagaattgtaaagtgatggaatgtcactccaccgttaaaaaatgttttgaaaaaattcgaatgatacaggaaaaaggatatgctcacactgtaatactaagcagaaaaaaaacaaggacaacactgcctatggatgtaaaatctagttatataacacacatttatacaaaggtactggaaacataccagatgttaatattgattgtctttatgatgttaatttttaaaaaatatttttctgtaatttcaaaatgttctaaattggatgtgtttgactttcatcatcatataaaacatgacaaaaagataagtgacagtgttaagttggggttggcacttgccagatcaatatttgaaatcacaagcaggataggagttcagcagaggaaaggattccaggggtgagggtggggttggcagcaggaggtgggagggacttggcctgggcttgtaggaaataaaggacctacattggttgagttgagaggaaattccaaggtgggggtcagagagagagagacagacagagagagagagagagagacagagacatacacacagagagagggacagacagacagagacagacagatacacagagacagacagagacaggacagggatgttcagagtgcatttggagctaggagtactccagttagagtagagcagagagaaagaagcccctggggagcaatagtgggagatgttgtacaccttatgtccttggtgatggcttgtctaatgggtattttatttccctgcctgttcattcctcagctaataacccctcatgccatcagagtacagactcctccccggcacatcccaggcgtggtagaggtgacattatcttataaatctaaacagttctgcaaaggagccccaggaaggttcatttacacaggtaggtgagaaaatgattccaagagaggctggcttctggtttgcctttgcgctagttcccagtatctgcactttgtaatcgtcctgatttttctaggtctttttactagtgtggaaagagtgagctgagtgatagatgttgaatggtgatgtgaaggttcacttctcaattagtgttttacttaagcaacttctgcatgatctgggagatcacagcagctcatttcaggaacacatctctgaaaatttaactctgttggaaccatgctgtaaccatcttttatccacatggtcagattaaaaaatagacagttattggctgtaactacattttcttgaaaagattcaagagagttgcctagtgatgttggagagcaattcaaagtattttaaaacttcaagaaggtaaacatcatatattagtcaatatttgttaaatttctactttgtatcaactgctttttctaagagaagggtatggatgacacgtaagacatgatcccttccccacttggaagtttagaaacttttgaaggagacaacggtatattgcaaagaacaactggtgaattcataaatttgaaatgtttggtaattccgatgaatggaatatgagtttcaggaagagagggcttagtgtggacaagagtaatggggtgaggtgccaaggaagagatggaaattgaagaccatatttacggacagggaaaatttggatgggcaaagagagaaagggagaatgttctcactatgggaatcccataggcaaaggccacagggtgaggtgagcacattcctgcaggaccaaaagcttgtctgacagctgtggcaatgcattttgtatttaaactagaacttaccctacatgtgctaggcatgtgtattagtccgttttcatgctgctgataaagacatacccgagactgggtaatttttaaagaaaaagagtttcaatggactcatagttccaagtggctggggaggcctcatattcatggcagaaggcgaaaggcacatcttacatggtgacagacgagagaatgagaaccaagtgaaggggaacccactataaaatcatcagatctcgtgagacttactcactaccatgagaacagtataggagaaactgccctcatgattcaactatctcccaccaggtccctcccacaacacatgggaattatgggagctacaattcaagatgagatttgggtggggacacagccaaaccatatcagcatgggagggaaagaaagcataaaacagcttaaaaaccttatgtagtacatacagtagtcaaattcatagagatggaaagtctaatggtgggtaccaagggttaagggaggagaaattggggattcatttaatgggtccagagattcagttttgcaagacaaaaagagttctggatatggatggtgatgatggttgtacaacaatgtgaactacttagcccaaatgagctgcacacttaaaaatgattaagatggtaaattgtatgttatgagtattttaccacatttttttaaagttaaaaaaaaaaaggagcctggtaagggagtttagacttgacttgtcagaaaataagaaggcattgagggtttctgtgcaacgaagagtaactcaaaggtattgtcttcaaaaaaagaaatggtgttaatataaagactgagttaactgaggaacaaccagaagcaggaagatcaatgaggtattatactttgacagagaaaataaagagtatagagaaagaaatatataaaccaagaaaatatagcaggcatattataaatttttaataatattattttatagatagtgtagtctctcatttgcgctctgattcctactcttgttaaagtgtcaatgtctggctagctatcaattagcagtagatggaaagaggtaatttttaggtctatttattcaaaatttagcctttgaattttctgtcctgagataagcacatctcaggtgttattttctgtggatctatgggagattctattgcagtcacaataaaaaagttactgttccagctccaaagggatatagttcattcattcattcaaactagtatttatgacctgcctgccatgggctggcacagctctaagctcacgggtatagaagggaggaaggtaaagtcccccaacttcataaagcttgtattatagaggggaagacagacaagagagaaaataagtgatataatttcaggtagtgagaagtaagggaaggagagtgagggagggttgggcaggctggttagggaggcctctctgaagaggggacatggagcgaagacctgaatcccaggatggcgccagctgtggagatccatcccctcttctctccttcttcctccatcctcctctcctctccatccacattccctcctccatcgcaggagctcccttgggctgggttttctgtttggttcactggtgttcactggagcagtgcctggcagtccatgaatctgggggtgggggaggtggttgtcccaggtagagggtacagcaagattacaagtgggagggagcctggtgctgttggggaagagcaagaatgccagtatggctggagtggagtcagtggggaagagagtgatgggagatgaggttggaaagtcaggcagggcaaggactttggatgggaagacgtggaagatgttgagcagaggagcaaccagcatctagacaggatttaaagccacaggaccagaggagatcaccatgatatggtggagaagtccaaatatggtgccttgggaacaccagcatgcaggattaaagatgacaggaggaacctgggaaggatcctgagaaggagtggtcagggtaagaagaagccagaagcgtgtgctgtccctgaggtcagttggatagcgggtcttgttccaggacactgtttacatgtagagcttctggtatctctgttgtttcaaagacacccctggatgtgggtgatggagctggcctataaggagatgagtaggtatcataacaaacacattgcagccaatcctgaactctctattgaagtaaagaacaatctcaatcagtagcgcaattgatgtagacatttggaaccaggtgttgtgtacgtgtgtgtgcatgtgtaaaagaggtcctcacccttggccacactttaaattatcagtgcctaggtcaaaccccagaccaattagatatggatttctgaaggtagaagtgtcacccatttatttactcaacaaacacgtgctctaaacacacaaaatcaataatatcagtacacctctatcagcttacagttctagaatgggagatgacagaagttaaaaaaaaaaaaaagggagatggctacagttacattacaataactagattcagcccctaaaataaaaaagggttataggggcactatgcagggagtgactagctttggggaatcagggaaggcttcccagaggaggtagcaatagctgacatttttgaagcgaaataggaatttgccagacagaatgaggaggctgtggttgacagatcttggaaacacagtacctagcaaaaggggagcctatacacctgtgaaaataacagatgttatgttacatgtaaattcaaataattttagagattaagggaatatgaagattaactagtcaaagtcctccttttccagaagagaaaactgaaacctaagcagaagtgatttgctagtaattgcctgttgaattaaagatggcattagaacaaagatgcaggcctctggccatcctgcctggtgtctttctgatgctcctttagcaagtcgtaaaatatctctgttttcttcatgtgctgagacattaacgacttttgcatgacgtgtatatttattgagcagtgcactctgtgctcaacattgagctctatgctcaggctattggagacaagtcaaaccagtgtctcccaccttcctgacattacaatgcactgacataaacactaactgctcatgctctggaattagatacctggactcatagtgtggcttgccttctgaattgttcttgaatcttggggaagtgacttaacctccttttcccccatctataaaatgggctacctacagagctgaggactaaatgatacagtgcctggcaactgtggtgggctggcaaaggtttaacaactggctcttcaggaagaagcagattttcttttttaaatcatgggtttataccatttactgatttccacggtcaaatactctcaccatggcagatttcaagctaccactcaagtagctcacaacgttcctgaaaacttcaccacctgccttcacaagctggtacagccaggtctcttcatggaaagcacctgggatagagagtggatagaatggcccatatcttattagtcaaaaagtggtttattatttatattattcttattattactgaaatgggaaaagtccccttgttcccctcgcagggcatgcgacggggctgtggctcgcttcttcagtgcctcactgttcagacctctaggggagcatgcagacgggcaggctgtggggctctgaccccatagcagtgtctaggggtaaattttacagctgaagccccagtgggtgtgtgttacaggtgctcttttagtttagccttccgtaggcggcttgtgttactcagctcaattagacccctgccttatcacaaggacagagggctttcatattccagggttcttgctttggtgtaccagaagaattggatcacacctgggcttggagaatgagtgcaaggttttatcgagaggaggtagttctcagcagataagggagccagaagggagatggttttccccgggcctctcggcagcccaggttctcctccaactgccccagccacattctgtgtcgttctgccggtcagtggcctgccggtgcctgtcggtgcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatgggggcatgacaggccagggtggtcttgggaaatgcaacatttgggcaggaaaacaaaaatgcctgtcctaacttaggtccatgggcacaggccaaggggtggagccctagccagggaccaggcgttcctctacccagcacttcccttccccacttccatatcatttaaaggtaccacgcccttcccttcccagcacttctgtgtcattaccattagccttatcagtatggagactgacttaaacaaggaattgcaaacctgatgaggactaaaaggagttgtttaggatgctgggaacatatgccaggggaattgaacctccttaaactgagttgatggggaggatttagaatagacaaaacagtatgtgcaaagaccctggggtagacaagaacatgggatatattttatgaacagagcagaaggaatgagtttaagagaggctgtgttcaagctgcaaaggtgggcaggggccaggtcacattaaggcttgttttttttcagctcttcctcaagcgccatgggaagctttgggaatattgccaccatcagatttgccttttaaaagatcattctggctacaatgcagaggatggcttggaagctaggttggatgcagggaggtcacttggaggccagtggggtggcccaggccagaaatgatggtagcttggagcagagtgctggtggtggggacaggcagaagtggataaaatttaggaggtaacattgacacaacttgatgattgattggatggggtgaaggttggggaggggaaggaggggacgacgctcaggtttcagagttgaaaaattgggtgggtatagtttagaaagtgatttttttttaagatataacgtgctaagggagttcagaggaaggacaaaatacttccagctggtggagaggtgggaagatttaatattgtaaagatgtcgattaatgaatacatttaacacagtgccaatcaaaatagcaacaaaatgtttgggaaaactttacaaaagttcacctgggaaggaaaggtgctaaaagaggattttgaaaaatgagaggcccttgccctgccagacattaaaacctattttaagtttcaataattaaaagaatatggggctttgtaggaacatatagaaatgtcatgcaacagaagagaacatttaaaaaacaaacactttgcacacattaagggtataaatacttaggtattagtaggtgagggaagccaggtcaggtcaacgcagaaaagatggaatgcttaacaaatgtgttgggccaactagttaggcattaaaagaaaaagttagattttaaatttcatagcatataaactaaactgtattcaaattaaatatttttattaaaaatgtagacatttcagaagattacaggtttaaagaataattatcattttgagacttgtgaacattgaggccaaagataggcaccatcaagcaaaagatgtgattacgtaaaaggaaaatgtttgtgtgtcaatatgccaggcattaaagggaaaaggacaaactgagaccacatatttgctctacgtggcctattatcttaagtataaaaagacttattcctttattcagcaaaaatttattttgtgcctactgtttgttaactgctatgttatacattgtggaaaaaaaggagaacgttaggtatcttagaaattgaagaggaaaagacaaatatccaaatagaaagctagcaatgaacatcaagagttaaattcaggaaggaagactagtaaacaaagaaacctattataataaaaaatcccaactgcactaataaataaatgcaaattaaggcaacaagatcacctttttttccctatcaagttgacagagattttcttttaaacaaatgaaaatactcaggttggcaagattcaaagacaatggggactttctaagatactactgcaggatactctagacaggatttaaagccataggaccagatgagatcgccatgaaagagtggagatatggcaccttgggaacaccagcatgcaggattaaagttgacagaaggaacctgggaaggagtctgagaaggagtggtcagggtaggaggaaaccaggagagtgggctgtccctgaagtcagttggagagtgggtctttttccaggacactttctgcatgtagagcttctggtatctctagtgtttcaaagacacccctggacatgggtgatggagctataaggagatgggtaggtgtcataactatctaagatactactgcaggaatgtaaatttgataagagaacacctgaagatgtatgtgccctttgacccagcaattctacttctagaaatgtctgcctaggaaataattgagtttgctggaagaccgttcatgggagtttattatagtgaaaaattgaaaatatcctcattgtacattaggggattcattaaacaaataatggaacatcttctacacttttttagagacattaaaaataatgccatggatggatatttatttacatgaaaggcatctgtgatatgggttttaaaggagctttaaaatagtctgcatgatatgacccaatgtttagatatatgaaaaatgagtagttttacaaacaaccctagtagggtacagaatcctgcatgccaaggtattaacaatggtggtttctcagtgttgttgttatttaaatttttttcatgttgcttacttgtatctaataaaattaaataatttaaaatttaaaatttaaagaataaagtatggcacaatatagcatcacacgtttaaatactgaaacagtgcacattagtaaacttgatttttcaggtacaaagtatttccagcctgatagttggtggtgcttcttccagaaactgcctttgagaaggaagggccttcgggggcagtcggagtgaggaggggagggactcaggagtttgttcattcacaaataaagaagaaatgctatcaaggatggctggatcatccttgttcattcacaaataaagaagaaatgctatcagggatagcatcatccaaaattacaaatgctatcaaggatggctcaggagtctggccactttctagaaaaacttccaccccgaggttactgagcgaagtaccacttgggttggtggagacaggaagctgatgtcatccatggagggttctagagcccacaggaaataggttggtggcctcctgtctttcccattgaattggcagctactgacatgaaaagccaatttcgtcttcatccactatcagtggcttccacaggcacctgctgatgggctgttccacctcagagctgagtcctcactctggtcacctggagagccatggcctcttccctaggaggagaaagacaaagccctcctgtctttccagccaccctgaagcactgacccacgcactctggacgcctggagtgcttcactgcaggacagtgctcctaggctgctataggcctagacaaaccactcacctccaatggcaaggtggacaaaaagtcattctgtttctggaggaaaaggcaaaacttgaaacctagagggttttaaaaggtgcagagtgagtgctgtgagcaggacgggtcccgagaggaggaccagccggaagcactgcctttgggggctggccgtgtggtccactgcttgtgtgtactttcatccggtcactgacctctctgagcctcatttccatcatctgtaaagctctggtgccaattatgctgttacccaaaggtgtttccctaatttggctgatcataagaattatgcttggcaccattccagacaatgccaaatcatgctcttcggacagggtctgggaatctgtattttaaacaaagaaatgagtttgagaaacctgagttctgctcctgaggctgttggagaggctttctggcctataaagcactccacccgtgggagggttcttacgagactgggtccgttcaccaggaacacaatagtagtgtttactcttatgtagaactttctagaaggagagtcctgcgggagactccagagaacctttcctccttccacccctgtcccactgcacacactctgtggtccatagtccaactgttgacattttctgtatccaaggatgcaccaccatgacagagccaagcccattattaggtgtacctggttaattagccagacccccatggttgccactgccaaccacagcacaaacaacatcggggctctgaaaaataacacattttctttgcacatgtgactttgcaggtcaattttccaccaaccgtggtttgctaacgtgcaacttgcttctgcgcaattgagagagccacgtgagaacagggctcattagggaaagtccagttgcctcttactggtttgagacctggaggaggtatgctagcctaggcggagaggagaggagaagagatcctctgtcttccgcgcagacttccagagagaactggcaatgcagaaaaataatcctagtaggggcacccaacagaaccacagtgactggttgttcagggacttcttggctgtcttgacttcaggtggcagtgagtatgcagggagaggatatcagagcatggtatttaggggtggaattgtcattgtctctaattgtaaaatctgcaccaaccacagaatccagggcaaaacacagtgtgtgaggacatgggggtaaatgagcacagcttttcactattgttgcctgtggttgcttgcagaacctggactacacattagacannnnnnnnnnnnnnnnnnnntttatctgtgatgacagttctatgaggatctcaacttcatagctgagatcctgctacttagagaaattaagtcacttgcctaaggtcaccaaggtatgatgaatcctagatgtcttattccaaagttctgctcttaacacctaacctgtactacttcccagtactgtacagtttattacaaaacacgataccaaggccatctgtttggtcttgtcttgttttacttggcagatgatgccttggctcttgggctgttactctggagaggtgcacaggaaataggccgtggctggtgagcatgaagggggtctcagaagacgccttacctgggccctggttttcagattgcaatatgggaatatttcttgctactctcctgagagggtctgagaatgtgtattttattttattttttatttttatattttaagttttattttactttaagttctgggatacacgtgcaggacgtgcagatttgttacataggtatacatgtgccatgatggtttgcagcacagatcgacccatcacctagctattaagccctgcatgcattagctatttgtcctgatgctcttcctctccctgcccccaacccaccgacagtgtgtgttgttcccctccctgtgtccatgtgttctcattgttcagctcccacttatgagtgagaacatgcggtgtttggttttgtgttcccatgttagttcgctgagcataatggcttccagcttcatccatgtccctgcaaatatgacatgctctcattcctttttatggctgcatagtattccacagtgtatatataccacatttttattatccagtctatcattgatgggtatttgggttggttccaagtctttgcttttgtgaacatgcttcaacaaacatacgcgtgcatgtatctttataatagaatgatttatattcctttgggtatatacctagtcatggaattcctaagtcaaatggcagttctggttctagatccttgaagaatcaccacactgtcttccacagtggttgaactaatttagggaatgtatattttaaacaaagaaatgagtttgtgaggcctaagttctgcttatgaggctgttgcagagactttttggcttataaagcactctacccttgggaaggttcttatgagactgggtcctttcactgtgaacacaatagtaatgcttgctcttaggtggaactttctagaagactcaaaaagcaggagttatgaaggggaggctccagtcagtatgatgtgctacactcagagcctgtgaagttccttgaattctttagaaatcatagaaattatcctctctacaaataactgaagttgcaggaggcaaagaaatatgaactccacatttttattaagcttgagagaacctggcgctggggcaggctgttgtatagaagagagctgatgacagagtgaagaggcagggatttgcattccaactttcaggaaaagcaacttttctttgtgccatttttctaacctaaaaatgaggatatacttaccccattagaaagataaaattacatacatatgcaaaggtatttatgtatataaatataaaagcacaagcacaagtcactgttgtaagcatctggtgggaggatacatgcagctctggggagcgtcctccctctttgctgttggaccagcgcagggcttctttgtctgtcttctggaaaatgtggattcatcttgaaagacctaccacatcatgccctgaatatctcgatctagattagaaatcaggtttttgcaggagacagagaaggccaagggagcccaagaacatggcctttgcaggagagggacagggggtcacaaggaagcaggtattaaaaggtagaagccaggcaccatggttcccccctgaaattccagtactttgggaggctgaggccagaggatcacttgaggccaggagtttgagaccaacccaggcaagatcccatctccaaaaaaaaaaaaaaaaaaaaaaagttagccaggctggtggggcatgggcctgtagtcccagctcttgggagcccaaggtgggagaaacgcttgagcccaggagattgaggctgcagtgagctatgattgcactactgtactccagcctgggcgacagagggaaaccttgtttcttaaataaataaataaataattttttaaaagaacccagaagttcttgtaagaaaaaaataaataaataaaaaataaaaggtggaccaaaggagcagaagagattgactgtgtcccagctggcccaggtacatgcagagtaggtgcttgacaaggtgtgcaagagaacttagaggtctacatagacaacctgctagttgagatgcaccaagaaaccagataattcatgctaactaaccccctctcccagaatacttcttatcttctactttggcaaaaaaacaattttttttttctgttcattatttgggagaaagtattcatcgacaggattaaggcaagaacaggcagcagctgggaggaaaaatcagaggccgaggtttttccacacacccccaaatcataccctgaacagcctcctccccaaggctgtgtgtgaattgtggggcctgccttcataaagctgtgctgcacagatgtgcaaactggatttcaaatgttaatagctcatccacttcgcattttttttccccatatagcgttatcctggaaaaaaaaattcccattgaagaaatgaatctgatttttagttaaaaatacccaattcagacatcagaaactggcccaagtacaactattccctgttcaaactggagacaggttgagtcaatagcccccctggtagcctgcacttttactgaagttgtctccactcccacctcttgtgaaattcagatacatcattcagctgagtctgagaaatgatgtctccgttgttagccccagaatagggggctgctgtttcactagagacatcccagccccttaatggattggcacactcggctataatattctaaatacacattacagagagcaagagtgtatttataactgctccattgtggcatttagatttacccttgaaatttatctttaatttttacagttgtctccttaaccatgtatattattcccttcttcaaacaatctgtcttgctgctgcagtttttctggaaaccaaagtgtaattaaatattaaattaatatttcatttaaaattaaatatcagaggcttcagtctaatctttcacttgtgcactgttggttctctcctcgtattcttgttcctgtgtccacaaaggcaggtaccgcctcttaataatgtgttcctatattatctttgttcctttttgtttttaaattggtgacactgaacttttgctacattgaaacaaatggatgtggggagagatttcaatgtagccaaggttaaagacaacttaattcaacagccttgacttcagctccaccctctactcctcagagaagaaagccactgctccaaatcagtgatagccttagaatcataaaatgtaagagcttgaaaggggtcttagaagccatttaccccaatcctttgtcttcacagagaaataaaccaaagcctcacctggccaagtgacctgatgaaggttgtgtcatttgttagtgttgggaactaaggcagctcccaagctaggaccagctttatcccatcacaccatcatatgcaatgaaaaacttagcatttaagtgtgaatttaacgtagcctttgcatgttggacacatgaggaatagggcagaagggagacaaatagacaaggaaattggaaggggaaggacgagggagagagaagggaacccaaatcctagcacatggaagacagactttgtgggaatgaacatgtgggaagaaagtactatgtaaggaaagaggacagagacgtcctaaagtggcacgagggcaggagctcgtctgtgttatctaaattcctcccaaagccagattgtgtttcatgccttcctacgctgtcaacagagagtaattctccttggccaaagccacgtggcaggtattgttaaagcatgttttctcttccattgccagtcagtgtctgtcttctggtcttgtgtttatatggcagtcacattatatagatttaagggtttgttgttgttgttgttgttgttgtttgctttcttacaatgcaaagaaaacctttcagtggttttccttattcttgaagaaagttggaatttagagttaggactgtagtgatcctctagttctgtgggctgtcacccttaggagaccatgggctgtgtgaacatctgacgaagtgaagctccctttctgcagataatgcacagatgcacaaacacatggctaggcttagaatttctacttttattggcctcctgatgaccatttacagattccatggtaatcctaggatccaagggaagactcactggtgagtaaagctgcaaccgaggccagcagtgtgatccgccaacatccccagagtggcagccaattgagaactcagatcttgcctcactcatcatcatcttctctcacattttttttaaaaaaagcaaccaggccttgatgttgccatctttgcaatcagtgcccctgctggtcaagagcataaatgacctccagcctgcagtgtcaaggctgtaattgttaagggctgaacagggttctaacaaagagccccctttccatgttagccagtgtccccttcatttttgtgaaacagaagtagaagtataagatggggtaagcattatctgctccctgtgcctcctcttaaggaaagaaaattaaaaacatatagaattttatatcgcactaatcctttgggaaaattaatattgagcaccagccagcttttttttttttaaagagtggttcccagtagatatttttagttaaatactatttactttaaaaaagaaaccattcacatattgcttatagtttatatttatttattgggtccaagatatatgtaagtaatctcatatattatacccgcaatcaaaatgagaaatggcacatgagatccaggctctcaagagaaatattatgaaatctcaaggtattgatgaaagtttttcaaggctgatccaaatgggatttagattctgtggcagttgaaatgtgtattattaaactccttaagcaaacccgaatgactcccagtggaggattaagacattctatgtatagcaaagacgaaattctcatgtctgagttttctctcttgaattccctcttgattagcttctgtaatatttaacttcatgccatgccataattatttaataaaaggtaaatataaattatatttcagtggggctatgaccttttaccttaatgttatattactaaagaaagacatagataaatagagcctatagattgaagcatatttttaatttactctgtttttgccttgccagcacttctctgtatccctgtcagccaaaaggttggcagaacttcacagcatccccgcactccatgtggtaggcaaggttgtaaattaacactgatgatggcagttaatggcctggttggcccttggagacagtcttggtgctggtcttgggcacctcattagctaattgagctttgcttggctcataccaggactgaaaagccagagaacgcccagggaagtagggagggggagggaggaagttgggattcaaggtgaagctgaatctaagagacgcaaaagcaactggtcagttgggaagtcagtctggaaccaaagagttgtcaaacccggccatgtgttaaaggctgaggtccctcttatggtttagtgttggctaaacagagctggagtactttcagcttcatgctttctacttccaatgtgcacttgattaaatgaaattctgtcggtgtgtatgtgtgagtgtgattttccctgtctgtgtaggtaactgtgttttactgtcctctctctcacttggatgcacacgagatgtatcccatagtttatgcctatgaagtctggcagggacctgccaaaaaacaacataaaaatagacaattctgccttatctacttattcagtgtaaaacatgaattgccagcccagtgtagtaaagatactctgccatgtctaatttgggagctggggaggggagggcaggcaagagaaactagacatgaccctgtatcctagtggcttgcaatctggttgggagaacaatgggtgcaaatgcgtgataaattatattttaaaaaaactcatctccatcccacctctgtgcactgattagagcccagctccagaaaattcctctctgagcagcaggaaggactaagggataaggaaggtggtgctacctggctggacccccaaaaatgctcttgggagaggcagagcacttgccagggtgggggacagccatgcagatggaaagggacaaaggcagaaatggagtcggggaggggttagattttctgccttatgggttatctgtttagtttgtatttagcacgttgtgagtgtacccatatcaataattttcctgttttctctaagaaaatctgcactttggctaacaaaatggtgcatatttctaaaaaaaaaaaaaattaggcaatgatgaattttgagaatttcatcatcaagtctgtttgccctgcagcaccaggcagctgtttgtgtttgctagttgattccgcatggggtctccttctggtctcagtgacaaagtcaggcaacacaggcaggacttcattcatgcttttgcatctgtagctcttgaagctgaggaggatgcccatcatgctcttgcatctgtagctcttgaagctgaggaggatgcccagagggggatggaaggatcatcatctctggttctgcagcaggaaaggttaagagcacaaactttggagttagagaagcaggacacagatcccacctttaccacttgggactgcattgaaaatggggataaaacccacattgtagggttacaatcagaatcgaacgagctaatgtgcctaaaaggcttagcagagtgcccttaacatagtaaggcttcagtacgtcctaatggtggtaatagtgattttcactattgcatattaccaccactaaaaatcacattatttaagaaaaagtcttcccaaattgctgacattataaagctaagtggaagaaaaaagtttacagaataattctacttaaacatacggctattcttacatgtgtttctaggtaagatggccttgtgagtgcaagtgtttaatcggcccccacccccaaaatatattagaggatactttcaggaaaacataaaaataaaggaaatctggtaataatgcttgaagctaggctaaagtcattagtatcccagaaattttgcatcattgtgctggcatgtgcacacagggtcgtactggtggacatgcgaattccagctggcctcctcattcccccttaggaaagagcagcagggcaaggaagtgatgggggagacaccaacaaccaccctgaggctcccctgtctccaacttgaggagtgagaaccagtggcacaagcagaaagttgatcttgaatgggagagtgtacttaactattctatatccagagcagttgtcatttatgtgtgagaaagacaaaaagatactctcttatttcagtggcccagacagaatttaactcttattcttattgatagcacctgactgcaggagaattgaatcaatgaagaatgcaagatgggaaaagttgtgctattgcaggattggtggttggccgagaaagcagttaaatatagagtgtctaaaaaattcttgttaatatggtgatgagacttagtggaaacatgaaaattagtttctaaaaatatagaacatagaaaatctaagaatagtaaatcagcttgaaatgataaactgccaacaaaaatgtataagtggagagaaagaggtgggaagatagaaggcaagcaaaattccttatatatggagcgactcaacacctcaaataattaggaaaaataaaatattttcagagaagtctaaagacacttctgtaaattaaaatagtatgtacagaccaggagctgtgactcatgcctatagtcccagcaatttgggaggctaaggcgggcggattgcttgagctcaggagttcaagatcagcctgggcaagatggtgaaaacccatctctaccaaaaatacaaaaattaggcatgtggtgcatgtctgtagcccaagttagtcaggaggctgaggcaggaggattgcttgagcccaggaggtggaggttgcagtgagctgtgatcgtgcactgcactccagcctgggtggcagaaccagactttgtgtccctgtctcaacaacaacaacaaaaagtgtgtatatctctcaaatcactagaaaagtatatatatttaaaactattagaaatgagaatgtgggaagacaaatttatagaagcaaaaatggatgtgttaaagtgatcaaaaagatagatgaaataagacattaaagcattgcccataaaatgcagacaaaactaatatgtattaattcacaaaaatgcaataaattccaaaaggcacatactgtgcaggacaccttttaaaatccagggcagttggctacaataagcaattaacagtttagtactcaattacctagaaattttaagatactcttcctggagctaaaggaagtcaaaattataaataggactaatcagaaaattacaacaaaattgtgaaatacagtaagttgtggcaaagataagtacttaatgttacacaacgaaataaaatccagataggttaaataatttaaatgtctacatatatttgtgtacatttcagtgggcagagggggaggggaactctagatcggttagaaattttaaacaaatacaatatagattctatgctaaaacattaacaatcttgatgaaatggatgattttttctagaaaaaatacaatgatattgagaaacaatgaattcaaggtttctgattggcagtcaatcatttggatgatggtacaattcacagaaaatctcatgagcttgggtatcttgggtagggggaatctatggaccatctaagtggaattttctagccaacagttggatatttaaagctgaatctcaggccaggtatctagtctagagatcaagatttatgacgattagcatgtagctgcatgtggaaatcatggagaattgatgaagttgcccaggggaacgtacagcaaagctgaggactgcctggcaaccatcttgaggagcatcatttacaagacaggcagagaaagaacagtccgcaaagtagtctgacatggccaaagaggtaggaaggaagccgggcagtgtaagttcaggaagccagtgggtgggagggtttctagaagtggagaatatgagcggtctcaaatgttaactcggggttaagaatggaaaagttcctgttggcttggctaaaatgctattggtgaccttagtgtgagcaatgttaactagggttctttcaagtgtttagcaagagctactgtccatgctatgtaagatttatagagcataggataaaataaagaaaacttctcaatatagttttcaaagctcatatgaaataaaaatcattagttggacagagccatgcacacaatcctagttattaatatggacacataaattcctgacagcaacaacaataactgatacctgcgtgctcaccaagtgccaggcactgttcttagtaacttgatttaatccttgtgccagttgtgttaaggaaatgttaatctggtattaatggttgaatctggtattaatggttatatctgaatttagatatataccaagaaaatgatacattacttccatgaattaatgtttaattttgaaatattagaaaatataaaatataggccaggcgcggtagctcatgtctgtaatcccagcgctttgggaggccgagatgggtggatcacttgaggtcaggagttcgtgaccagcgtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaatttagcacctatatgatgagcagcacagtttactgagggatctaaagaagaaggtggagtgttgctattgcaaagccatccattttctctctagctgtaggtttaatgcaactgaaattttttttgaaatttccctaaggttaaactggaaagaataaatggataagaataattgagaaggccgggtgcggtggctcacacctgtaatcccagcactttgtgaggccgaggcaggcggatcacgaggtcaggagttcaggaccaacctgatcaacatggtgaaaccctgcctctactaaaaatgcaaaaaaaaatttagccaggcatggtggcgcgcgcctgtaagcccagctactcaagaggctgaagcaggagaatcgcttgaacccgggcagtggaggttgctgtgagctgagattgcaccactgcactccagcctgggtgacagagtgagactctgtctcaaaaaaaaaaaaaaaatagttgagaaaatgtagttttaaaagattgtgtgtttctggaaggacacttaccctatcaaatattaaatatgtattacaacctcaatagggtgacttttacccagaatagatcaataaaacagaatatatgtatagaaaccattcaataaattgtgaaatacagttaagttgtggcaaaggtaaattcttaatgttacattacaaagtaaaatccagataagttaaataataaacattcatatatgtatacataggtgtgtacatatacatttgtgtgtgtgtgtgtgtgtttgtgtgtatctaccagttcttggaatagaggtggtttttctatacataaaatacttaaggtcaaattgggatgtgatattgcaacatgataccacagtattaaaaatctcaacatataaagtatttttacaagtgaaagaagagtgcagaaagtattaacacgcagtttataaaagaagaaattaacatcagcaaatataagaaaaaattcttcaacctcactggtgagtaaaaaaatgtaagttaaaatgagcacacgcattgctggagggagaataaactcatacattctcctgaggagtgatttgaccgtatgtctgaaaggcctgaaatataaatcataatttttggtccagtaattccaattcttagaattttccaattgaaataattaaagttatgcacaaaggataattattgctcgatatttataatagtgagaaattaggatcacattaattgcctgatattaggaagccatttaaataaattatagaacatgtcatagaaaaatatgcaggaatttaaaataatgttataaaagaatagttaatgatcttggggaagtttatgatatattgttaagtggatgaaaagtaggttatgtaacagtgtgaacggtatgtctctgaataattttaagtatgtgtataggtttcaatctggaaagacatatgcaaaaaatgttaatccagctcatgtcttaagtgggtttatggtaattttttacttctatatttaatgtttgtaatagttttttacaagaggcattgttatgatagaataatagcaacatatataaaaaaaataagattaaagaggaaatagacattactgtgtttattgctgcataacagcagtgcaggtgattatttcattctttgtatctttttctttaatcatgtattaattttaaaaccatgacatttaaacaagaaacttttaaagaataaatgaaagggaagaaggagaaagaataaaagcagcatgcagaaaactctttagaatagtggaaatgctaaagtatgccattcattaattcactcattcactcactcgttttataattactgacactaagtgccttctatgtgccaggccctgtcttaacgggaacatagtggtgaaataaaatttgtagtattcgtggggtggggggctgatagttaccagacgtgggtgtaattaaatataattgaaaattgtggaagcgtattatgcataaagtgggttttatgagaataagctcatagaaggtttatatatgtataaatatacataagagactggttaagaaaaatatttagaagaatatttcatagatatttagaagaatagacagtgcagtcctacttaagaaagagataagagaaaggaaaataatataaaagtagtttattatcttcataagaaattgagatatggttgcttttttatttgatagcagagaagtttatgtatacttaaagcagaaatgataatctgaaattttgaaatgttattctaataggaaactataaaagtactataaattccaaatttatatgtgaattaaccaatgtcgatagcaaaaaccctaactgattacatccattatgcatccagaaccttcttattacctgtggaagaattaattagaaggtttgctttatagccaggataccaactcagaaagaggacttttctctttcagcattaaatgaacccaccatagactatggcttccagagactgcagaaggtcatccctaggcatcctggagatcctgagagattagctaaggtaatgtgctttggaaattgacatgtgaagccatttgtgtagaatttcaggaaacttagacaaatgcaggcatttacatcccattaaaattaattaggccttgaaatttggctaagctttagatacgagatgcacataaaatatctgctatgaaatatattatggtcttatttattaatctctgaggaaatatgaacatttgagctgattaaacagatacacgacaggagtattcagtttaaaaaacatggccaactttatgaaaataaataactgcataattggttaaaagtataagcttccactcctttgtatttaaatgtttctatttaaccataattgcaaggactcattaatccacaattagtattaattattgagggcctactatgtacgtaggtatctaatgaggagaaaaatgcttctgtataaaatttctatgaaatacatcactttcaagtgaacttccttatgaaaattactttatgaatttggcccatgttgttagctttctttaaaaagtacatcaatttattagttgtcattcagctgatgagaaactattaaattttcacatttatatttgcactttaaacacacaaattataaaatgccatattctcttttgcatactgtgaataaaatttatgcaccagagttgcttctacatcacacctttattttcctcctggaaaaatccctagccccaccattaaattagatgatatctggaaagtaggttaatagcaatttaaaaggctgtgtaaaacaggaggtggaaaaggcaaaatgagaggaaagggattcgtgattactaattctctgtggttaaagtgtacagggggaaatattattgaaagaattcatctttattagaataaaattttgcagcagacgttgccaagataatttcagtactctggacaactccttggcaagcagctaaactcaaatccatcaatcattttaagaatatttggttaattagagaaccagatttttaaaacagaatgggctgaaagtagcatttaatagaacttccatgaccttaataattttaataaactatactctcaattgggttgttttttgttttggtaacacaatcatttatagagccattttatagaggtgaatttcagatagatacgtatttacagagagatgtacatgtacaattgtattctacctgtcaaaccaaatataggacctcttggctaattacttacattttgggagggatgtgtggatttctcatttttgcctataattttcttttgtttgccatcttggattttgcctttgacaatatcccatcctcgcttattttccaggagatgctgttgaaaagagctgcagatctagtggaagctctttatggcacaccacacaataaccaggtgagatactgacatcctatcctttattgagttttgcactttatgctggatagaatgctcacattaacctgttgttttgtaggacatcattttgaagcgagccgcagacattgctgaagctctctacagcgtccccaggaatcccagccagcttccagccctctctagctccccagcgcacagtggcatgatgggaatcaactcctatggcagccagcttggggtcagcatctcagagtcaacacaaggaaataatcaaggtaccacctttcttagagtcaaaatccaaatatgtctaatttaaaaagttctgctggagtggacagagtcagaggttgggtcataatggtccaacagagtgtgtccacagataggcaatacaatcatagattgggttatttcaagattatagatggtactttattagagtttgagcttcttaggtaccaggtagaatgtctggaaatatttaaggggaagattgagtattactaccaggtttggtggctcacacctgtaatccctgcagtttgggaggctgaggcaggtagattgcttgagccctggagtttgagaccagcctgggcaacatggtgaaaacccatctctattaaaaaatagccaggtgtggtgggcagatgtagtcccaactacttgggaggctgaggtgggaggatcacatgagcctgggaagtcgaggctgcagtgagcagtggggtgcgctggcacactgcaaatgagccgaggctgcctgtgcagtgtgacggtgcactccagcctgggcaacagagcgagaacctgtctcaaaaaaaaaaaaaaaaggattgggtattatcaatttagaagggtttgggcttatagaaaataggtttacaggtattaatttaaaagaaatttatgcttctgttattgtgattatcagattgaatactggaaagaaactgattattgccattatcatttatgatacccaaatttctcttcctggtagccaagagtgaatggcttggttttatttggtaacttctattttgtattatttcatatatataacaacaaacaaatataaagacaactgtgcttttacatgtgaagcagaccgtgtaaagacatttgcattgagattgattattgaagtgctaagtcgaaatctgtcacgaatcatttttaaaaggagtaaatgttcctaatgaggtccttaacattgggatagttttttctaattttatttgttggaagagaattcctcattttttttttgcccagggagagttcttacaaaagagtaggtgagccgggtgtggtggctcacgcttgtaatcccagcacttcaggaggctgaggtgggcagattgcttgagctcaggagtttgagaccagcctgggcagcatggtgaaaccctgtgtctacaaaaaatacaaaaattagccaggtgtggtagtgctcatctgtagtccctgctatttgggaggttgaggtgggaggatagattgagtccaggaggttgaagctgcagtgagccatgactgtgccactgtactccagccagggcaacagagtgagatcttgtctcaaaaaaaaaaaaagactagacaggacatattattatttttgtttctgtagacatgaggcccatagaacaaatatcaaattctttttcatttggtgacaaatttgggttgtttcctatatagttttagagacagtaatccaaagtgttttattccaggacatatgatacgatgtttctgagctgtggtttctcactccttcccccgtcccaggcatagactgggtcccccatgctcactgctgatgccccaaagtcctaggtcagagaatagcacattttaggggaactcatccacactttttgaatgaaattgatccccacttgcacctagggtgtggcaacaacttggaactgacgtttctaaaactgtgttccatagaatacaagtggccccagagaggtgaagataccgttcccctccaggccccgccaaaagatgctatggcatgttaaatttggcaaacactaggctagcaaagttaaaccagtttatttattctctaggccttctgtatatgaatcaagaaatggctacagtgcataacatctgcccagcctaacttgaccacagaatgttttctcagtgacaccaatcatatctcactggactccagtgtcatatgaaatatgatttgggagagggaactccacactgctattagccattcgctccttggtgtaagctggaggtgctgagtgcaggtttgaatggagtatcaagggcatggccttacatagatggggaagagagagaaaggtataaaaggctgaagatgggctgggcgcactggctcacacctgtaatcccagcactttgagaggctgaggctggtggatcatggggtcaggagttcaagagcagcttggccaacatggtgaattcccgtctccactaaaagtacaaaaattagccgggcgcaatggcagggtgcctgtaatcccagctactcaggaggctgaggcagaagaatcacgtgaacccgggcagcagaggttgcagtgagccaagatcgtgccactgtactccagcctgagcgacagagtaagactctatctcaaaaaaaaaaaaaaaaaaaaaaaaagctaaagatggactgcacacttcctacaactgcccggggcagctggtgacattctgcagtctggggccaatgaggacctgtgctagccacatgtggcctgactgtgcacgcctgttgatttacctgggctttttctttgttgccaagggtacatccgcaacacaagcagcatctctccgcggggatactcttccagctccacgcctcaacagtctaattacagtacctccagcaacagtatgaatggctacagcaatgtccccatggccaacttgggtgttccaggttcaccaggatttctaaatggctcacccaccggctctccttatggaagtaagtgacctctccatcacttggctctccatgcttttttgtctctgggttttactattgggccttttgggagaaagttgcatttgtaaatcttcctaagttgtcggggagcagcctagtttcctgattaagcatccttcctgcctttcgttcttttcccttagctggactttggctcacgtggttactcaaggccttttggggaaagaaaaggattgaaacaattccgtttttatagagaaagagcatgtgtggcctgtgtaagtggaagcaaggaattaagattccatttctgttaacaatatgtgtgctcttaggcactttcagatgtaatattttatttaatctccataagaacttttcgataagaactttttcttcatgttatagacaaggaagtttggctttgctgcagttttctgacttaatcaagatcacatagctagaatagagcagggtaataatttaggcacagtcctgatgactttgagttattttgtgtatcacaccatgctgctttttgactttgcaacctggttttcccctcctttcagtacctccagagaggtggaagttgactgtgtgcaatcatgtgatatattgagacagaacctcttcatcttaatctgtggtctagcagcaaagtccctgctctgggaagttgtgaaaaccccatttgggttgctttgggaggtatgccgggaagttacacaatgctcccaggagcctgagagagtgcatttttcaaacctacctagggaatattttaggccaggggacaagctgacatggagaggctgaagtgattgagtagagtgttctcgaaatgctgggtcttgttgcaattctctgcaccttgccctctttttacccagtgtggttcccttgtgccaagagcaaggacatgtcaagggcagcatgcagccacgtccaccatagcttcagaattgacatgtcacagaagctgcctttcacagtctttggacttttggttccctggggagacacacctatgagctatttctggattatcagttcaatgcatacactctacactacacggtgagataaagatatagcaccaagcagcgaagggtagtagaggtcagttcttctagtgcaatgaaaatcttcttactgcaaagacaagagttctatgttgtgtcttgtcaggtggcctaagttaattagataacagtctagagaaataaatgattgcttgatttgtttctaccccatagtaggtagaaacaaattcccccaaatttttggaaattcttgttccaaaaagtgtttgggggaattattgcagtcaaatagatagtatgaaaatataaaacagagtctaacaagaaactgagctaaaagaaacaaatatggttcaggaaattagaaaatgccagggccagcatgaatatcatttggtctattcaagggagtcatttactttgctctgagtttacaagaggctaaagcaaagagagaaacactatttgttataagattttatgtccacacattattttttaaagtagctcagaagaaaggtggctatttctgttactgagatgttggagaggtctttcccatgcttcctcctggaggtggtgtctggtgtggtaaagagaccacatctttaacaacccctaaacatgatgcagtggcaagagatccattgtgtaaacaatgatataacagtgacaacaataagatgaattaacaattacattccactttacagcttacaaagcatgttgacatctagagtccagtcagagcctcacaacaaccttgtgacatggatacaatcatttttatcattatccgttgtaagagatgaagagttattgaatgacttaagagttcatagccaataaatagtaaaaaagggactagaacacatcatcacactcagaataccacgtttttaaattattaaggaatatttaatgtatttatagtgtaatattaggctaaaccataggaaattccctctatttgaccattttgatctacaaaagtggcaatttcatatcattcaatcataatctatgtaggtatgaatgaagttgaatcataatagttgtttttgtacataaaaatgatcaattttataatacagtatgtagtgtggtagtgaagaggatggagaagaaaggagaggaaaaaaagatgaatgaaaatgcacagttaggtgtgaatttcttaatatttcttcctaaataattcatttggtagagagaaatccttcccactcccaccagtgacgacttccttctactgttctttcatgatcacccaaacccactgccacaagaaaactaataacaccccaaatcttcaaattacccattaaaatgagatggtagacacagaataggaaaaagaggaaggcaacctgcccaactgggagacagaaagagagacgggagaaaacctcctccctgtacctattgaatctggtgtggtggtttgcaccttcacttttggagggagggtctgaacgagttgcagcctaggaatgaaattccaaacagtgcattcattacaatcaaattcacttactccaaaaatactgaatacccagtggagttcattacaatagcacctgacctgtatttctagccagccaagtctttacttctctgggaaatacaaaaaaagaaaagcccgggggaaaacattttgtcaattcagttgcttgtgtctgaaaacacaattctatgattttttttaaaatgcatctgatgtggctggaccatgccacggagcaaatacttgccagagacactaagtaagaaagagccaagcttcttagtcaagtttgacttgcatgacagccaacgtagagtatcagaaacccgcatctttactgtttttgctctcgcactacttcaaaaatggccaaacagatgttttttcaattttacatacaaacttcacttcctggcagtagcagtgtgccaagttccagctcagtgcaagtttttatggctgaattctaaacccctgacaatagggggttataatgaaatgctgacagaccccttagctccaaaaaatgcactgccttgatgcaaaggaggatatgtgcccggtgagttccagctgagactatgcaagccaatcaatcctcctacaaagaaaagtggtttttccttaactccccatgttcacagagatttctgggccagacgtacttttctttactttggcctctatccatagagagatagatgtccagagaaattcttgattggaagtacatgcaatcaactttcctaaaatggttctctctgcagtcccaaaagattgtctatttaacaagcctgtaacacccatagggaccacttcttccaaagcagaatagccaccaagcctacgcagagtttgggacagaatccatacaggcaggaagccaacttgtcctcatagattcctacatcatgttcagagccttagaccatgctctggggttcaattgttttatagtttcaaaaataaatactaagacattctctattgtaaaatattaaattattattacagaaaatgtagaatgtataaaaataatttttaaaagaaagcgtactcccaccataagaataacctctttgaattctgatatatttctacttcttcagaaaagaaaaaaaaagcctattaaaatagtagtattctcattacagacaacttgaaaagcacgtataggtaaaaaggaggaaagaaaaatggcacactctgtgtctgtgcagaggtaaccattgttaatttttaaaggatagcctttcagtcatggatagatacattttgaaaattgcagtgtctgctctgatgcacaactaatgagattctgccataagatcaatgaaagagagggtggaaggaaagcagtaaaattaccaaagtcacagatatgaagctgggctgcataaaatccttcagtgatgcagacccaggtcataagaatggggaacagagatatgaggagtggtgtttgctttcaaaagttgactacaatcaccaagtgtttcccaggaatgtgaggatttattcatctcttgcttttttttttttttttggaggtgggggttggtattagagtaatagacaactttgtttataagtagtacagccttaaatgaaagaggaaagttaaaattatttttaaacactattatgtctattgctaaggattgtattatttcttcccaaagaaatcgagattttccatttttaaaatgtaatagcctttactggtttctcctaccatgtattaaaagtaatacaagtttgttgtagaaaactttgaagatacggacaagtgaaagcaatacatttaagggtattcataatcccatcagccagagataccattgctaaaattttgggcatatatcacatccttctagagttttgctatttgtatttttaaaaattaaagggggcttagtatgtgttatgtaatctgttttttttcatctgaagaggtgtatatttccatgtgattattctacaacgttagttttaatattggcatagccttctattgtataggctaaatataatgtaccctactgtgggacacttaagttattttccaatttttcattattataaaaatgcccttgaacctattatttttggcacagtcgtgactacctccttgggattaatttctagagattgaattagtgggtcaagggatgtacacattttaaaatacttttatatatattgccaaagaccctccagagaggttaattcttcccttagaaaagaaagattattatatgtttccccgccctgttaagtttttctttttctatttagtgagtggaaaataagatctttttaccgttttaattagcattttattatgaatcagtttgagtgtttctatatggatctctcttggtcatttttattcctgattttctttttttgtgtcctttgcttatttttctcttggggcgtttttctttttccaattaacttatgagctattgaggatatgaacatatctaaataagtattacaaatatttttcttaatctgtcatttgcctttttgtgtttgttgcagaagtttttcattatgtggcaaatctatcttgtgaacctctaaccatcctaacagctctactagcacttttacaattttgcttttaaaaatgtctttaatctacttagatttattttggtgtttagcaggagaaagtactctaaacttagtcttcaaatggttagtgtatttttccatgcatttattttcctactaatatgaaatgtcacctttattaagtattaattcccatctatacccaggtctgtttctgaactctattttgctctaaagatttgtctgcctatttctgtgctagcacaatgctgatttcactgatgaagataagtgccttcttactacttaaaaaaagtttttaaacaaaacttcctgtctcttacggtgttgttttatgaaacagataaacatagtaattgtgtttgccgaaatgcacaaattaaaattcctttcagcatttttattatagttgcatcgaattttaaattcagttgaatgcattttggcatttttacaaaattgttgtaagaaatatttaaaacgggcatgtacttgctcaactctgcaacaattccttcacgtcacttagtaaagcttgaggtgtttcctctcccactgcaagggaaccatttttgatctaatgggccctgctttccgttgaaatctgttattagaaaataattatctgtactagtgagtcatttgctgaatataaatggaatggagtgtgtgtgaatgcctcattcacattgtaaaaacctcttcaatgatgatgtctgagaggaggttctgctgttgtagacagggaaaccaaggcgccatttgggggaccatggtagaatcagggcctcctaagtcccagcttttctttggcttctaattctgtaccatagagaaaatgaaaagttggggattttttgcttttggattttttctatttcactaatgccaaacccaaggctagaagagattttgctcagaaccatgaataagacccactcctcatgcttaaccctgtgtccttattatgtgaattagcccaacagtggttttattcatttacatattcaagtattacatgagattcttccagaactttgttctcctttccaatttttttctttttatccatatatgaggaaagacagatgtactcagatgcatagctccttaaatcaagactactttaaggataagatgtttttagagaaagctcttcttttgaagtctttggattttagtttggctataaaagacatcatatgggaagtatgctatataagtgctttatacaggcaattgggtggacgtggcccaaaatatatttttatagggaaggaggggaaatgagggtggagttgtccatggacatcagaacatttgaccttcagttcaccttgtacttggttggtcagtcataagtgtcgcccttgtcctcactttcgaatttactttgaaggacaggtggtccattgaaaatacaaagcaagaaatagcactgctgggcttggtcattaggctccaacaacacttttgtcaagtcatgtgacttggacagttcagaattctgggaattatgctaacacaagtgcctaaaactatactataaggtgctatatttaagagttttgcccttgtgtactctagtttactcctttcttaagttgaacatagaagataaaattatcatcttgcatgatataacttggtggagtatctgacattaagaggtggggtacttcattatgtaaattgcttttattttttcttggaaattataatgcttggcttttgtcttcccttaagtcattttaatgttaatatcactaatattggtgtttttttctaaacattatgtcaggggaggccgacttgcagctatatttcccaagagcacttgaaattacgggagaggaagacgattttctgaatgttaataaacttttacatttaatgaggaagtggcccatagagatggcactctcagagaagatgttaaccctacagaccaaacccctggagccttaggagttatgggggaggcacatagctcccaaataggactttttttgtagggtgtgaaagcgatttccattgctgggtagatttgatgatttttcaggcatgtttgatctcagtcttctctcttgccaagcttctgcttgtgaatgaagacctgtgctaacatcacttcctgaagctgccttcctgactctcccaagcacaagtgccctttgctgtctgcatctcctgggcattgggtaccttcctctaatagcgtcattaccatattagttgttttatgtgtctgttcctcccactggacatggtgggaatgttgtcacattcaactttttttttttaatccctgcaatctggaacaatgcatggaaattaacaatttctcaataaatgtgtgccaaatgtgtgaactgaaggaagatcttaatttctaaatgaggattgtgcatttgctttccagtcatgtcatcgagtcccaccgttgggtcttccagcacatcctccatcctcccattttcctcttcagtttttcctgctgtcaaacagaagagtgcctttgcccctgtcatcaggccccaaggctccccttcacctgcctgctccagcggcaatggaaatggattcagaggtaagcaagggttctattttggggatacacaatgtaccatagggttggcaaagtaagagcaaacagcacatcattgtatagctccagccatttacctgcaaagagatgctttgctgttcttatcatgggacatgaatggcttctacagctaggcaagtgctccatctaaaagcaagatggggccaggcatggtggctcatgcctgtaatcccagcacttcgggaggccaaggcaggtggatcacttggagatcaggagtttgagaccagcctggccaacatggtaaaaccctgtgtctacttaaaatacaaaaattagctgggtgtgtttgcgggtgcctgtaatcctagctactcgagaggctgagggagaagaatcgcttgaacctaggaggcagaggttgcagtaagctgagatcgcgccattgcactccagcctgggcaacaagagcaaaactccatctcaaaaaataatcaaatttttttaaaaagtaagatcagggaaaacagacatcagcaaactctgcaggtaatggaattaaccatggttaatacaactgaggagtgtctggacttcccagccctatgctgtccacaaggccattctgctatctctcagaaaatgcccagtcaccccaggggataccacatggtgctttctgcttacctaatccgcttgccatcatgtcctcttggcacacatggacaggagccagcaggagcaaccaacaagttctgagaattctggttacatgcaagtcaaattgatagcaggtgcctgattagggggttgtggagaatagaaaagtcatagtttctaagaacaaaagttatccatcaaacccatttttgagcaatgttctaaaatataatatggcatgacataacacaaatgtgatgagtatatgaaaaatcatctcattgtggatggagggcagccgacagcaaaagacagcaaaagagcacattggaaactgctgaggactggggctcactggcaacccacattatttttaggctgctcctctcatgttcttgacaagaaaatatttacaacaagcagggttgggtaaaactaaaaagggaagaggtttcattaaccctcatggatcaaaggctgtaaggtcagcagtgcttgatggggaaccttggatgggctgcattgtcctggggatggcatctgcctggtggtttgatgatagagtgtgggttcttaattcttttgggacacgtgtgagaggtcagtctcctcttgtggctgagcagagctctgggaggtacgttaggttcctgagccatcccaacactggagatgatggtgtcttctggaagtcaagtgactctacagagaaactgtcaaaaccagaatggaaaacccagtactcagaaacattgttgaaaattattttacttctcactagagaaagcagcggggtctatataccacccaatgtatgggtagttggaaacatctggaaacttcatggattttttggcagggattttcacccagatgtctaattcctagagaaataggctgagcctgtagctaagtgtctccacttgcccatctttcatcaaagaccagtggtttccatcccatccttagggaatgtgcccagagctttttccatgagacagggaaatgaaaacgattgctgaatatttaccgtactttccttcctcttccccatgacctcttcagtgttgatgtttcctctttttaagttctctggttttattcatcgaccttaacccgagcggaggcccagcaagtcttactggcaaaatgcagattgagacagaccaaggaggggtgcaggctttcctctgcattggacgggaggcagacaggatggatgcagccctttcctcattcctggccacttagcacatatgttacttaaaggaaaaaaggatacttgacttccactgatcaccccttccccacctcctctctcacgggaaagtggagctggttgtctcagatcttctctattttacccggctctgagcctacaatgtggccaggacaagtttcttacagactcccagggcctgtcatccccaccccacttcctgctgcatgcccaagactcccgtgctgttactgaagtcaggtttgagccagcccaaagagctggaaggaaaccttgcttggtcttagtaaggttccctgtgagggcagctgcagcagaaacagaagaccctctccagggtccccagccacacaaaattctggtcaccacccctcaggatgctcgggctgagcagcacattcctgataggtttataggagcaatgacttggtgagttgcatgtaggcacaggctctaggctctagcttcatttctagagtcactgtaaggtcccaaacctcatttgaatccttcagttccctccacattcctctggtgatttgaacctttaaaagaagaaggggccaggcgtggtggcacacacctatagtcccagatacttgggaggctgaggcaggaggatcacttgagcctagcctgtgcaacatagcaagacctcatctctaaaagataaaagtttttataggtttttttttaaaagaaaatttcattaattttgggggtacaggtggtttttgattacatggataagttctctagtggtgatttgagatttcggcgcacgagttaccttagcagtatccactgtaccccatatgtagtctctctaaaagataaaatgtttggagtaggtcggggaggaaaaaaatagaactacctgtcgatttagggcagtagcctaaaaagaaattgcaaaaaatctatgaaaatatcaagtgacgtgtggagaaatccttaaagagtattagccactggaagagtgccagccatgatgtcaccagtcctgtgctgagttctagttcagctctttccaggccttgtcaatctgtgcatgccattatctcagagcctcagtttcctagtctgttaaatagaaaatcgacagctatccccaaaggtggttgttgactaatttgtgtgaagaactaggcaaggtaacagctatttcctacagcctggctgagaggaggcgagggttgacaaaggatgccctcagtgaccttaccttatgctcttcctcgttttagaccaggtgcatggaagctcagtgtccaacattgtgaagttcccttgagtacagagagagaggaaaccaagctgacatttaatgcacagtcactgaagaaaacaaacaaacaaaaaatcctgggatctcagacaccagctggacagggagctccatctttttagagatacacagtgggagggtgacaatgtgggctgagtgcctgggtgatcgcaggctggggaggggcccttctctagacttcattgtctgcaaaggcatatgctgcccacactctttgaggcttgctaactatcctgagcactataggcaaggtgccgaactgagtgccttaagagaattatctccaagtcatgccattatcaccattcttagttaagcagtttacccaaggccacacaggaaaagtctgatgacttgaacccagacatgcagattccagagcttgtgctctggcagcccactgtgtcttcagggacaatgagagtgaaattcttctctttaccctataccccctacccccatacctactttccacctggttcaaagggagattatttctttctgtctgttgcctatggtttctacaagcaaaaagtcagtttccacctagcagagatcaggcctacccagtctggatgtaggactaggaggaagggatatatctcaaatctgttcttttctgtcattcaggggatcttgatctttgagcacctctgctgttacatgagcccctttggtatctctctgagcacccagaaaaaggaagggactgaagatttttctttttgagacagggtctcactctgtcacacaggttgtagtatagtggtgcaatcatggctcactgcagccttgacctcctgggctcaataagagattctcttacctcagcttcctgagtagctaagactataggcatgtaccaccatgctgggctgttttgtattttttgtagagatgggttttcatcatgttgctcaggctggtcttgaactcctgggctcaagcgatcctcccacctcagcctcctaaacagctgggattacaggtgttagccaccgtgcccagccaggagtttgtgagtcagaattccactgccagagagctccacatacagcatggttccaccttctacctcatttatcagctgcttccagttgatgagtatagattgtcgagataatattacacactatgtgtctgattcattttccagctccctccaggaaaaaaaaataaaataaaaaaacctcctacactctgggataattactagggttgctatatctctaagtcatcagggagtgtccagaattgaaccgcctttattgaaaagttacattgattcaatatatagtaatacaggcaaaaataattaaggctttgctagctgtgtaagaccttaatccagatctcacaaacattcaataaaggctatatgggcagggaaatagacagctgacaattttacccgagaggactagctgatgtggaaaaaaggggcagagagagtaagagaggagagagagatggaagggttgagaaaagcagagagaatttcagccatttgcttggaagcttagtaagcaacactcagcaaaatgcttctattatattgaataattccttagatgcattgtagatagtaaaatgcaaaggatcaaattctagatatgattttaaaggttctgatgcatggaaactattctgccattttctaagaatgtgaaaatcccacgggcttatcctctgaaagccaaggcaggaggaatacattttgctgtgggatttttccacattgtgctggtgctgctttatttgccacatctagggaaaccctgggaagtgattctgcccagacaggcattgtccgaatccttttgacccgatgaagggagaaagaattaaattactccattcatatagggtgatgaagagtaggaattggaggctgagtacagtggctcatgcctgtaatcccaacattttgggaggctgaggtgggtggatcacctgaggccaggagttcaagaccagcctggccaacatggcgaaaccccattcaatacaaaaattcaccaggcatggtggcatgcacctgtagtcccagctactcaggaggcagaggctgaggcaggagaatcacttgaacccaggaggttgcagtgagctgagatggccccactgcactccagcctgggtgacagaacaagattccacctcaacaaagaagagtgggaactgagggactaaatgaagtcttctattccagtgatcagtgttcatttgcaatgagcatcagacatgaacagtgagcaccaaaggaagatgagctaattaaaaaaaaaatgcactcaccaaagaagtgaaggatagataaaaagcttgatttgttatcaacgatgccctagtaaatcaacaggctcagcacctggaatttcctttcctgttccaactaagtgatttggagcagtataatctggaaattatcttagttgaataaaaaaatatgcatatattacagtttagtttacatgtttacatctgttgtctcatttatacaacccatataaaacaaaacataactcctggcctcccaggcaaaacttcatcaaggtttcccttgtacttcagtgattccataaggcttcagtgcctttaatgggctgtctgctagaccaaacctggagaacaggtcctcatatcagctgagggcaccatctccttgaatagcatcagactctatcattcccatcccctgcccctcattctgtgtcatagccttgaacataaaaagtccccaagtctcattcctgtgccactctttccttgcagccatgaccggacttgttgtacccccgatgtaaagaagaactgctttcttatagcacaaaactacttactctgatggaccaataatgaagaaagcactaggagctcttttgggggtgtagtggtgcccccacatgaacatgatggacacccttgggtctgcaaggagccagcatcttacttggtcccacgtcctcctatagctctgatggtggctacacaaactgaccctcttgggacaaggacaaaagatgtcattgacgtagtcagtgctaagagcagaaatgcaattctttgttatgaacattatgaaaaccaccttcctatgtttgtaaaatatttaagaaaaaattggcaaacaattaatgcttaatattttggatactatttgtttttctttgtaggaaaaaaaagttgaaagtttctattttctatgaagcctttcagataccaatttagtttatgcagaaaaaaattgaacaaaacagggtaccagcacggaagactttcttaaaacgcaacctgaattgaatgatgaaatgttgtatgtgtgtttgcttatagcttaatctctttaaaaaatgaacaaaaaaagggaaaaattttaaaatgttttacaattatttaaataaataaatgtgtaacttattgtaagtagaggtagaaattaagacctttttttggaagagagagggatttctcttcctgatgtaaaatgaaaatgatgcaaacatgtagtaacaagttttaaaggtgtgtgattattactgcagttacttactagattcttatcccctgtcctgcaccccctccttttccatcactttattgacccaagggcaagaacatgtagattcccacagaacaccctaatgcagaaacagacactctagcacatgcacaaatactccaacccatcaattcattcccagctccgtctgatttctaaatagtccacactcttgtgaatactttttaaaattcctattattagctttcaacgttctcccctgagcagtccagagaattcccatgtttgagtctgtctcaggctttcagcatcccaaggaaagaagcacctcaccttctagcagagccaaaaccacagactttcttaaccaagggaccccttgggaattcctcctcaccagaaccccaccactccctccgctttgggtgcctggttcagtacagaggtacacagccccatagaacttcagcaacacggtttggagaagataactctgtttgatggactctttagagtcagtcttagaacatccaagtcctttcctctccctgtcaatttccccttttatggcattaaactctcttgaaaaacatagctatgccactcgacagtttctagtcaagaatgagacggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtctatacacagacttagtttggggttcttggttgggatttcagcattagaaatagatgcagcactcatggaaaaacatcatgagtgcatctgagccaattttagatgatttcattaattctgcataccttctctttgacccattgatgcaggcccacatctatccagccccaactgtcttatttgcctttaacccattctggaattacccagtatgacttatattatttctatgcacatgagaatccaaggttttagaaacctggcatgcttataactactgctgacagtccctcatagtcagggcttaaagcgccaaaatacacggaaacataagagaaaaagtcccccagtgagaaacctgattgatggaaggggaagaatgtgtggaatatgaatgttaccttccaaaagtgaaggcagagcaaaattaagcatgtttagccctggatttgagccaatccaacataaggaaattttgttttttttaagtagcattgcttttagaacctgtgaattttccttttgcatgaagatgagtgcagtactgtcttcaaaatgattgtagaatttcttggtagctttacaccgaaaaatgcgtgtaactaaataccagacatcttgaccattcagctagaaccctggcagcaacagagctatttaattgtacaaatgtgtgtaaggattatttttagtgtactaataaattaaaaacaaagctaccctgtcctcgttagtcattgctattcaatcattccagtcccaagttatttttgtgccacttggaatacaagtatttctattggtaactacaaactctatcctgtgtttgtaagaggagctgtgtaagatttttttcatttaaagggacaatttacttcattatttatctttcttttgttatagcgttgtaattcttctcagtttttctttgcacatttcaatatgcatggtttaaaaaccattaacttctctaccttttgtacagtaaggtttcattttcacactgtatagtttcattttattgttttgctttgtcagttatatacagtataaagttgctatgcacagagctttttgtaaagacagcttttttgtttactgtttttaatggtcttacttaaagaatatcttgtttgtaaaatgaatatgtctacttcagttttaaactttaaattatcctaacaaaaaaataaaatttttgtactgtaaaaatgagtggacctttgctttttattttttatttttttggagtggtagtttggaatttgttcttaatgttggcaattttctcataactgctggtccctgagttctatttgaggaaatcttactatagattttgtttacatggaatgtgtactaagttactcccttaaaggagagcatgacttttgttcatttttctgtatatattcatctatatattccatctgttcaaattcattcataaaaaaacccctcaaaactgaaagaatcctgtttgctctgttggattttggctatatagtattcctgaggtaggtgggcagtctcccctgatttgaaattgcttgttgagcaaatgttacatcttgagccgtcagacactgggtgaagaatcgcaggctagaacacaaagacttgatgtctctccttaaatcgtaggaaaggagtgagacgtgtactcatggaagaaaataatacgcagacgatagctcactcaggaagatagagagggtgcagaagctcggagaagacacccagacagaggattggagctgtcagagagggttcctttgagggaggcaaggctggaccagggctccaaagagcagcaggaattttgcagtagaggaggttagtagcgagcagtccagatgggaaggataacataaagacatgcaaagggaaattcacaaagcacacttaggagaacgggatcctacatgtgatttttcaaccagagtattcacaagtgtaattaaaattggattatttcatttctctctaggagggtacagatatcttcaaaccacacgcattgccctcctcacataagtggatgcaatcctgcttctaaacactgaaaaagtcactgtgtttttgcttttctcaatgaaaactagctctctgcctagtaggatattctcccctttgatctgtgcatagctgttgccttctcatccttcaggccgcagtttaaatatcacctactgagggaggcctctggtgaccacctaagatgcagattccccttcttattctccgtaattaaactctgtttgtgcccttttcacactttgcattcatttgtttgtttcctgctggctgtctccctccactttagacagaaagctcataaggacagggaccatatcggtctcaaccccataagtgaccgaggttctcaacatgcttgttggatgagtgaaccagcagactcagttcggactcccagaggtggccctgccttgtcatgtgggagaggccactgatttgttacaaacgacagaaaatggcatcactggcagaatccactccttagggactctcttgtcagtcaactaatcaaaaaaattatgaagtgtgtctataatgtaatgtggctggatgtttaacagagaaaactcaaaatgggaaggaaatgaggaggaagcaacctctggctggtcgcctgttggagaggttgctcagccctggaacttatcccatgtggattctctcactcggatgtgattctagaaccagaatctggatcttttagagaaatgtacattccattcctgctccaggtaggacaatgttaaccacacacttgaatctcaaagagtctttggtgcatttaccaaatggcaagaagtccagagtggctgttgggcactgaatgtgagagtgtttagatttgaaactttaagaattaggtggggactatgtcctaaaagactgttctcaatgccaaagactttagacttcatacactgatctatactgcaggtaatggaactcaaagaaacttacagaatgacatgatcaactttagactttagataaatcataataactacaatgtgatggattggagaatgtagatattagaagcaaggagaccaattaggcaaagaccaaagacagctgatgagcaccagtgttctgggctattgtttatgactggtgtcctttctaattgctcagcatctgtgtggcaccagttgtgaaatgttttaaaattgctcctgcaattaagatactattgaaatagtctaaacacaaatgactcatatttgaacaaggcatgacaatagagatggaaagcggaggaaagattttagagaacgttttacagtttgacaggagttatcgactagtgaagtgttggaatgaagagaatgaggtgactaggataaatcccagtttgtcagttagacaatcagatttcgggatatcattaactgaagtagggagtgcagaggggggatatcttgggaaggttggaaggaaattattttaaattgggacacacctggcacacatcctcctcttccttcttggttcactgaaggttgttttctagcagtttaatcaagaaggacttaggagaattatgctccttggttcatgcacaccaaaaagagattatttctatttgagtggctattggttaagtattaaatctaaaattgggggggttatactttgaggattcataggagtttttgtttatttgctgtgttgctgtggcgatgtctaaagccatgactttcttctcctctattattttacttatttaagcaaggcaatcctataatttttttgtgtaagtcatgacacttttgagagtgagggaaacacaatacataattatggctggaaaacagatgcaaattgagactagctcatggtctctttatttacaagtgacttgatctttttgtctgtcagccccagaggctttctatgggaagccagtccctttaccaggatatagctggatgttgattgtcctgagtcatttttttcccagtgttccctttcaatgtgtagattcaagtagtcttttatttctggaaactttaattacgatgttaaaatatattctctgttccttcattctggtccttctggtccccttttctggtctttctaaagacacaagtgagactctctagtctccatcatttgtgtccgtcacatcctctctaaatgcatgctgtttgcttgcctttctcactcttgtctgcctttgtgttccttctaatttctcagtggcttttattttttctttcactattttcatgagttgtgccaggttatatttcatcggttttattgtgttgcccattttcatagaactgctgcatctctgcattgagctattgtttcatagaaatattggtttttaaaatgattaaggcaatgagcttgatcagaattaccaccagctccatgagaacctttttctttctggtgactatccatcaactatccattgttttcctttcctttttctttcccctctcccatagtgtatgcatatatatcatattctgatacctttttgacagcatttatctttgattgaagtgaatttttcctggaccagctatttgccagaagtttgggaggggagggtcagggctatgtattaggataacaaaaattcttatttcagaattcttacgtgtgtacatgcatgtgtgtgtgtgtgtgtgtgtgtgtgtgtgtgtgtgtgtatgtgagagagagagagagagagagagagcgtgcgtgttttgtttttttgttttttttttttttttttttttgagaaggagtcttgttctgtcacccaggctggagtgcagtggtgtgatctcgggccactgcaacctctacctcctgggttcaagtgagtctcatgcctcagcctctcaggtagctgggattacaggcatgcatcaccacatctgcctaatttttatattttttaatagggacagggtttgccatgttggccaggctggtctcgaactcctggcctcaagtgatcctcctcggcctcccagagtgctgagattataggtgtgagccaccgcacctgccagaccactcttccttgccaactggccgcttcttacatctatggcttgtttgggtgatttcctcattcagttctgcctactgagcttcatctctctgccagatgaggtccagagataacgtctgcagtcagattccatgctcatcccagtcgttacaaacaagaggctgctggtttgggccttcgagatagtcctactctttccccccagctttctctgacgtcagcagctgaagcagcctttctcagtctctccacattcctgtttaattttcacagccattgccacccctttctcatacattgtgatttggggtaacctgttttcctagtttcatcaaaaaataaattcacgcctctctttctcatttctctattttnnnnnnnnnnnnnnnnnnnnnnnnnnnnnnnnnnnnnnnnnnnnnnnnnnnnnnnnnnnnnnnnnnnnnnnnnnnnnnnngtcatagaatagcactttagtctggatgtcagccccacgggtaattcaagaaaaagggacaactacacagcaccgtgaacttcattctaccaccatgtgtcaagcttacctctgacttcgtagactacccttgataaccagctctgcggcccagctcagtgacactttctccattggatcctttccattggatcactttctccattggatcctgccaaatacagataataaaacacaggcaatttcccaaataacaaataaaagtgatcatccagctgaagtttattatgatgaataatacacagaaaggaattcattgcctgactcttggaaatctgttgaagggcacacgaactgtcacaccattgggagtattgaaggagatggttttttggttatttccctaaaactgagcccaccttttacagcaaaaccctattttccattcatttcatgaacagaagacagtgtcataatgtggaaatatctaggattcagagatctggattcaaattcaagttctacaatccttagctatgcaatcctgaataaatcactgcattattcttctcaagtgtaaaacaaggacaaggacaactacacaggcatatatgtatacgtagatacatgcatatgtgtgtatacatataactacatgcatacacacaaatagttattaggattaaatttaaaaatatatgtactttaaagactgtaagctcaatgaagtttgaatgtatttttctggctgtttcattcactactatattcctagcacctagcatagtataatacttgagaaaagcaggcactccataaaaaattaacaatttattgaaaatgtaaaatacctacatgtgttagaggttcattaaattcagcaacaagaacagcttcaacatggacttttggagacacagacttggatttgaatcccagctttcccacttgccagtaccagcacaggaatggaacaagcagtgacacagtattctctggttcatcatctttgaaagagcaggacttcagcacctggtcctgccttgggggtcagttaacatcgtcctctcaacagcccgggttgcttatctgatgggtgctaaaaaggaaagcagtcaagatacgggtttcactccagttcatttgtggacaaaagagtgactagcaataggaccattatttggccatggatatactttgatccaacagtaaaaattaggttagaacaatgggccgcatacccaggaaatagttcccaaggtctcagtgtgcttggaagtgagtggtacagccaggagaaaccatagtcccaggtctttgtaagtgataataggaaaaaaaaaaaaaaaaaaaaaaaaaagagtaaaggatgtgtcctaaccgccagtccattttcttccattaaaatttaacaagaattttcttatcagagattagaacatctggtatgtcatggctactacttttgaggacaaagcaaacattgttttcaatcccagattttcacaagtccaagagtttgaacccatgaaaaattgctcttaaaacaagaatgagaccaaaatgacttctaatacaaaatccaaatattaccacttttgaactgagcaagagcagaatagttgcatagaactctaagtgtctcaaagattagggctacataaatttgaagtattatggtcattaaacattaataatacttgtttataataatgataatgactaatacattggaaatgctaaacttccactctttgccctgtggagtagcagaatgagtgttagcattggaaaccaccagacatgagttcaaatcctgcctccatccctcactataattatccttacaagctgcagtttcaccatctgtaaaaatggtgataagaagacctttatgccaagattctttgcctgccaagattgttgtgaggtttaaatacaataatcaatgtcatagtggcagacacagtaagtgtttggctctatatgtttgtttctttccccttagcctgagataaaaattaacatgtgtttatctggaaagccacccatcattctttccttacaactcctccctggcagcacagaaaagaggactattaattagcagtgtttgtgaaacacttagaagatgaaagtgctgagtgcagaacagcaccatttacatcacaatacatgagttggctgctccttcaagtggatccacttacaatgtaaggcaggcctaatggatgtgttcgtgtcattcaaaaatcaatgtgggagtctctggaaaaggcatgtgtctgcctgctgtgctatagccagtccaatgcagtaggagggcaatcctgaagaggcaattgatggataatgctctaacacagtgatccctaacctttatggcaccaaggaccagttttgtggaaggcagtttttccacggaccagaagagggggatggttttggatgattcaagcgcattacacttattgtgcactttatttctattattattacattgtattaatagtatataatgaaataattatacaactcaccataatatagaatcagtaggagctctgagcttgtttccctgcaaccagatggtcccatctgggggtgatggagacagggacagatcatcaggcattagattctcataaggaacacccaaactagatccctcacatttgcagttcacaataaggtttgtgctcctttgagaatctaatgttgtcgctgatctgacaggagacggagctcaggcagcaatgcaagagatgggagcggctgtaaatacaggtgaagctttacttgctcacctgccgctcacctccagctgtgtggccctgttcctaacaggccatggattggtaccagtccatggcctagggattggggaccactgctctaatagccatggtaatgagaaaccagaaaggaggtcaaaactttatctaattgaaacctacaaacagccctaaattccctttagcaacaacaagggtatctggtggattttggtttcacattgtcttctttccctggcagatcttagaagaagaaaatcaattctacataaatggcaaaagcagtgttccccaagctggggctgacagacccctgagaaaaaagcattacgtgctagtggaggagctggaagttgtggatctccaacactgatttccaatatttggttctcctctgctcctgatcacatgcgaaaattacactttcccatgttgtttcagcaaaacatcatccatcactgtaaattaatgttgttaatattgaacttactgattttgtggttttgatggtttttactttgtgaattatttttattaaaacaagcatatataaaagc

SEQ ID NO: 1283 - DNA, 2217 bp, Homo sapiens
atgtttggaattcaagatactttaggaagaggaccaactctgaaagagaaatcgctgggcgcggagatggattcggtcaggtcctgggtccggaatgtcggagtggtggacgctaatgtcgccgcgcagagcggggtcgccctgtcccgggcccactttgagaaacagcctccttccaacttgaggaaatccaacttctttcacttcgtcctggcgctctatgacaggcagggccagccggtggagatcgagcggacggccttcgtggactttgtggagaatgacaaagaacaaggcaacgagaagaccaacaacggcactcactacaagttacagctcctctacagcaacggtgtccgcacggaacaggacctctatgtcaggctcatcgactcggtcaccaagcagcccatcgcttacgagggacagaataagaatccggaaatgtgccgagttctcctgacgcacgaagtgatgtgtagtcgatgctgcgaaaagaaaagctgtggaaaccgaaatgagactccatcggacccagtcataattgacagattctttttaaaatttttcctcaagtgcaatcagaattgtttgaaaacagcaggaaacccaagggacatgagacggtttcaggttcataacaactccaagcatggacggagagcaagaagactcgatccatcggaagctaccccctgcatcaaagccattagcccgagtgaaggctggaccacaggaggagccatggtcatcatcatcggggacaacttctttgatggtctccaagtggtgtttgggactatgcttgtatggagcgagctaataacccctcatgccatcagagtacagactcctccccggcacatcccaggcgtggtagaggtgacattatcttataaatctaaacagttctgcaaaggagccccaggaaggttcatttacacagcattaaatgaacccaccatagactatggcttccagagactgcagaaggtcatccctaggcatcctggagatcctgagagattagctaaggagatgctgttgaaaagagctgcagatctagtggaagctctttatggcacaccacacaataaccaggacatcattttgaagcgagccgcagacattgctgaagctctctacagcgtccccaggaatcccagccagcttccagccctctctagctccccagcgcacagtggcatgatgggaatcaactcctatggcagccagcttggggtcagcatctcagagtcaacacaaggaaataatcaagggtacatccgcaacacaagcagcatctctccgcggggatactcttccagctccacgcctcaacagtctaattacagtacctccagcaacagtatgaatggctacagcaatgtccccatggccaacttgggtgttccaggttcaccaggatttctaaatggctcacccaccggctctccttatggaatcatgtcatcgagtcccaccgttgggtcttccagcacatcctccatcctcccattttcctcttcagtttttcctgctgtcaaacagaagagtgcctttgcccctgtcatcaggccccaaggctccccttcacctgcctgctccagcggcaatggaaatggattcagagccatgaccggacttgttgtacccccgatgtaaagaagaactgctttcttatagcacaaaactacttactctgatggaccaataatgaagaaagcactaggagctcttttgggggtgtagtggtgcccccacatgaacatgatggacacccttgggtctgcaaggagccagcatcttacttggtcccacgtcctcctatagctctgatggtggctacacaaactgaccctcttgggacaaggacaaaagatgtcattgacgtagtcagtgctaagagcagaaatgcaattctttgttatgaacattatgaaaaccaccttcctatgtttgtaaaatatttaagaaaaaattggcaaacaattaatgcttaatattttggatactatttgtttttctttgtaggaaaaaaaagttgaaagtttctattttctatgaagcctttcagataccaatttagtttatgcagaaaaaaattgaacaaaacagggtaccagcacggaagactttcttaaaacgcaacctgaattgaatgatgaaatgttgtatgtgtgtttgcttatagcttaatctctttaaaaaatgaac

SEQ ID NO: 1284 - protein, 554 aa, Homo sapiens
MFGIQDTLGRGPTLKEKSLGAEMDSVRSWVRNVGVVDANVAAQSGVALSRAHFEKQPPSNLRKSNFFHFVLALYDRQGQPVEIERTAFVDFVENDKEQGNEKTNNGTHYKLQLLYSNGVRTEQDLYVRLIDSVTKQPIAYEGQNKNPEMCRVLLTHEVMCSRCCEKKSCGNRNETPSDPVIIDRFFLKFFLKCNQNCLKTAGNPRDMRRFQVHNNSKHGRRARRLDPSEATPCIKAISPSEGWTTGGAMVIIIGDNFFDGLQVVFGTMLVWSELITPHAIRVQTPPRHIPGVVEVTLSYKSKQFCKGAPGRFIYTALNEPTIDYGFQRLQKVIPRHPGDPERLAKEMLLKRAADLVEALYGTPHNNQDIILKRAADIAEALYSVPRNPSQLPALSSSPAHSGMMGINSYGSQLGVSISESTQGNNQGYIRNTSSISPRGYSSSSTPQQSNYSTSSNSMNGYSNVPMANLGVPGSPGFLNGSPTGSPYGIMSSSPTVGSSSTSSILPFSSSVFPAVKQKSAFAPVIRPQGSPSPACSSGNGNGFRAMTGLVVPPM

SEQ ID NO: 1285 - DNA, 39405 bp, Mus musculus
  misc_feature (1)...(39405): n = A,T,C or G
caaaggaacacaatgagtaaattcagtgccaaatctcaaatccagagctgactgacagccaaagaactttcctctggagtattagagacacatagagagaattgctgtagaagctaactgcactttaaaaatggacttttctttctctgtcagatcttaggacaatatctacccactcaagtgtagagaaattcctaggcagatgctaatgttgactcttacaacccaggaaccatagtcaccagcatgataggattcagcaacactttgcttggccacttgagtgagaaatcctgactcaaagtacagtggcagctccataggaatattacacacacacacacacacacacacacacacacacgggactaggccaaaaatttcttttttgaatacctagacattcaacaataaatgggtgaagaaaaaaaaaaaaaaatcaatgttttttttttttttttttttttttttagcaagatgttcagacaatacaaaacttagaccttctacttgtcatggtctctcccttcacacaccacctccccatcacagtattcagccgtgacttaacagcactaaactattattacttacttctctgccacaatttctcccatctgtaaaatggaagctactagtacctatatcatgattataaatgtttgttaaaatttagttattgttaacctagtgtcatgtaggggaggaaatataacccaatgggcttttgattcaaacgtgaattctattcttggcctcagcactgaggacctgtgcaatggtggctaaatttctgtttcctcagatgagatgattacagttataacaattctaattgtgtttaccttctagattgtctgaggatctttaagtgaaataataaactaattactacaagctagatactgtataataatgtaacaattattttactcaagttcacaaaaatctattccatctgtaataaaaaaaaaaaactgatctcatcttctattctcagtattattatttccccttaatggtaaaggaaaaaaaaaagtgatatagcattatatgagagaaaaagaaacctataaaataaataaaactaggacattaaagcaaaaagaattcctacctttttgtgttcactgaagaaacattgaagatgggatagacagactctggggaaactgttagggggaaaagcagcagaagattgcattactgaatagaatctcaggtctgactcaataagactctaaaggttgttaagaacaaaaaaatttacgctgcctgacttaagaccacaattaagacaggacaaatggtcaggcagtggtagtgcatgcctttaatcccagcacttgggaggcagaggcaggtggatgtctgagttcaaggccagcctggtctacagagtgagttccaagatagccagggctacacagagaaaccctgtctagaaaaaccaccaccaacaacaacaaaaaggagtcaagggagaaattgctagagcaagggaaatactgaatgagaaactagcataagaaactaagacagtgctcaaaatacaaagatgagacataccaaggagaattaagctgaaaacaaccctcatgatcaaaacagaataatttcagcaataaaaatatattagatttaaatgcaaaaaaaaataagcattcacttatggtattaagtaaaggaataagagcgataaatgtaagagggtctaactccctagagagcatagtagggcagatgagtagatgtctcagcagacaaacctcctgaggtggagacctgatcccaagttcaacccatggaataaaaaacaaaacaaacaaacaagcaaacaaaaaatcaagatgcagagtttggtgtgtggaatcctagtactcctatggagttagagagaggagaatcatcagataccacaagctagttagtgggaatacagaaaacacaaacaagagaccctgactaaacatggtggaaacaagagaagccactctagaaagctatcctctgagcgccacacatgcaccacaccataagtgagcttaggaaaatggaaatagccagagattgcctaaggagaaccgtttcctttgtctgaagctgtaacctaaaagcccctttcctgcatttcaaagcatactgcatagacagcagcagtttcccagagataaacagatattagtgataagcacagtaatttttaagaaggcctggaaaatattagtatatataaaatctcatattgatacgcacaatgaagcactgttacaagttgctaggctagttaatgcaaaccttcttacttacttgtcttgttctcatcaagtgaattctctgaaggaaaatcatgtttatcaaggttacattcctttgaagaaactactgcacctgagggattctaacaataataaacaggttaacagaaatatagaacatcccttatccttagttgtattgtcttcaagtaaacaaatctcaacaaaaacatgtgtaatacttcatagcatgactcaagttttcaatctacttttttttggaaatttcctctgcattcactgaatgtggttcatcttttaaacatcagagagcagaaatagagactgcaatacttagaaaaatgcatgcttcaaaagttggagaggggctggtgagatggctcagcaggtaagagcacctgactgctcttctgaaggtcctgagttcaaatcccagcaaccacatggtggctcacaaccatccgtaatgagatctgactcccccttctggagcgtctgaagacagctacagtgtacttacatataataaataataaataaatctatttatataaaaaaaaaaagttggagagatagatagcacagtggttaatagagctctggctgcaattctagccaggttctgttctcagcacctacttaatggtttaactgtctgtagctccagttccagggaatctagctccctcttttggcctgagggcacttatacacatgtgcacatacttattgacaggtggaacactcatacacattaaagctaataataagtcttttacaaaaaagtatgcttccagatgaagatgttgtaaagcaaattgtataccattcttttcattataataaaattaacttttaaaagttagtggaaatggaaaaaaaataacaaactttctcttaatctagtaaggtaaacaaattctcatcatgaactcaagactggtagtttaggttggtaaagtttttgctgtgcagaatgaggacccaagttggaccccagcatcagtttgtgcttgtaatccctgggccagggaagaaagacaggcagcatagttggatcctgggctaatgaagagcccctgtctcaaaaaaatccaaaatctgtttttcaatagtagcagagaaactacaaaagcaaagtagaaaacttcctgctaacatttcagaatatactacctaaagctaaaggagagaccacaggcttttttctacccatctttaactttatattttctgtttttataaaagtggctctccaaactgtaaagaaaatcaaatttcattcacttatgtgatctacataattatacacataatttatatctaagcatcattaagtcgccagctgttcttaaatgatacatttagctttacctttctcagtttctcttcatttttacttcttgcattctgtactttaacactggatttctcatccactagcaaggactttggtatttgctttgcctctggagcaccttcagggacttctggtaaatttttctgcaaaagtaagggcttatcttccagaggtaactttttaagagagtttcttttcctaacgaaaaatgctgctccgccttggagtgtaacttgaggctttattttttggctcagaacccgaggaggagaatttggataattttttgctggaaaacaactgttctcttggtccacaactggcttataggtcacttgatttggcttggaatttttcaggtttcttgatttagacttgatgtgcttataatttggttgatatttggcagttaaactcttctgtttttttttattcttcttggtacagactggttttctctgaatattttctgtcacactgggaataggtttatctccactttcagttgctagacaaatagatctacactctcttatcaacttcctctcgagtggattgaggtagtatttctctttactgtagaaagatacagtagacatagctggtttaaataatgagctgtggtttgcaaatgaaaacctactattttcagttgttttgagtggacttgaagggaaatggagttggtgggagcaagacttgtcttccttttgaacactgctttgataattatgtttcttattaggtgatggaaatagattttcagcacatcttaatttgcttgatgaaatatctgttaataggctacaaaatgaaaagaaagtccattggtaagtttgtggttctttttcaaaatttatttagatccactagtaaacttctccctactagtcataaaaaataacacatcccccgccattgtttgacacattatttgttagtttaacgggatcctcaaattctgtctttattaaatcatttaaatatatattcataagctgggcaaggtagcatacacctttaaccccagcactctggagggagaggaaataggatgatctctttgagttagaggccagcatgatctatatggagttcaggacaaccaagattacatagagagtccctgtctcaaaaataaacagatagtgctaggcgtggtggcgcacgcctttacttccagcccttgggagacagaggcaggcggatttctgagttcaaggccagaactacagagtgagttccaggacaggcaggactacacagagaaaccgaaaacgaaaaaacaaacaaacaaaaaaaaacccagataacattcataaaagcaagcagtgtttacaaagaaactttgatatacaagtaagtgtatttcaaaatcaatttctctgtctaggctatataaaaattatcccacactaggtctgggcctcgtggcaaaggcaggaagatctcaattagcttgaggccaaccaggtataaataattaagactgtttcaaataaacaaatcaccaaagggctggagggatgatggctcatctgttaaaaatattctccatgtatttttcccgattagctactaaaataccctatgataaattttctgtaatagacactggcaagactggattttttcatatttaaaagagttcatacatacaggttaagacttacctatcatcattatcagcattcagtgtatatcgcttcctctttcttggagtacaagttgccatcatcttagttaaattcctaaaggcagcaaatatgtcagttataataaagtcaccaaaaggatagaaaacgcaccatgtcaaaattgtttataaatcttgattctaaataagtgactgcaaataaatacccaagggaacattgctttttgagatagtgcttcacatagcagagcttagcctcaaattcaaactcattcactctgtcgccaaggataaacttgaactcttgagctttccagaactggaatcacaagctaagtcaccaggcttggttccaagaaacagattaagaaaaacaacaacgaaccaaccacagaaagacaaacaaaacctagtcaggtgtgacggtgcaaaatgggaggcataggcaaagggaccctgagtttgaggcaagcctggggtacagggggtctcaaaaaaaaaaaagcaaagcagtaagctatgtattagagaagtaaacagtgataaaagggaaggagggtgggttggggaaatactgcgctacagtagatgagagtgatgaaaggtgatcctactaacgaggccgggtggaaccctaattggggtacacttccctttaattaaaccagtcacatcaagttttggcactcctggtaggcctttggcactagcctccttccatggctcctccatattccacttagcacactttctgactgaccagccagtcatcttcacagcctgcacgttcagggaaggcagagattgctcacacccttcctggaggtctgagcgaggtaatatgggtgggacaagtcctccccacgggtcccggcggggctccctcacctcactaggcagcttgctaaagtcaagccgcgtcccttagggagataattctagaatgttctttccttcctttccccttccttcggaaagggtatgtcagtcccacagaactccacaagcgcgacctctaagccaacccgagcgtctacggggcaacagggaagccctctccttgcctgcgtgagagacgctggcacccagagcgggagccccgcgggaggagcaggcagcgggctacgttcaaggcccttgccccttgacgttaccttcgttcctcagtctccttctggaccggcgtccacgcctgcgggggtaccgcacgaaatgacccctctgcacctcagcaagcttacgaccttgctcacaggaacccggcgctccgccagtgtgttcaaattcacgcgcgctacttgagaccaacgctgctgcgtactgattcgtcactgctcaggcgcttcctagagcctgcgccgcgattggcttctcgctagtcattgccccgccctccggcgaggaggtctccgagattctcccgcccttgagaggcaaagctggtcagggggagggagttggggggaggagttggggaagaaggaaggcacacctcctgaaatcctgcaataacttcaggcttcagaccgacgcccgtaacagtgcattctgggaattgtagtttatggctcagctgaattggaagttaaattctgaggcagtttggtgcaaacagctaacgaaaagtgacatccccaagatactggaggctcttatttttcatatttgaagccctattgttggttttgcgttttagaaaaaaaagtgagattttcagtttccattttactattttattattcaaattatggtgtgaatgtttgctaaatttggttactttatatatttttaaagattttatttattttttgactatgtgcatgcctgcaagtgagtatgtgtatgtgaatggagataccagcataggtcagaggagttgaattccctggatcaagtttagacagttataggtcaccaaatgtggatacaaggaattgacctcaggtcctctgcaagagtagtctgtgttcttaatagctgagcccaatctcttgagctggatcctttacatgttttatttcacgtactccttacacaacctatgaagtttgtattatcattcctcatttacagaaaatgaaaacgaaggcctgaacacaatcactatttacagggaaggcctgtggcactccaactccaatcaagtgtcttttggcaagcagaaatgttcttaaaacactcacaggcttttaaggagttattagtgtctagaagtctcagacaaatgttgaaaggaaataaaacttgagacctgtgagtcacgtaatgtatgtcaaatagcccaaagagttgtttgtgagctttgaaacctggggctgagaacatagcagaacagaccaggacatgcctgggcaggcccatcgcctccctatctcccacccctctgacttaagttaaatgttaacaggctgctgatgtttaaatggaccaatcatgtgaaactgcgccaattcctcccccagtcccactccttttctataaaaacccctagcttccaagccactgtctcctgtgtgagataccggagctccgccattaaaatacccgtgttgttacatcaaggtgttgtgttctattcgtgattcttgggtgcacgctgaattgggagctgagtcggggtttccccactaggttctttctttttttttttccattttttattaggtatttagctcatttacatttccaatgctataccaaaagtccccccatacccacccacccccactcccctacccacccactccccctttttggccctggcgttcccctgtactggggcatataaagtttgcgtgtcaactaggttctttcaatgtctagttctaaataagtctaagcgatggatgtccttcttcatagaacaaagctggctggaatgaattgacaaatggctaacatattattggctatttgcaggaatcatgagtgagtcagctactcttttacaaggtagaataaggtttctactaggcaatggtagaacagtatgttttgttgaggaagatgtctttgaatcggaggcctcactacttcaaactctgctacaactctgcctcctgttgtaatagggcccagaccttaacagaactgactccatgatgaaagtgtcattcaggctataaaactcagcacatagacctgtcaaaatgaaaacaaagatctaatccatcagagtccatagttctgggaaagtctctaaatgcactaagcttgctttctgacttctgtagttcttgttaactgaggaatgtcaacccagaacatgtttttttgtgtgtttaaaagctcaccctgaggaaagactgagaaaatgttgcactgggatcccaaacatccagtgtagtatccggccaactaaaaaagactttctattggtttaaacccatgttggagcagtcttctctggtggatagcctacaacattgaccagcaccaggaaacccagaatgatagtgggttttgtaaagtgaaagaattagaacaatagtggaaactgcttagtgggagactctggctagtttcttcttttgagagagttaaagccaaagaggggacatttttaccatcaggttctacttgcctagaatttcctgctctatgaaagactaggctctccagggacggtaaaactccttttctgtagcccttttgtgtggtctgacttttggagcttgttggagggatacagcccgaaatggactctcatattttttctttatcagaaataagaaaaacttccaagtcaaacctaggaaggctgtggaattttgtaaatttatagcaagaggttctgaacttcagaagtttggtatttgttcagtcttgtaggtaataaggagcagacattagatttaaaggaacaaaaaatagccctactcggaatcccaaaaaaggagagtgtctctgggtagtaacagtaacaattcatttgagaaccttctgtcctcgatgcaatttagttcattgtttgactgggcaagacagtgcagcatttcttccatcttgtattcttgctgaggccatctcaggcttagatagggtttgatgaacattacctaactctattctgactagtttggtcaagtcaacaaacaaaaaacacaacaaaaccctcacctatgtcaagtaatgggagaatgagtttatttaaaaattggttcttggggctggttagatggctcagtgggtaagaaagagcactgactgctcttccgaaggcccggagttcaaaacccagcaaccacatggtggctcactatcgtccgtaatgagatctgatgtcctcttctggtgtgtctaaagacagctacagtgtacttacgtataataataaataaatcttttaaaaaaattggttcttactgagtgcctcctgaggaaatggttacagggacccttaaccatgcatgaaaaaggcagtttctgcacgcatggagcccatattgggttgagtgggaagacataaaaagcgatgaccaactctcgtgtccacttagtagagcctctgaaaataaagtctgcccttagtattttttctttatgacttcaaacaagatgtatttccccagctaatttctttcaaccagacgcttgagcggaatcctcaaaatccccgggacacctgctcttccgccaacacccttcccttcgccaggactaaagatggcgctgacaggacggcgttgtgacgcgacggcacgtccgccggaagtgtcctgaggagagcctggaagccggctcaccctcgcgccggcggtatctcaagcttcgcgttttgagtaggagtcgccactcttctaccaggatcatggtgttctacttcaccagcagcagcggtgagtgacgccggggcccctgcttccaaagccggcattccccagccgccgcgctgggcttggacttagtcctgaaccgcgtccttccgcgggcacctctcccagagccttctggttccctgcttggccgtcccctcggctgcctggtcgtcccctggccccggtggtcgcggcgggaatgcgcccccgctttctttatacccggtaatcattctcgtccccacttgacagacccgccaacgcttcctggacgtgtgtgcgttccagcctagtcccccacgtccccgtcgcaagcctttgccctagcgttctgcccgcaccttggagcgatgcttgaccagtgcgacaggtgccagcagatgtctcctgcaggaagagtagcttgccctcctacgcagggagggcctggggtgccgcggagagcaatcggagggctggaatgttagtacagcccctccctgggcagaggtgatggtccagtggacgtctgctaaggctactgggttggttttggaaggccagaaagagctgtttcggtttccaggaaatgccgcgtcaacttagtttctctgcccatattgtccagaatcaatttctaattttaaactctcaccccattaaaatagcgcttgcctttttgaagacactgtgtgagacccagtttcctcgtcaagataaaatatgcatttctttctggaccccccttaacattcctttaggactgctctcatgtggtattaaaaggtgtctgcttgagctaccgggcaggtctcttgaggggcagtctgtcttgtctccttagcatagtgccctacttacacagttggctgctgtgttgatttttgccccttcttgagacagtgagtggctcaggttgcttcaaacatagactctcctgcctgaaggctccctgacgttggcattactttctaggtccccagatctggagttattgtttggtggttttgtctcttagtactttttagtttgtttatttttgagacaggatctcattatgtagcccttggctggcctagaactcacagtgtagatcaggctggctttgaattcatgctaccctctgctctgcctccccagtgccgggattaaaggcatgtactacctagcctttcatgatacttttaactgaagcattattttgtgaagcgtccttcagtgtgaggtgtttgtttgtttttcttttttgtagccatgctacttctaaaaattattttatgtctgtaggtatttttcctacatgcgcatctacatactacttgtgtgcctagtgcctatcaaggccagaagaggatgatagatcccctggaactggagtgacagacagttgtttgagttagagtgtttgtctagtattcctgaagtctggggtttgatctctaataccacagaaactgagtatgtggtccactcctggaatcctgtgatccaggaggtgggggcagaaactccctggccttctaaatgtatggtcccttggtccctccctccacccctcctctctctctctctctctctctctctctctctctctctctctcttgcatttttcgagacagggtttctctgtgtagccctggctgtcttggaactcactctatagatatagaccaggctggcctcgaactcagaaatccgcttgcctctgcctcccgagtgctgggattaaaggcgtgcgccaccaccgcccagcgaatgtatggtctcttaacttttatttgttttttgttttttgtcagtctcagatagaccagactgccctaagccagcctccgtagctaaggacagcatgaattccagacccttctcccactcaaatgctgggactataggcatacaacaccatcactgccctgtgtgtgttctgctcaggggtacagactctccagccaactctgtttctatctaccaggtcttgtgctttgtagactgaacaccatctcacaaatttagctccatttagggtccagcaagttttggtagggtgtgtacctagttctttcagtcctaatcttgtactttagaatcaagattaaggaaagctttctaagcaacaaaatgctcattacttcaatgtaaaaactaggatttagcttgtttgaggtagctggagggcgttagagccagtgtttggagaagtttgagaactgtggttcccctgagtggaacagggcatccaccatcgtagcacaatgagatataagcaatgccagctagctaagttttaagaatacattatattcattacatatactatgcacacacacatagacacacgtttttatatagttgttttgagacagggttttctttgtgtagccctggctgttcctggaacgcactctgtaaacctggctgacctcaaactcagagatccacctgcctctgtctcccatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcatctttggggacaagttactgttttacgctcagtaagtacttaatgagttcgaggccagcctggtctacagagtgagttccaggacagccagggctacacagagaaaccctgtctcgaaaaattagaaaaaaaaaaaaaaaaaaaaaaaaaaaaaaaagacttatgcagtctatagtttagtcttggcctgctgctatcagtcatttaaaaggatacatcttatgcttaactcagaggatgcataagagcaggtaggtgagccaggtatggcccatggccatgcaatgggtccccactaattgtctttttatttttgttttattttagttaattcatctacttacactatttacatgggaaaggataaatatgaaagtaagtttacaaaagcatttgattttgaaattccaggcaggtaagtgctgttcctgtgcccttgttgttgggtttatgtgttttgttactgatttatttaattccttttgaaaattagactggacaaacaacagttgcccacatttcaaatacagtgttttgatacgtgcacacattgtgtggtgatcaagttgaaatccacagcatatctgtcacctcaaacattgattattcctttgcagttagagtattcaacatcctgtcttctagctgctgtagcatagactttgataactgtatttaccctgcgacagaattccagaagtgctcctaatagatcattgttttaccaattgactagtgtctcccagagctccccagccaccagtagtctctacttctatgagggttgactttctgtctttcctctgcttgtcctgttcagcggggcctggcatgtagcttagctgtagtatgtgtcccttggatgtctgtcatcccagcattataggagatagtagaactgagggcctcctgaagccgaacacaaatactacaactaagctacatttttgttttcacttctgagacaagattgcgctctgtatagcgcagaggcttagaattcagtcagtctcttgcctcaccctctggagatcggtgcggagcttacgaatatgaaccactctgactagttcaagttgaccttcttggtggtcaagacagcacagagttttgcaaccctgatcctcacagtgaaggtgagagaagctgaacctcaggaggagctggagagaagagtgtcattcctcaagattggaaaatacaggtagtgtgagggtttagaaaagacagcttgaagtcacgccagaatcagctccccagcgaacaagctgcagttatgcaacctcttcagacctccgagttcttagacatgaaaggctcatgtagctactgcagagggttgtctagattaaggaaaaggacctgtatgcagtgtcttagagttttattggtatgaagagacaccatgaccaaggcaagtcttacaaggacaacattttattgggttggcttacaggttcagaggttcagtccatcatcatcaaggtgaggagcagggcacatgtaggcaggcatgatggtggcagagctgagagttctacatcttcatctgaaggctgctagtggaatactggcttccaggcagctaggactagggtattaaagcccatgcccacagtgacatacctactccgagaccacaccttccaacagtgccactccctgggccaagcatattcaaaccttcatattccactccctgactcccataggcttgttcaaacacttgagtttataggggccatatctagccatagcataattacatttagtccaacctccaaaatccccatagtctgtagcattattaacaatgtcaaaagtccaaagttcaaagtctcttctgagatccatccaatcacataactgtaatccctgaatcaagataggaaaccaactgggcaaactccaaactctgcatctccttgtctgatgtcaaagtagttttcagatctccaactcctttctcatctctgttgactgcaacaagcttcctttcctgggctggttccactccattagcagcattcctcaggtgatatcccatggctctggcatggcgaaaatattggggttgccaaggcaaattcaacattgcagcctcttgtttcaatgtctgggatccacacgtgatcttttgggctccttcaaatgtcgcttctccagctctgccctctgtagcactctaagctcaggttgattcactccactgctgctgctgttattggtgatcatcccatggtactggcatctgcaatacactgggatcttctgctgcgactaggcttgaccagtagcctctcataggctctcttcatggtgccaagcttcaaatcctttgcatgactctttcagtcctgggcatcaactgcaactgaggctgcacctttaccagtggccttccgtggcctctcacagtgctaagcctcagctgctgttcatgacccctttcatgcctttaaaaccactaccacttgggtgactcttacccattaccaagtacagctgcagcacaatgtacaaccttggctctctctggaacacagtttctttgtgctttcagaaaacacttcccagaagatttcagctcaggatgctggtctcttaatcactgctaatttcttagcttcagctaaccagcatcaattgtcccagtagtcccttctgtttttccagccagagtcacatggctgaagctgccatgttctactccctgctggggctggaacatgctcccaccccaccccacccccttattctgttacaactccctcactgcctaagtgtggctttcctggaacttgctctatagattgaccttgaactcagagatcttcatggatctgtctcctgtaatgttgggattaaaggcttgtaccaccacgactggatttaagcttttcttctagaacatgctttgtcccaggctggccttgcactgtttggttttgtcttctgggattaaaggtgtgtaccaagatgcttggatctaaatttagctggatgggatcttgccctgaaatcccttaatctgttatctcctagaacacaggatttagctccatttcacttcttttgcccctttaatactcgaaccatatattttatatttttccttctatgcttgctatgcttgttcagaacactcttcatgagactgaaccagagatcaagtctctgctgggctttttttttttgagggttccattgtcaatgcaattaatataaatatctttaccttagactcaggtagactcttcagacaagggcaaaaagcagccacattcttcatcaaaataccacaaaaacactctctaggccacatactgaaattcttctccactgaaccctcttgggccaggtctgcacagttcaaatccatctcagcaacaaagtgtttcatattcttactaggagagtccattaagcctcatttaaagcattccactgctttccccaagtccacattcctccagacaaaagcatggtcaggcctaccacagcaataccctagtccctggtaacaacttctgtcttagggctttactgctgtgaacagacaccatgaccaaagcaagtcttataaaggacaacatttaattgggttagcttacaggttcagaggttcagtccattatcatcaaggtgtgagtagggcagcacctaggaaggcatggtgcaggcaacgttgagagttttacatcttcatctgaaggcagctagtggaatactggcttccactagcagtattcctggcagcttggactagagtattaaagcccacactcagtgacatacctacttcagcaaggctgtacctctcaacagcaccactctctgggccaagcatacaaaccatcacacagtgcccaccccataggagcactcttagctggtgggtagaatccctggaacttcttaagctcccagataccactccccaccttgcttctctgggaacattccccggggtccgtctgagagctagctggtcacactgttgtctgtgtgtaatcttttgatattccttatctgcttttcccatttctttctaaaactatcacaatctagtttggtacagcttgacattgacaacagttagaatttgatagtttatatgcattaaaagagacacacataccatcttcagtaagagattcttaacagtaatgatataaacaagtccaaaatgggtgctataaagcagaactggtaagatcaagactgccattatgaagtgagaaacaacaaatcacagcaagatagagtagcccacactttgaagcagtctttcattgtaatgggtgtatggcgttgacttaggtgtgacctaatggtaagtcatccatgttatactaatacttaagttttagtttctccttgtagcccatgataacactggtcctggagaaaaggaggctgtttcatgttctacactgaatagtaagccactgctacaagagccatagttacttagaatggatatgaaagcagatgccaaggctgccaaatgtggttttctttctactacatcacagtggaagagcatgagaccacagccactgggaagcacttagagccaggctgcttcctgagtgatgcaggttttgcacactataactgggcgggtgtgtgtgggggggggcgggggggagcttttacatatttcttaaaggccggcgctgttctggttcacatgggtggactagtggtgcttctgacatttccgcctgtctctgttttccttctgtggttgtctcctctttatggagggaggcctcattccagcctctgttaggaagatgtaggtggcggttttgctgcattctggcatccagacacaaaaagtagcatgtactgactttgttgtgaacctaaaactgctctgaaatataaaacctgttttaaaatgtggacaaaatgcagttgttaccacattacatactagcacatgctgtaggaggggcggtttgaggcactgagttgagaagccttcacatttgtggtagaatttatgcctagagacacacccctagatgcagagtccatttgtgagtctagacgtctagagccctctggtgttttgtgccattgtgtctgtatatatggaacacttgcccatcaggagacttagagttgaatggagttgtcagcccctccaaattagccttatatgaaaggaagctgcattttaaagtccccttttggaaatattcttggcttcacccatttatttccagtagccaggcagtttccaagtaagctccacactggatacaacataaatggaatttttaagtagtgtatttgccgaactcttggcaggtctgttctcttcatagccagcaggtggcctcagccattcatagcacacttaccattagtttcaccattagtattttcttttactttttttggtgatttgttcagtttcccactttccatagtaaatttctaatgtctagcagaaagcttccggtgtcagctagtgccaacagtgtcctctccaaagggttgtgtatagcttagccctaaggctgtcctttcttaggtacgtttaaagccatcacatcggaatcacatgctttcctcgcagttgttaattgactttacctttaatggcttacctgccacgtataacttaaaatatcagatcatacagtacacacacacagtcgttccccaccctcagaagcttgttcctcttcatccctcccaaggcttgagatccactccctacctcccagagtaattccttctcactctttcacatctgtctgctgctgcttcatctcattcgtgatctttcctttccttttagactttgtttgaaatatccttaagtatatcctctgtatatctttatctttttaagtatcaatatcttaagtatattgtctgactgtaaaagctgtattctttctttttttgtcaagcttccaagtccccaccactgttttcttcatcaagggaagagagagagagagaaagagagagaaagagagagagagagagagagagagagagagagagagagagagaatgagagagagagagaatatgtttgtgtgtgtagaggggtgatagtatttttttccccttaccaacataaaaatcctggtgtatttccacttagcaactttcttagtttcttttttcctcctcttgtattttattgtagatgaagatctgataaagtatggctggcctgaagatatttggtaagtagcaaatatctgtttcatttagatttcagacttggagatctatctacctgctgcctataatttaaacacattgcctccatgctgttttcgttcatggggtttctgagtgaatagccgctgtgcccttcagtgttcactctgaccaaagagaagggtgcgggcgggctcctaactcagcttcttactacggtcttgtccatgttcattctccagtgcttattctctgtcctggaacccagtcttaccacttcagtggctatcatgcttcctggctaagttctcagtgtatttggggatgatggcaataatgtacatgtttcaagtacttaactgccaagtgtcaatacatttaatctcacaacagcctctgcagtgttgctaccatgtccacctttcagatgaggaacagaataggtctgctctggttattattggcccagcccaggctctcacaggcccagctcagcttctaaatgttgaggttgattttccctcaccttagggcaccattcttccctgttcagttccctgctccccgctcccccctccctgccccaggcccattgctgtaactgtctacagaccttttctccagctgtgagctccccagcccactgatttccttacagtactgtgaggttggacggccacttttcagaagagctggttccgttttcagtaaggtggatggccttgagtaggctactatctcggacttttatctacttggttataaagggctctagttcatggctccaatgggcatgttctcctgtcattctgatgtccgagttgaaaaccagtaggcttccaaatgctgacaccattgcatacactagcaagattttgttgaaaggacccagatatagctgtctcttatgagactatgccggggcctagcaaacacagaagtggatgctcacagtcagctattggatggatcacagggcccccaatggaggagctagagaaagtacccaaggagctaaagggatctgcaaccctataggtagaacaacattatgaactaaccagtaccccggagctcttgactctagctgcatatgtatcaaaagatggcctagttggccatcactggaaagagaggcccattggacatggatactttatatgccccagtacaggggaatgccagggccaaaaagtgggagtgggtgggtaggggagtgggtgggagggtatgggggacttttgggatagcattggaaatgtaaatgaggaaaatgcctaataaaaagtattaaaaaaaaaaaaaaagaaaaccagtaggtggcagaaacatgaggaatttgaaaggcacagttcctaccggcacagttcctagcttctgcactcaagtgtaccatcaagttagactctgcttaggtagggccccttcactcatgtaggcagattgtactgctgggaatttctggccttccttcagaaggccctacaacctccataggacagtgatttacctgttctgtgaacaagaggtcgtcagtgttggaacataacaaaagtttatgcttgactcactcactgccttcgtagaaacacacatgctgaaggcttcctcaccatgagcgcttccttgtctcgcctttgaatccctgtcatccccagctaaagcctctttgatgccagtgtctgtacttcttggtgaggtcgttacctcctctctttatgtccccttttactcttttcaaggtagagtttaactctattccaggctttcctggaactcactttcttgcctctgttttccaagtgctagagctacagctactatgtttatctgtgttgtatattagcctacagatttgacacctagctgcctagtaggaaaggttatatattcagatacaccttgaaagtcagtttaccataccttttaaatatttttttaagttaaagaggtataatttctagtttatttagacagatttctaatttaaaacccacactagtaaattacagcttgagttttttcaatttttttttttttttaaggttgagactcaccaggatgatagcgacctagagttcccttgtggcacctttagtaggctagggatgaatggccaaagctcagcacagttgacttttatgttcagaagctatttgagaactcagggaagctggagtaaccccagacctcagggcccattccacttcatgtgctgtcaatcctgacaatcttgcaggagccaagagtgactccgagctcatctgcagtgcagagttctaacctgggattctctgatgctggtttggagaatttacctgtttcagcatcttgagtctatcctggtaaatctgaggttcctttaagcaagaactttctaaggattaagtgagattagaagcaaattagtttttaagtgaggaaaagagaaaaggtgtgtccttgtggtccccagactgcctaatgagaagtagtttcatggaccccactttaagaaattgaaccatttccctgggcctctgcatcctccggtaattgttgcttttattgaaaactttaatctctgaattagtgagggatatcaaggacataacaaggacacgaggctagcgtgggcatactttaaactctgagtgagtgtttttattgaaactggaaagactttttataggaagtagtttgtgctgaattgttccaggagtgggtatctcaaaccctgcacttctgtctgtccctttaccctttgtaatcatacactgtatatgtaagcctgaagatctcatacgagctgtgaaaagacaccatgatcacagcaactcttagtaagagaaagcatttagttggggccttgcttatagtttcagaggcttactccattgtcaccacagcagagcatatggtggcacacatggaactggagcagtagctgagagctatgcctgatctgcaggcagctgccagagggagagagactgggcctcaaagctcactcttcctgagacacacttaagccaacaagaccacacctcctaatcctttcaaagagttctgcttcctggtgactaagcattcaaatatgagcctctgagggccattctcattcaaaccaccactctggccctgttactcctatgtgtgctttgattacttaggtatgaactcattagtgtatattattttggtatttctattggcagcagtccatttagaagaccttgaggaagaaaacagaatctaatagagctactcttgctgttattaattaagagctgtcactaaacaagcaggagccagaatggcaggtgcaccttttcagttgaggtcagttcatagcatgatatttttcttaagatcctgaaaggagaatgaaatgtataaaatttctagattctggacagaaaaatgcccaactaagggtgacaattactatgaattttgcatgggaatgcaaatgagtaaatgaacagcttggaaaaacacaactggctatcagtaatgactaagaataaggcaacataaatcatttgcccaaagtctgagtattgttttatatccagaacaaataacaaggtatttagcttctttgtgggcataatcttaaccttcatactgaatcatacttgttatattgtgtaccgagtgtgtgatccttttaacagtaaaatagaagttgataacaagaaaatgccttgggaagtcagtaatgggatgcaatgatgcttcctgccttaggtttttgtttggttttgagctagggtttctctaagtagtccaggctgaccctgcactcatggtattcctgcctgctggaactacagacctttgctactctgcaccgtctctacaggcttccccaaaccttgttaggaacagtacccactaaagttaacagggtcgcagtgtctgtcagttgtgcatagccttggtcattgttgatgcttaaattctagacccatctctgtgctgcaaagtgaatcagctttatttagctaattatatgaatgaaaaatgtcacatcagttttaaaagattgcattaaattgatgtacgataagaaccccatcttagttagggttataattgctgcaataaaactctatgaccaaaagcagcttggggaagagtttctttcagttacagttcagtataacattcaccatcaaaagcagtgaggacaggaacctggaggcaggagctgatgcagaggacatggaggagtgcgcttactggcttcctcagcctgctttcttatagaacccaagactaccagcccagaggtggccaaacccacaatgagctgggccctcccacatcaatcactagttaagaaaatgccctacaggcttactgcctacagtgccatcttttggaggcattttctcaattgaacttctgatgaccatagcttgtgtcaaattgacataaaactaatcagtacaaactctaaagaaaagtgaatttaagaatttaattaaagcattaggaggcagaggcaggaggttctctgtggattcaaagttagttcagtctacatagcaagaaccaggactttgtaatgaggccctacttcaagggaaaagggggtggggtgtgctgtggggcattccaaatgatttccagacagtttcagtaccatagagactatgttcatccagggatgtgtgttgatatcatcatcagtgtgtgtgtggcagggtgtgaggttggaagaattcttagtctgcttcatctggttcatttaatgatgtagcctgtttagtgagctaacttttctgattctgcactcgatacttggtcttgattgttctgccatcacttgaaacctggaggtatcagaaaccatgttgtcctcttctccagactgcagtcctgcaaagctcccaggtgggcaacacagtgggctttcactgacgtcttccatcctttctcatctgaaattctcgccctgttttccttcttggcctgtgctttggtcgggtcagccaaatctcagctcttccacaaagcctttggtcactgatagctcttcttgttgcttgaagctgcagtctacccaggatgtttcatagttattatctgactcaccttggctcatagccaggcacagctacacagctctcaagtttgtcttgcctctccaggttgctgggcagcctttggcgatggtgactgtctgatactctccatagagcttcacgtgtgataagtccccgagaatactgtcttggaatgagatgctttcagtgcaagtggctgaagacatggttgtcttgttgttgctaaaagtggtttccttctttgtaggtttcacgtggacaaactctcttcggcccatgtgtacctacgattacaaaaggtaactgaatgtaagcgtgagttcatgaccttccctttatagatgaacatcatatattctttttgtgtgattaagttgcttaaataataaatgtgttcaaagtcataaagattagttagtaaatgtcttcctcctatctagaaattgttatggaaaattctggatgatttcccaggtggaagccctgccttgtctagccagctcggtgcattacctatcccctctgcttgtgtccccctcagttcatctgatgctgacgtctatttctagtggctgcttctccgacacactcagttcacctggctcacgagggcacttgttccccttatcagagtgtctttggacagtctaaaacacggtggcgatgcaggaacgaagagttcatgtgccctgggaacgcagcaccactatttctttctaacttgcttgtatctgtattttcaatagttaaactacatagtatgtattatgttttaaaaaatatgtactttggacttacagggttttagaacgttacaaaggtcaaatgacttccctgctgctgctagcatctcacattacatggcggggatctcaaacagcaggccaactaagttctggagttgatttgagcagttttcccattaatgtctctacctcctgagtgctagattgaaaagcatgtgccgccatgcccagtccaaaaaagtttttaataaagttttgctgtgaagacctggtcaggaacctgctaagtagagcaggctggccttgaacttgtgatcccccttcggaatgctgggattacaagcacacatgacagtaacttataacatgagatctcttaaatctgagctgcagcctctggcagcgttccttgccctcaagttgtatggtgggtcgcacctgttgtgtgttcagaatggaggctgcagtgaagtcactgggcaacatgggaagtgatgccagaagggtttggttataaattaatttgggaccactgtgagtttcagaaacccgcagttgccaggttgtgatactgcagctcaggctttaagcagctgagaacccaaggacagtggtgtaacgattttttgatcttttgccttgtgatttccatccaaaacattgttactgaaagttcagctcaagctgtcatttctattctgtctgtacatctggggtgcatttacactgtttaaccttgggataccgacagccacagtagcccaggttggtcagattactttttagggtcgtggtttgtaaactggatattatgttgttttcttgtttgttattttgattgcctgtagtgagctgataatagtggcacagttagtaggaaagctactttgtcaggattagattgtatgcaatttttcagcattataaacccttatttagaaatgcttatttgttttgaaagaaagtatcactgttggccatgctgatcctgaactcttgggttcaaaagccctttctacctcagtttctgagtagatgggactgtaggcaggcatgcaccaccacacctgactttggctttttcttttttttttttttgtcactgtggctggtttggaacttgctttgtagaacagcctgaaatcctgactctgtagcacataactgcctacttcctcctgtgtagaagggaccaactcttcctttattgagtcattgtgaaggttaggacctggcacatgctgaagctttgcagagtggcatctggcaggcactgtgtgccttcattgtggtttgaatccaacacgaagcgtgacgatgcagactctccggcagtgttcactgctacacggccattttggatagaaaagccatgacatttgggagtgtttttggctcactggtgtaaagtgactcaaagcaaacctgagttcctaggctcacttgtgtgagctcgcccatccattgctgctttgctgcagcctccactggctactttatcttcccatgggagcagcacaacagatgaagaacacaagaacttcacccggattttggctgggaggtagacggctggggagatatttgggattcagagctccaggccattatctgtttcaaaggaaggttacagggacctcagccaggaaggtgtctagatctcagaatggacaccgtgcccccccccccaagctttccggaaatgaatgaggatggcagaaaccactgagacacaactgcagttaatatcttcaacatggtttttaaaatgtgttgagtatagttttctgctaatgccttctcctagttcaggtaccattctgtggtgggtaaatgtccctcatctttcagtgctctgcagtccacccggagagcccctgcttgtctgtaagcccgtgtccagccggtaaggcagcacatgccttgcgagtgctccagtggccatcagtaaccaagaggattatttggtttattttgtgttgcagggagagaagatagaagacattccaaaggaggttttgatggactgtgcccaccttgtgaaggccaatagcattcaaggtcagttggcctagcattccctttttctatgtttggatcatagtccattttagtgagcatgagtctggggagagcaggaggaggaggaggcttgtcagagaactagatgctcatatcccacacctcttagttttactgtcctttctgtcttgacacttgactttccctttccttgagtaggaagtcatccagctctgcctaagacttttggcaacatggcagtgttgatagctaaggagatgtgtctgctgccatcagctgtcaacagactgtaaaactagaggggtttggttcagtgttttgttggttttttgttttaaatatatttatatgtgtatgtgttttatttgcatgtatgtctctgtgctatgtgtatgtctgatgcactttgaacccagaagaagttgtcagattccctggaactggggttacagacaattgtgagctacaatgtggttgttaggaaattgaacccagatcctctagaagagcatccagtgttattaactgctgagccatctccccagccccttgtttggatattttgaactggaatcttgatatgtagcccgggctagcatggaactcactgtgtggcccaggctggcaactcacaattctcctatttcagcttcctgggtcctggaagtataggtatgtttaactatttcaggtttagagccagagtctttgtttttttttttttttttttttttttggtttttcgagacggggtttctctgtatagccctggctgtcctggagcttactttgtagaccaggctggtttcgaactcagaaatccgcctgcctctgcctcccgagtgctgggattaaaggcgtgcgtcaccacgcccggcttagagccagagtctttaaatcacgctttttcttttctccttctctcccatgcttttccttcatttaatttgtgaaggttttgagtcatttgactcttgtcctccttccccactgacctgggtggtctgggagtgtccttatctttcaggagctctcagtgagtccagtgtgcagtgtgaattggaaacaatcaccttatgtgttttaggcagtagctaaaaatactgggcttggtgcctgtgtaattctagataagattaaatctaatggaaaggtctagaaggatggttatgaggatgggggtagaggttatgagggttgagagaggtgtgggtttaaatgattgagctaataagtttctaggggtaggatgtagacctagatagaaagagagaactggttttaaatgaagttggaagaggccccagagcacacagctgataacaggcactggagttaatgattacacaaggagagcgagcttggcagccttccttcatgtagactggtatcttcagtctcagcccaggcagccctagttacagacccggtgggcagactacgaagcttaaagtttacctttaggagccaccagtttccagctccatagtcagcaggtggttctgagggaggacgctttattttatgagtagagtaaaatctcagatcttcagttactgaagtaaaaaatgaaataagcaaactgtttattctgtgttccagccgcttccacagccttgttcttttccatgcccctggcttgcagaagacccttggcttaaagagctgtagactctttattcttggcttggtttcttcttaatgtccttagagtgtatgggttctagagaaaacagaggggaagagttgtgacacgggattattcccttctttcctcagccttctgcagtgacctgtcacacagcagagaaggagctaggcctcaggttccactcttactcagtaccagaggacagtgctgaggaccgaagagaattgtgagcttgcagaggacaccccactggcagctctgtagttaccaagttctctctgctcagtaccagaggacagggattgaatttgctgggttctgctaaatcggctcatttcggttcagactcagaggttttatttaggggaaaaggctccactgacaaccaaacaagccttcgtaaacatgttgctttcctcagcgtcaggagccagggcccttgctttttctactctaatactttggcataatggtcaacttcccactgacctttcatactttgggacattggaagtgagctcttaagcctcgtctggggtggatgaggttttgctgtggtgagggctacaccactcatgtttcctgcctgctgaagacagtctctcttggcaggctgcaagatgaacaacgttaatgtggtttacacgccatggtctaacctgaagaaaacagctgacatggatgtggggcagataggctttcacaggcagaaggatgtaagtgttcatatactgtgggaggcagggcctgaccctaagctgagtgtcctgtgtgtcctatgggtgttaaactgggtggctaaagccctggaaagccaaagccttgccctcttaggtgagaaaaataattaaggctaagtactttcctttatttccctcaaaggtaaagattgtgacggtagagaagaaagtgaatgaaatcttgaaccgattagaaaagaccaaactggagaagtttccagaccttgcagcagagaaggaaggcagagaccgtgaagagaggaatgagaagaaagcccagattcaggagatgaaaaggaaagagaaagaagaaatgaagaagaaaagggaaatggatgaacttaggtacgctggggaggaggccttgctgttcacctgggtgctccccacaggttctgaagataatgccccagtggctggaggccacatacaagttaagagtattgactgagttgttaaaggtggttgtgatgatgtggtgaatccccgtgttacagaggtgttgggtgtcagtgagcaaaatgaaaggttttacctcaccgtaagcaccatgggctgtcctcagatgccagcttgttcttttttttttttttttggatttttcaagacagggtttccctgtgtagccctggctgtcctggaactcactttgtagaccaggatggccttgaactcagaaatccacctgtctctgccccccaagtgctgccagcttgttcttggggaaagaagaggtgtaggagtgtgtagtctgagcagctgggctgctgttaccatgatgtgcagccgggcactcagctgctttcaaaccactgtgcagtcaggtactcacagctgctttcacgtgctttttctgcttttcggaagttgaatgtgttaatgtgacgagacctgcttcagtagcctacagttttaattagcaggtaaattatattttggctcttgacatcttagtgatggtggccatgagaatgctgactgtatcagttttctgttgcttctagaacaaatggtcccaaatttaactcctcaaatcaacattcagacctgcaagaagtcctgactaatcaaaacaaacgagaagtcagcagggcagttcttttctggaggctctagaggcgactctggtttctagagactgcccacattcttcggcttgttgctttctctgcttttaaagagccatatgactagatcagacacacttgcaccatcctgtcatctccctgtcatagagaactgtcacatgtgcaaagtgtgtgtccacagaagacaacatgtctgttgcttctagagatttggatgagaaagtcctggggtaggggagagctttggaagcatcattccactgccgtgctgaatatgtgttgctgcacttgaaccggcccagttgccctgtttgtgtttgagtgtggttaagcatctgcctcctgagggctgggattaccgacacgtgccagctacctcttgtttttcttttcattttttctcttcctctctttgtgtagtgctaagggatgaagtaggggctcatgcacggggcaaatgctctagcacagttgtccttgttgtgacttgcagtcacagaactcctaggtttccatggatgccatttgtgatatgtgcagcagaaaagacacaaatgcgggtggcatcaaattaaaagccacctatctgcccgtgctctgacccagctttctctgaataccctgggttcttaggaagcttgctgggcaggtgcgaagctgctgcgattgtatatggtcaggtgtgaggtacctgcttgtgttccttcctgtccaggttctgctgaatcaggaagtctggcttcttttaaagttgagcattcagatggcgagctcagggaatgttgtcttgcattggtctgctgactgaagcaggcagatccatagacttggatatctgatattgcctgcaaatgggaacctgctgagggttgttaaaatggctcactccagtaacatttgtgagttctggcaagcagcatttgcagctgtcttagttggggtttttattgctgtgaagagacaccttgaccacagcaactcttacaaagacaagcatttacttggagcttgcttattgtttgagaggtttagtccattctcatcatggtatgaagcatgggggcacacagacaggcatggcactggaggagtagctgagaattctacatcttgaacccaaggcagctgggagagagtgacattaggcccggcttgaccatttgagaccccaaatccccacccccagtgacacacttcctccagtgaggccacacctccaaatactgccactctctatgagccttcaggtagggggtgtgggtggcatcattttcatttaaaccaccacagcagctaattcttggttttagtttggagtaggggaaaactgaagaaaatatgcccttctgtttccttcacatctttaactgctttgtttagaaacatggttgtcttgtgttagaaacacgacctcacttcatttacagcttgctaaggaggaacggctgatacgttaacatttgccatctgactgacactcttcttgaaagtgcttcttgcatggcctcattcagcagtgacgtagttctgttacctggatttgtaaaaggagagtgagagcctgaacagcacctaagcatcttgctgggagttatagctacgtgtgtcgtctgattctcaaatcaacacattacaaagctctgttgtcttctagctgattcattttatacaatatttattcagaatgagttgagtaatatagagattctgtgattcgtgctggaggtagagctgccctctgacccccacgggtatgctgcacttacccacatacacataagacaatttcttttttaagtttcaagcagaagtgaggaggctttgagtgagtgagtcagtgagtttgttttttttttttttttttttgagacagcatgtctcacacttggtggctgtctcctaccgcagcctcctgagtggtagttttgtaggcatgggcccagatgacaggcatgaacttagctggctacttgtgttttagtaagagctctttgcctggtgggttatagagggacccagaggcaggggagccagaagttaagtgattggcagtggtccagaccacggatgaggcttggactccgtgagagggaaattcacggtaaagttgtggtttgatgtagtttgggttgaggagcaagggctgagaatggctcctaggttttcagtggaatggacagtgatgctgttctaggcatcaggagaacgaaacgtgtttgtttccgtaggggaatagattttgagtcggatacagaccagaagtctggaactatcttttaggaatctcaaaaggtgttggggtagtttgggttaatagggagtacagaggaaatgtgaccttcagagggcatgcttgtgtgctgctgtcttcagagtgggaacagttagcccactgagccttccaccaacgtggtgactgtctgtgagagcttgttgacatagtaacctcatttgggttttagggtgctaatcacccacaaaatgcttatggagaaataacctcaatttgactattttcttttcttctaggagctactcatcactcatgaaagttgagaatatgtcctcaaatcaagtacgttcacatttcttgctctactgttgcaccttgaaatatttaacagagtcttcagtagttgagttttcgactgtcgtagtgttgcagattgcttaccatgattggcagctagtatggaagaggaggctgagtgtgtgtgtgtgtgtgtgtgtgtgtgtgtctggcaggcattagcatcctgccccgtgttccaatgtttgcttttacatggtcactttaaagaaagggtcggatagctcacctgctgtgaagggtaggcctattagtattacatggtgcaccagtcagctttcccttacttcagcacagtgcctgagagaatcaatttaggaagaaaggagctttattttgacgtgggattttaagagatttgggtctacagtcagttgccctgctgctttctgtccagtattaaggcagcatcatgggaacacaggagaaggtgagcggcttgtcttagagcagctgggagcagaggggtgagggggaaggcaggaggcccagcacctgggaaggccgtgcctcctcagaaacctgactgtcttcactctggacaccacttttaaatgttctgtnnnnnnnnnnnnnnnnnnnnnnnnnnnnnnnnnnnnnnnnnnnnnnnnnnnnnnnnnnnnnnnnnnnnnnnnnnnnctagagcctggactagagaacaggccttcagcacgtggcctttggggacagacccagactgtggcacagcactgtagtcaaatttttttctcctttcttagttcctattccattaccaggctttggaaaaaaaaaggaaattaataaatttccatttattaaaatcctctactaatggtgctgtagacttcacaatatagttaaacagagtcgatattacccctttcaattaaaaataaaagtaccaaataaatgtaccaaatatgagaccatatgcctaaataccagcactgattcttgtcatacttgttaggacttggaataattgttgacatgtttcagggtttcgttttgtttttgagacaggttttccctttgttgctcaggctgccatgagcctccccttacccagcgtggtctcagattcacagtctcacggctcctgtttcccaagtgcttgggttacaagcaggcaccagcacatttggctcaggctctttcacaatacagcttttagaatgtatgctttagattgcatcatcagatatgctagacatgaattgcaaatggtgtctcaatgaaaattaaggttgaagcctgtgttcttcagccatatcagctttgtgtggcccgatggctactatttcagcagagataaggaaccatttctacattactacagaaagctctgctaagtggctcagtttcccacctaaggttatctactcaaattccaagctaagtgtatgattggagtcagtaggattttaaatgttgctcatgtctggtgcctgtccaggaatgggtaagaatacatcttgactaccacaaagctaaaattttgaggctcctttatgaatcaagatggtggctgtgtaaattatttctgaaaatttccaaaataacactgtgtagttcatcaggactgaatgtgaagtcaggagatttaaactgtccctggattgagcctactacatttttagcctttttagggggattattgctctgtgtagagacattacctcatgaggttgtcgtagcctataaacaagggtgtgccctcatcctagacttggtcgtgtcatagataattgtcattggtccttacttgaagtcctgagtttgtttagccctctgcatattattcttggctttctagaaattcagaacattttaaccttagcagaggcctgtgatagattccaagtcaaattcagtaaaaactaatggtcctgtctctgctgtgctgactgaaaacttcttgaaacgttatttagaagtggctttccaccagaaatctggcctgtgtttcagccttgtacctgttgttcccacagtggatctttaagagctttacatgttcttttagaattggaaacatacgtgcatatgtacacatgtatatgctcatatgtatacgtgtgcatgcacacacacacatacatttgcacataccatctcttgaaatttttgaggcattggttccaaggccctaggaatactaaaatctgaaatatgtagatgatcaaaaccctctttttgtttgtttgtttttttgttttttttgttttttggtttttcgagacagggtttctctgtgtagccctggctgtcctggaactcactctgtagaccaggctggcctcaaactcagaaatccatttgcctctgcctcccaagtgctgggattaaaggcatgcgccaccactgcccagccaaaaccctcatgaaatagaaaattattctcatgtaactcatgttttatctccccatgtgatttattctgactattatcaccaaatacagtataaatgcaggcgcagatagttgtcacactgtagtgcttacaaaatgctgacaagaaagagtgtttgtgggattcctaagtgctctttgtgcttggttggatctgcagaaatagaccccacagatgcaaaggaccagccatgcatgggtgtgcacagatactgtaattaagagtctcaagactacagtgttcagtgtgagaaaaatgctcctcctcccccctgctctgttacttgctgccctgtgtgaggtgctccaatgaaaaagcttcagtctccttagaacattttctgctctgttaccatcttgtgttgtacaacctgatttgtagtgtgcacccctgatcttcatccagaggctgagacttgtgtgagataggactgtacaagctcatcaggaagggtactggtctctgtctgagacgagctagatgctcatcagaatgcttagttttccattgcataactgctttgatctgtaatttttagtcctttttttatgtgtgcttggaggcatatatcattgctcttgcattcttcttgctcatcagttagcactgggcaacaagaggcctgtctaagctgattagtagaggactgggaatctgaaatgtgatagttgtccaaggacagtcccagaccgcagacacacagttaaacattcctgtggtgccagatcacctgcccacacatccagtgagtggcccctgtatggagagtgcactgtcccttttaccagctgggtggccttactgttgtctgtcctcactgaccgtgtacagaagctgnnnnnnnnnnnnnnnnnnnnnnnnnnnnnnnnnnnnnnnnnnnnnnnnnnnnnnnnnnnnnnnnnnnnnnnnnnnnnnnnnnnnnnnctaaagtttaggactctgatgcagtcctactagcacatttccccattgtcctagtaaaagagcagcacatgggttgggggcgtggttctgtagtaagcagagctttctgctcttccagtagacctggactctgttcctggcacccacatggcagcttacatctctttaagactctagttccaggggatccagtcccctcctgacttcccaagggtttttgcatacatatggcacacatacactaaaacgtacttttaaattaatctaatttaatttattattttttgtgtaggtgttttgtgcatgtgtggtagtgcggcacatgcgttcagtgccctagaggctagaagatgttggatcccgtgaactgggattctggatgctgatgagccaccatacgggtgccaggaattgaacctgggtcttctgcatgagtaacaagtgctttcaaccactgtaccatctttctagctcctaaaataattttttttggtgttttttgtttgtttgtttgtttttctctgtatagccctggctgtcctggaactcactctatagaccaggctggccttgaactcagaaattcgcctgcctctgcctctcaagtgctgggattaaaggtgtgtgccaccacgcccggcaataattattttttaagaagatgggggaagaggagcagcagagagagagagccactgaatgaagccagagaaaaacagcctttatagaaactaccgttttctaccctcacttactgtcttcctaccatttccaacaagggtccttaaaagaaaaagaaccccaagtcctgtccctgcctctggtagtactggtgttaaacaataatagatagaaatcgaaccaggcagtgaccagtgttgctcaagccagccactgtgccagggaagagtcttgccagtgtgtgctgctgtaaggcagctggggcgtatcagctgtgcactaagaatgccctttacccatgtgctgtggtatggaagaggccaagctggctagctttattaaaagcccatgtttggcttcttaaggactttgcctattaaaaaaagggaaggaaaacagttagctttcatcatgtgaaatcacaaatctagggaaaccacaaggttcaaaatactgagatttagggcacagatattttatatatgacagtgttattggcataaggaagcaagatactgttcatatagtatacttgtggaggattaatccttttctaaaattgtgtgtgtgtgtgtgtgtgtgtgtgtttcatgatctgatataacatgagctgtgttcagagagtaaagtcactccaggagaagaggctccatagccctctctcagtcactctattttaaaagttcaggatttatgctaagtgattagcataaatcattctttagcagagtcacaatttcatcccacagtctaccagttggggtgggctttacattattacttggaagttaaagtaactggagggacttggaggttgtgtccactctcctgggtcatataagagctaatggcagcaggctgtggcgagctcagtcatcttcctgctgctttctgcagccctgctgctttctgcagccctgctgctttctgcagccctgcaccctgagagtcggactgagaaagggcagcgggtcgcatgatgattatgactgtctgtcgggctcaaggcctcacggtctcttttgtctcctgcaggatggtaacgattccgatgagttcatgtgagctgagcaacggaccctgggaagacatgaatgtgcagaccattgcagagcttttgatttcatctaggttctgaattacagaaaccaaccaaccaaaattctaccttcattctacatagacatcattggttttggagtttaaaaaaaaaagtcacctttttgctgatgaaaagaacatatgtataatatagttgaactcgaagacaacttaaagtttagggaaaggagaatatttttggcagaacatccgtcagtacctcatgaaggctggctgcctttgtctttgagatagacattggagcagacggactctggaaagtgcttctgtggctgtggtctgtcctgggaacagacgtggtaaaatgcgtttcctatctctaaaatatctacttctgtgaagaagactggcttactcaggccagggccctcctgacgacggtttcctgactagaagaaagggacgtgggtttgaaggcagcagcagtgcttacttaacctgcatttcagcatttggcaagttctctcttgctggcgtcagagtagctggcccagctcttagcttgttctgagggttctgctgtgaggtgagggccccatctcagcatcgtagttacatagttgatcttaactaagcttgggaatacgtcacctgagatcacaggtgatccaagccgcagatgtgacagctgggctctgaagctatttctgtgtgtggagggagacaggaaagggtgctgtgctagtagtgagagtgacacagattgcctcatgattgtctggagtgtatcatgaaacaaaagtccaccatggattgcaagctttagaacgaatcaagcattttccctagccaggcaaggcattcgtttccttactttggaatagtatttatgttgaattgtaaacccacagttgtaagcttagtgacttcacatgtatgtagcattggtactggtctgagccacctgctacccagtagatagataacctttttgttagtgtttaagggagcccctgaagagactcaacagaacagtgagaggagagagagaaaagctggcagggttgtgactggcatgcaaatccatattctagcacaccacacagtgcccacagctctgcggtgctgagccagcagaaatgatttcttcagcagatgtaccagctgtcatcactgacgtatgcacaaaaccagaccgttgatccctggtattccaagttgagtatgggttgaactggaaaattccctgaggcataacttgttagccaatttgaggagagccagtttgagggttatgaaagtcagcaccagagatcagtgagtgtgagtgtgtgtgtgtgtgtgtgtgtgtgtgtgtgtgtgtgtgtgtgtgtgtgtgtgtgtgtgtatgtgtgtatgtgtgtgatagttagactggagttctgtgatttaaaaaaaattataataaagtatcatttttgtcagaaagggcattgatatctgaattcttagaacttgttttctataaaagagagcagcccccacctccaagctggtttaaggctaat

SEQ ID NO: 1286 - DNA, 599 bp, Mus musculus
ccgccggaagtgtcctgaggagagcctggaagccggctcaccctcgcgccggcggtatctcaagcttcgcgttttgagtaggagtcgccactcttctaccaggatcatggtgttctacttcaccagcagcagcgttaattcatctacttacactatttacatgggaaaggataaatatgaaagtaagtttacaaaagcatttgattttgaaattccaggcaggtttcacgtggacaaactctcttcggcccatgtgtacctacgattacaaaagggagagaagatagaagacattccaaaggaggttttgatggactgtgcccaccttgtgaaggccaatagcattcaaggctgcaagatgaacaacgttaatgtggtttacacgccatggtctaacctgaagaaaacagctgacatggatgtggggcagataggctttcacaggcagaaggatgtaaagattgtgacggtagagaagaaagtgaatgaaatcttgaaccgattagaaaagaccaaactggagaagtttccagaccttgcagcagagaaggaaggcagagaccgtgaagagaggaatgagaagaaagcccagattcagg

SEQ ID NO: 1287 - protein, 200 aa, Mus musculus
  VARIANT (1)...(200): Xaa = Any Amino Acid
RRKCPEESLEAGSPSRRRYLKLRVLSRSRHSSTRIMVFYFTSSSVNSSTYTIYMGKDKYESKFTKAFDFEIPGRFHVDKLSSAHVYLRLQKGEKIEDIPKEVLMDCAHLVKANSIQGCKMNNVNVVYTPWSNLKKTADMDVGQIGFHRQKDVKIVTVEKKVNEILNRLEKTKLEKFPDLAAEKEGRDREERNEKKAQIQX

SEQ ID NO: 1288 - DNA, 59341 bp, Homo sapiens
tttagagaagaatggcatgagctgatataggattccacaaaagcttacttcagcaataattacatatagaaaaagagactgaattagataagattcatctcaacctcaacatgaactatgagatgaaaggtaagggaggccaaggcgggtggatcatctgaggtcaggagtttgagaccaccctgcccaacgtggcgaaaccccgtctctactaaaaatacaaaaaaattagccgggcatggtggcagacacctgtaatgccagctacttgggaggctgaggtaagagaatcgctagaaccctgggggcagaggttgcagtgagctgagattacgccattgcactccagcctgggtgagagtgagcctctgtctcaaagagaaaaaaattgcactctaattggttatttctcacaggggtatgaattaacaattatgaaactgttttacatgtttactgggacagaacaaataagtagatggatagtgaatagtaggaactaagtgtctcactgtccgagaaggaagttacagatgaaaaaaggatagaataaatcctggagtactggattagagttggaaatatcaacgtccagctggcaatatgcaaacaaagaaataagacagaaaatgtcacagataagactaaagacacatgacaattaaacgtaatatagtaccttggaatggatactgggacagaaagaaaacattaatagaagattccaaataaagtttagagtttagttaacagtaatataccactaccaatatttggtgaactccaaataaagtctagtgcttagggccaggcacaagggcttatgcctgtaatcccagcactctgggaggctgaggtggggggatcacttgaggtcaggagtttgagaccagcatggccaacatggtgaaaccccatcttaacaaaaattagccgggcatggtggtggatgcctgtaatcccagctacttgggaggctgaggcgggagaaatgcttgaaccctggaggtggaggctgcagtgagccaagatggtgccactgcactccagcctgagcaacacagtgaaactccatctcaaaaaaaaaaaaaaaaagtctataccaatacaagtttcttagttttgacaaaagtattataacataagatgttaagaatggaggaaacagggtaagagatacactgctactctctgtactttaacttttctgtaaatctaaaattatggcaaaataaagtctattaaaagaaaagagcaaagttaaaacagcaattgatttgaggaaaatagtaagctgagagtgggctaaaaaaacaaactttaactttgcattgaaaaataattagagctcatcctctagaaacaaggccaaggcaggtgaaagtctgagctgctattggtaagttacttaacccaagtccatttcctcatctataaatgggcatatcaggacctagagtagtagggagaattaaatgataaactgtagttattaagtaataaagttttggtctttttatattacttttatgatttctcccatatccttataccatttgtattatttttattcactatttttctttaaattgacttagacaatgtactaaaatatattttaaaagaaaaatttataactattttaagtagatgcctttttgttatattttctattgtatcagtgctttgagcacaatctatgaaaaacataacgtatactaaatatttagcactgccttatattcagcactcagtaaatactagttattaacatcatatctcagaatcataaaaaaaagctttatgtattcatagtttagtaagctatttaattgaacactgacagcataaattaggaataggatttcagaattgacaggaatttaaaaattaactttaactctttagagatatcttcctagatcatacagctaattattagtaaacctagacaaaaatccatggttcttgatgcttaatttcagtgtcatttataaaacttagtaagttctgctcacaattgggctttgatcacaaatatacataatagttttaacttctattattttgggtgaaagatagagtaggtatgattttataatgagaacactcaactctagagagcttaagtaacttggccacagccatagaccaattaagcctaatattttgtctaaaattttaacctaggatctccttgtttcttgtttttcaaaacgcaatgcactgctttactacagaaaacagtgtcacagagataaacaaagatactaaccacaggcacgctactgaaaaaagaaagacccagaaattacaagaattattattgtataatgtatgtaataaagcattattttaagcagctaaattcatgcgagttttctcttacttgtcttattctcaccaagagaatcctctgaagaaaaagcctcatttttatcaactttatgttcctttgaagaaactctgtcatctgatgaatcctgaaaataggtttaaaaaaaaaaccaaacatctgtaatttttaactattttctagtgaatgaatcccagcagatctatttctaaaacaaaagatttggtttattatgaattacatttcataatgtgattttcaatcaattttcaaactatttttaggaaaacttcccctgtattcactaagcgtacattacctttaaagccagagtacagcagggcccggtggctcatgcctgtaatgccagcactttgggaggccgaggtgggtagattgcgaggtcaagggattgagaccatcctggctaacatggtgaaaccctatctctactaaaaatacaaaaattagctgggcgtggtggcacctgcagtcccagctactcgggaggctgaggcaggagaattgcttgaacccaggaggcggaggttgcagtgagccaagatcgtgccactgcactccagcctggcaacagagcaagactgtctcaaaagaaaaaaaagccagagtacacgtgttgtaatctgtcatcctctcaaaaatgtgttatacttcctgacagagatggcagaatgattacagaccatcacttccataatgaaatgaacaaaaaagccagtaaaaatggcaaaagtttccccagcagccaccaaactggaaagggacaactttttgccataaactttaaaaatcagcagctaaggaaagaacattctagagtcactggagagtagcaggaatgtgggaaaagcaaagtagaaaaaaatcctgacagatttccctcatactaatttgggaattactagggaatatatagcttggggaaaaaggaaaaaaactcttggttaaagtagaacttctactcaaaaccataatatcccagcagaggtgggataacccatcagtttaacacttttcagggctccatgagttggggaaagggtatcctcacaaaaatcagattcaccggccaggcgcggtggctcacacttgtaataccagcactttgggtggccaaggcaggtggatcacaaagtcaggagttcaagaccagcctggctgagagggtgaaaccccgttcctactaaaaatacaaaaattagccaggtgtggtggccggtgcctacaataccagctacttgggaggctgaggcagagaattgcttgaacctgggaggcggaggttgcagtgagttgagatcatgccactgcactccagcctgggcaacggagtgagactccatctcaaaataaaaaaacagaaaatcagattcgcccttagctagcagagacgaatcccagacatgggtatttagcaaaatcttgaaagagcatagccccgttccacaaatttaaaatgcacaaaagcccagcttcccaaactactgaaaactaactcaataccaaacccgtaaagtgaagctaagaaaaagaaaataagacagaaaagagaattacagaattctctgttacactggttacagagaattcatcaggtcaccattcatttggtacaccaccaggctgtaccaaacagataagaataatcatcaggagatgcatggggaaactgcagactcttcctttgttttactggattgagacaattttagcttgagttacgccccaaactttcaaaaaacttaattttcatacaaatgtataagtataaagcacagtttaatacattttgataaagcttactcttgtaatcaaaatccctatcaagacacagaagtgttttgttgatataaacagaaaatgaattagtaaaattagactgtcatggcttagctagcaagaacgtatctcatttaacaatctacttggccatactcgataaacaggaaaaaaaacaaacatttacagtgaggactaaaaacttaaatgccttacaagggcagcagtaagtaaaatgatcaaaactaaactgatctaaatagatagatatacactgacttagagaaatgaagaacccatatttgtcaaatggtatgatactcagcctgatattcagctctgattattgccatgtagaaatgaaggctcagctttcaatatttcatgagacaccagaaatgtttttcttgtatttaaaaataattttggctccaacttttaaattatgtaggccaagcaaaacatttatgggtgagatttggtttactggccaccaatttattatctttgccactgaggtttgaaatttaggtgattacgagagatatggactggggttgaatttgagagaaactagtgaggaaggcaatgatgagaggtgggttaggaaagacatgactataagcctgagtgtactgggtatcatataagcctatcatttctccagctacaagggttgtgatgaatataaacaagccaccatacatggaagccctgatctggagacaacctctcttaaggttgcttcaatggctttctgcccctagctgccccacaaaactcaactttttttctgatgaaggatataaacaggaggtcagcaacagaagttctagaccagcatggtctaatatggtagccaccagctacatgtaactattgagaacttaaaatgtggctgggccaggtgcagtggttcacacccataatcccagcaatttgggagggtgaggcaggtggatcactatagcccagcagtgcgagaccagcctgggcaacatggtgaaaccccagcctctacaaaaaatgcaagaattagccgggtgaggtggtgtgcatctatagtaccagctacttgggaggctgaggtgggattgcttgagcctaggaggttgaggctgtagtgagcagtgtgccactgcactacagcctgggtcataaagaaagaccctgtcttaaaataaataaataaataaactccttacagtaactaaacactatgctatctggctttataaaagcagtccagaaaataaaattttattcaactatgtcatttatactgaagttttgttatacagccatttttaaagtgatatatttagctttacctttattaatttctctttatttttactgcttgcactcagtagtccaattttcaatttctcttctaggaccaagcactttggcacttgccttgtcgcaaaagtttttttttcactgacagtctctacatcagaatcttcaatgacttctgatttactcttttgggtgcgtcccagtgacggctcattttccagggacgattttctaagagaagatttttttctaacaaaaaatgctgctccaccctggagtgtaacttgtggttttattttttggctcagaacccgaggagcattggaattattttcagctgaatgacaattattttccttctccacaattggcttatagatcactcgattttgcttggaatttctagaattccttgatacaggcttgatgtgtctatactttggttgatacttagcagttaaactcttctgtggttttttgttgttcttcttggagcagactggttttccttgcattttttctgtcacaatgggaaaagatttatcttcatcattagtttttagacaagtagatctactctcttttatcagctttctctccagtggattgaggtaccacttattttggttgtaaaaagatacagtggagagcgcagatttaaatggtgagccttgatttgctgatggcagtctatttatttcagttgttttgagcgcacttaaaacaaaatgctcttgttgagagcaatgcaggttttcttcatttttatcactgttttgataaaaacagtgctttttattaggtgatggaaacagattttcagtgaagtgtaaaaggctataaaaagaaacaaagtccattgataagattattttgcgtcaaaatttacataaatctactgctaagtaagctctacttgtaggtcatattaaaaacaatacatgtaccccccatacacacaattttctattagtttaacagtaggattctcaaattctgtctttatcaaataaaacattcaaatatcttcccaaagagttcatgaaaacaaatactatatacaaagaagctatgatagacatatatgcatgtatgttttaaaatcgatttctatgtgttggccatatataaattatagctcatatattttgctctattgtctacaagccccctataataactgtctgtaatgaactgaccccctggggcttttcctgggtagagtaattaatatctgagtacacagtctttctagaattgtttccagacaagcatctactgtatgcaaaacactgtaaaatattataggggaacagaaaggaaaaaggtaatagctgatttggtatatttcctagctatagaaaacagctttcttcaatgtgctgcttctatgtcaaaagaaaaaaacaaaaactaaaaaacagctttgattcccttgaaaaggactaaataattcattatgaaaacttaatgtatttccaagctagaattagaatataggttatcaggttatcactgtagccacaaggagtaggctagtggaagaacgaaaattttagaaaataggagagaacaagagagacaagaaggtggatttttctaagagtttctattcacaggctgagattcacctgtcacacttcaaagaatcctgcttcctcttccttggagtaagagctgccattttctttattgaattcctaaaagaaatgacaataaccacattcatcaaaatattaaaaatcgctttatcaaaattataccccctttaattagtctatttcacaccaagttaaaaccctattttctgggaggtcttcctcgacattgctctccttccacccctcccagggttacacgcgcttgttctgcttccatggcaccctgtatttccctaatagtccatttaagacattttcttgtttccccatctcaacagccttcaatgaaggcagagaccgtctgtaacttttcatcagagcccagcaagaaaacgggtgaagcacagtcctctgccattttcctagctgatgagcccggagcaagccgtttgcttccctttttataaaaatctcttgaagtcgtaaggctgctgaaaacaaatgctagaatgcacgagcaggcggctacgtggctcgtcagaattcatttccttccccttccctgggatcagggaaattccccccaaagcagcacacaagcgttatttcaaagctattaatgaatgaacaaactgaaaggccagggtctctgggaattcaggtcgagctgcggcttaaggggggacccctctggggctaagcgaggaaaggtaggagaggaaagcgtcccgaccctgaacccggtcagggaaacaaacaaacaaacaaaccctaaacccaaaacaaggaaacgcccggcgtcgggaagagggaaacccggcgcctgtgagcgccgagaacgagtcagtggcttcttcggtctcgggcctgcggacctgccgagcgccgagcaaaagctctttccccgtgacattcgcccccacgttccacagggtctcccgctcgcctcagccttccacagccccccgcctcagcctactccagaggttacctgcgcctcagagcccggcgagctctcctcagcctagccagccgctccgtgagcgtcttcaaataatcgcgcgccaggctaggaggaagccgctgcgttccgattggccacggctcagcgcttccaggggctggctcggtgattggtggagcaccagcccttgccccgcccaccctggtggctgtttccaagattctcgcgccctggtgaggtgaaaaatctctgagggaaaccacgccacccacaatcccctgcagcaacgccggactccgttcccggggccttgtttaggtgcattctgggaattgtagttctcggtccagttgaagttgagatacattctggggtcacggggtaagaaatttttgtaaaatggcctctccagcctggcgacagagcaagacttcgtctcaaaaataaataaataaataaataaaggcctctccaagattctcgatgcacttatttttcacatttgaagcttcattgttagtttcactttttttattagtaactttaggtttctatttatttttcaaattaaaatataaaacttaacacctgctatgtgccaggcattcttagatgctttacatgttttgtttcatttacttcttaccacaatctgtaaggcattaatatctattgccattcccattttacaaataatacaacggagaacccaaaacaattgctatttacagaacagagctaaattcttactttggaaaaccagaaagttcctaaaacggttattgttagctattgttactatctttgtgtcaccagctcctggtacagtgtttctggcacatttttagtttcaaataagtttagagttttatgtttattttttcaaatttaattttcacaaatttgtatgtcatccttgagcaggggccatgttaaagttctctgtatcattccaattttagtatacaggctgtcaaagcaagcatgtaaataaatttcgttaagtgacgccctcaatttcatagaatgaagtcagtgacagtgatgtaagagtgtcagtttaaaaggaaaaggctgaggcaaaaaaaaaaagaatgtagagtttgcttgagttaaagcggggacagctgcccagaagattccaacccccctccccccaccgccctccaccagcaggcttggatatgagctctgtctggcctttgctacaagcaggtttttaaagacgaagaaggggggcaggaagtgggctgatacacaactgtcaagcattctcattgatgtatagaaactacaagcatcagtgattggctagacattgttaaactatagggtgtgggtcatgtcatagtgtcttgtgtggcagtgttaggttagtaggtagctacctgtggcagaagcaggtagtttcagtagatgaatacatagctcaagggggtggtagaacatgatggggtcttatcttaatgcctctccagacctagtaatttaaagggactcacattcctcagataaaagtgctttctcaagagaaataatcagggcaaagccaagtgctgtaggagctttacatgaatatgattattcctactttatagcaggaggacctctgaggttcagaggtttgggatggcaggccttcgatttaagccagaacaaagtccaatccccaagaggcatattgtcctggtgagtatcagaaacaactcgtttgtgtgctatgttctaaacccttggcgcccattaacttatttaaccctaaaaaatatcctgtgagttagctgctctagtatcatcttcatttcgctgctgaggaaagtgaagcacagacaggttaactaacgtgcccaagatgcccagcctctttcccttaacccacaaatcactgaaccaaactccttgccactacacttcgcctcgccaggattaaaaatggcgcccacggccggcgttatgacgcgccccgacgtccgccggaagtgcacggaggagttctgggggccaggcggccgccgcgagtctggtatcctgagcttcgtgagttgagcgctgctgctccgcggtggagtcaccgcaccgctcccgggatcatggtgttctacttcaccagcagcagcggtgagtgggcgccacgtcctcctggaccctgctggacagcgggctccgaagccgggacccgcagtccgccgctgcgcctgaccctcgctctaaaatgccttctggatgcgagtgcctcttcccgcggcctctcggtcccccagcacatccgtccctcccacggctgcaggatttcccccggcgtcccctcgtcatggcgtggggggcgcggaggggcgatgccactgctatgtttgtatcggggagttctcgtcccctaatcggaaagacgtcccgtcactccctgggattgggcagagcctgtgggctcctccacacaccttatcccaagtcttcttcccaccttccatctgcggcctttgttctggctgaacccttgtaattatcccctgtgagaaaggagacacctgctaacaactttttcttaagggaagtgcgacttaccctttcaggaaggggttgtagggtctgggatgcaacagaaaacaataaaaagaccctgggatgtccacccagccactctccgggcagttgatgtcccagatctcagaagtgacctatggtaatgcttctgacttatctttgacagataaggaaagggtgcccttcgttcccaggaaatgcagtgtcccgacttggtttcgttctgttcctgttattcccctttcctaaaatcaacccccagctaattcccttaagacagttttggcccatcttttccaagatgcctttcctgatgctagctcctaccccaagattgcttagctattcctttcctgggacccacttaacgttccaagtatgcctttggcattgcacttatcacgtggtattaaatggtgtctgcttgagctagagtgtaagtcccttgagggcgtggacaggatctctttacagtagtccctacttgtcctgtatttcgctttccgtggtcacatcatcacaagaagaaaaggagtgagtacagtacaataaggttttgagagagagagagagcagagtcacctaacttttattacagtacgttgttataatcgttctattttattattagttattgtcaataatctcttactccaccgaactgatacattaactttatcataggtatacatatatagggaataccagtagccatgcgtcccttaatgacaagaatacattctgagaaatgctccattaggcggtttcattgttgtagcaacacggtagagtatacttaaacctgtggtatagcctaccacaaatgtaggctgtacagtataccgttgctcctagggtacaaacttgtacagcacgttgctgtactgaatggctgtaggcaatggtaacgcaatggtgtttgtgtatttaaacgggtctcaacgtagaaaaagtgagttgcaccacgctgttatgatggctaccaggtcatcaggcaatagtgatcagaatttttcagcttcgttataatgttatgggaccaccatagtatgtgtggtttgttgctgaccaaagcatcattatgtggcaagtccctttatatatggaattcagtgttgtcctcggtttcaggcatctgctggagatcttggaagacatcccccacagataaggggggactactgtacttgtttccctaacgtagtgactggttagtagttctcaataaatgcttgttgaataaatgaatgccatttttttacttacttatagcactttctattctattgctactctatatgcttgttaaaggtgagttttttgtttttgtttttgtttttttttttttggagacggagttttgctcttgttgcccaggctggagtgcaatggcacgatctcggctcactgcaacctctgcctcccgggttcaagcgattctgctgcctcagcctcctgtgtagctgggattacaggaatgcgccaccaagcctggctaattttgtatttttttagtagagacggggtttctccatgttggtcaggctggtcttgaactcccgacctcaggtgatctgcctgcctcagcctcccaaagtgctgggattaccagcatgagccactgcgcccggtctaaaggtgagatttattttatttatttttgagacggagtcttgctttgtcacccaggctagagtgcagtggcacgatctcagcttactgcaacctccatctcctgggttcaagcgattctggtacagctaggattacagggaccagccaacatgcctggctgatttttgtatttttagtaaagatggggtttcatcatgttgctcaggctggtcttgaactcctgagctcaagtgatctacccaccttaacctcccaaagtgctggaattacaaaaggtgagtttttgttttgttttgttttttgtttttttgagatggagtctccctctgtcactcgggctagagtacggtggtgtgatctcagttcactgcaacctctacctcctgggttcaagcaattctactgcctcagtctcccaagtagctgggattacaggcacacgccaccatgcgtggctaatttttgtattttgttagtagaaacggggtttcaccatattggccaggctagtctcgaactccttacctcaagtgatccacccgcctcggccttccaaagtgctaggattaaaggcgtgaatcaccacgctcagccaaaaggtaagatttaagtgaaactagttccacattgtttgtgtgggtttgaataaggcaatactttctctttagaagtaagattgaggctcagggaagttgtaactcacagaccctactcttccaccttcatcacactgacatctccttatttttctcagtagtttagccttccacagtgtgtgccatgagctatttctctgtctctgtacatgtggtttgttttacccatattattaaaattactagaaacaaaattcaaaaccagcctgaaaaatcatatacccttataggcctctaagcattttcgtccttggcaactcaggcatctctttataacttctccagttgtgaatcttcaacaacatagatatccatataaacccaacaatggaaaaacaaatatacaggcagggtgtataggtactgaatgtattttgtgctgttctattccccttaaagttactctgaattctttaagtgttagtcacacatacacatctgcccttaatagagcaaaatgcttcactagatttgtgggtcctgtttttttttcattgacttccattataatgtcagaactgtttcctgttagaaaaatatttggcctctaagcctaataaaagtgcacttgtgcagctgatcttttaaaactgcaaagttaatggaaaaatcataactttctcagtaaaatagtaatgagactttacatattggcagtatagaaacaacaaatatatagaatcttcaggaaatgaatttgtatggcttgccaagtttttaactaactgatggtttttactgcataaaaacttttttaaaatgggaagaaaatcttcataggaagttgttcttttacattttaagattaatatctgactaaaatgtgttccattttcattctttcatgctgtctcataagggaataattgaacattaataagtccagtgtcacatttaagaccatctgattatagatacttggctcaaagtccacttgtacttttaatacctgttaatatcatctgcctaaaagtagattgttctataaattgtgaaataatcagatcacctctgaagttgggttggttgctacccgtaagtcaagtgtcttccaaataaccggttccagtactaatcaaccatattatttagatgagaataacaaatgaactagaataattcagtttacttttccttcttaacatggaaaggaacttaattcagacttgttgtgcagcaatgatgttcctttttatttttcattttcttttctttttttttttttttttgagatggagtcttgctctgtctcccaggctggagtgcagtggcatgatctcgactcactgcgacttctgcctcctaggttcaagcgattctcttgcctcagcctcctgagtagctgggattacaggcatgtgctactacggctgactaatttttgaatttttagtggagacagggtttcgccatattggccaggctggtcttgaactcctggcctcaagtgatcctcccgcttcagcctcccaaagtgttgggattacatgcatgagccactgcgcccagactaattttctattatgacataatttcagtctttcagagaagttgcaagtatagtaaaagatttcctgtatattctcccagagtcccccaattttttttgagacagtcttgctctgtcacccaggccgaagtgtagtggcaagtgtagtggtgcagtcacagatcattgcagcctcaacttcttgggctcaagtgatcctcccactttagccaccacacccagctaattaaaaaaatttttttttatagagacagggtttcctcatattgcccaggatggtcccgagctcctgggcccaagtaatccacctgcctcagcctcccaaagtggtgggattacagacgtgagccactgtgactacaaattctgacattttactacatgccttgtctttctttttccgtttctctttttctctatttttttctcttgcacacacctttttcctgaaacgtttgtaagttgcagttaacccctgaatgcttcagatttattttctaaaatcaagggcattctcttctcaaaagacgtttttcatcatcaaaattaggaaattaacattgcagcaatgcgattatctaatcaacaggctttattccgtacccattagtgtcctaatgatgtatttgtaacaaaaaataccttacaaatcattgttgcattcttcaggtgtcattattctgtagcctcctctaatcgcgagcaattgctcagtctttgtctttcatggcattgttagttgaattattttgtagaatgcccctcactttaggtttgttatggccattttcttaatcacctcatttaataagtcaaccatcaaaacattcctctattattattttggctgtagcttagacagcttggcctgcagagacaactttattaatattttatatcagttattattttttcttttttgagacagtcttgctgtcactcaggctggagtgcagtggcatgatcttggctcgctgcaacctctgcctcccaggttcaagcaatcctcatgcctgagcctctccagtagctggaaccactggcgtgtgccaccacacctggctaatttttgtatttttagtagagatggggtttcaacatgttggccgggctggtctcaaacttctggcctcaagtgatctgcccaccgcggcctcctgaagtgctgggattacaggtgtgagccactgcacctggcctatattgttattttgaaaattctgttctaattacaaaagccatctgtatgttttatagcaggctaaccaaggtaactgttgttaaaaaatgtttatgcttccatacatatgaagtatgtgcttatataaaaataaaacatgtatgtgtatgtatatacacacacataccattataatcatttattttttataaattgaatcatatagatacacaaaaatactgttcggatatttaatttcttcacctgccgtttctttttaatgggtacatggtattttgtttatggatgttcaaatctgtaatatatttaaagagtctctattaagggatgtttaggttgtaaaaagattattgcttggtggagtattttggtactctattatggtaacattataggtagtgacgttataggattgaaagggtatacacttgaactattgccaggccatgcagagaaaatctgaaatgctttttagttttattcccacccttttggcatttgttacacgctacactaaggcctgatcaaggtactacaatgctcaataatagacaagcatttctataaacttggcgatgcacacattctttcaaggtacttttctcaactacttctggacttcagttattataaatgttaaacaaaggaattagttttctctcccccgagaaaggcaactaggattgatcatttaagaagcttctcattactgaaagtacagggcatctctctgatataaggctttttaatttaggagagcgtattgccctttgtccttcagggctccaggtacatgtgtgtgttctgtgctgtggagtgatagccagcaggctgttcagcccaaccctgcacttatcagtactttgcttcagtgtgtatttatttttcagtacttctccatcacaggctttgtagcctgagggcccagtgtctatgaattcaggagtttagtccaattggatcaaacaagttttggtaaactagctttgaaacctggcactcagttatcctttcagtaggaatccaaggtagggacgtctgcaataaaacaccaccttggtaaagcaaatatcatttctaggataaaccatacccagaagattccatttgagttaggatagttgtttctaaccctgaccttatattagaatcacttggaaggcttttagaaaacacagatgctcactcttgcccaccagagatttggattgagttgatctgaggtggagctggggcataattagatgattctaatgtagatcaggggtcagagtcactggtttagaagttggagagtcatggtctccctgaatgtgatagagagcctgttagaatatgcagcacacctggaatatgggtaatattggctaaaaacaattatgcacaatagaactttggtaaacatgggaacttagttgtggtgtttagttttcttttcttttcttttttttttttaactcttaaagaaggcaaaagtataggactggactggcgataccattgaactgtaaccctgagaaagtaggaaagtagctattagtaaggatggtaaactttctcttttggggccagatagtaaatattttaggctttgtgagtcacctacaatctccgtggcttattcttctttgttttgctttttttccaaccctttaaaaacgtaaaaaccattcttagctcaagggctgtccaaaaacaggtggtaggctggatttggatcatgggccatggtttgccagcccctagtctaagaattgtcacttgtttttcacatgaaacaattttgttggtgatgaagttactaattgttttttatttttgttttatcttagttaattcatctgcctacactatttacatgggaaaagataaatatgaaagtaagttttcaaaagcatttgattttgaaattttcagcaggtaagtgttatctctcactcaccaccttccatgccccccacccagtttgttggttctgagttttcacctactttgataaactagcttttgagaaacagaacaagctcacatagggagacagcagcacctcctaagctacataagaaaaatgctttaactatcaatgttacttgtgatgatttatgggttagtaggagaaatgtaaaactcaagtgttaatatgctgcagactgcttcaccattaaatcacacccaaagttaatgtcacaactttattatcatgaaaaagtactaaggtctattttttaaaaagtatagacaaaatgaagtaacatgaatagtaaatgctgtcgaagtagacagatcagagatagtaaatgtgattgaaagctgagaaggctttgtggaggagtgggttaggatggactagattgtggaatcctttgaatgtctattgtaggaatatatagatacaaatctagatacataatttatgtcacagatataaatttagatgatatttttagagccctctggagtggcattttgctgtcattaaaaacctttgtagaaaaaaacgtaagaggccaggcatggtggttcacgcctgtaatcccaacactttgacaggctgaggcgagaggatcacttgagcccaggagttcgagacctgcctgagcaacatagggagaccctgtctctacaaaaaacaacaataaaagaaaatattagctgggcatagtgacacacacctgttgtccttgctactctggaggctgaggcaggaagatcgcttgagcctgggaggtaggctgcagtgagctgtgatcatgccactgcattccagcttaagagacagcgagaatctgttgtctgaagtaagtgaatgtatgtatgtatggaacactttttccctgggaactcttagagtcatttggaggtatcaacttttcctaggttgccttgtaagaacggacattacttctctaaatcaccccattgtctggcattcctagcccattacatttatttctaatagtgtttatgacttcagaccaagaactcgatagaaacatcaatttaagtggaatgatttactttcactgaaaagctttcaggtctgttctttttatcagccagcaggtgtcatcagggagccaaactttgcctgactgagggaaagagattttttaaatttctctttcctttttttgcttaccttttggctatttgctcagtcctacttaaagcattagaaagcctttcagaaaactcatagtgtctacgactgttatgagtgcctttacccaagatgtgtcttccttttgcttttccttttctggatggtaaataccccattcaaattatatagaccatactttcttgggtacattttaaatcatcacatatgaatcattcacaatttatttatttatttatttatttgagacagtttcccactctgtcacccaggctggagtgcagtggcgtgatttcagctcactgcaaccttcacctcctggattcaagcaattctcccacctcagcctcccaagtggctggggctacaggcacgtgctaccatgcctggctaatttctgtaattttagtggagatggggtttcaccatgttggccaagctggtctcaaactcctgacctcaggtgatctgctcgcctcagcctcccaaagtgctgggattacaggcgtaagccactgtgcccagtattgtttatgatttttaaattggcatttaatacttaaataattctgtattaaacagaattattactaattattaatatggctgtagaaatatttattgatataacctttatgtagtgatatatattagccttaaaaaatgtgcattcactttgagcgaatactttagcttttagaaatataccttaaggaaataatcagaaatatggacaactttacttaaaaaatttattgaaccatttataattagaaacaaaccaagggccaacaatagaaaagtttattcatataagagaattaggtagtcattgttcccaaagaactttatttttatttgtatctaacaaatacatagtttaaaaagtcaagtagtaatagaatgcttagaattaaaaaaagaatccttcttaatacccatgttccaccccacctgctacctccccagacaattacttttcactctgttagctatttcttctggtgttttatttccatgtgtgatagaatttaaggtgatttttattttctttttatacttctaatgtttgttttgttttaaattttctgtaattttataatcaagttaatttttcttaaagaagtaaaatatttctttaaagtttcagccagttctttttaatgtttaagtattattaggtgaattgattatctgaaacatctgaactattggttgctttgttttgtcagtgttagttttattatcttcatatagaaataatatctgagctttagattagaagtattatataaatttataaaaattataaagttcatattgttcaattatgaaaattattattttttctgtattttcaagcatcaaggcctccgaattactcttcttcattgagggagagagaaatttgtgggaggagctgacatttctcccattcttataaaccctggcatatcttcatttgacagtttttgtttctttcgtttctcatatctcattgcagatgaagatctgatcaagcatggctggcctgaagatatctggtaagtaacaattttggttctgccctctgtagatcatcatttcctttcttagacttggccaagcattcaaactagaatcatgctttgtactgtggtttatgggtcttcagggttaaacagctgactgccagttccttcatttctaattaccttgcaagttggaaatgatgtttttgggtttgatctcaggcttgagagcaaaggcctctaggacacaggccttctttttcctcctttttgtctccacgccatagtaagttactgagaccacacctcacttaaatattcagaccactgttcttgagtggaaaaatgaagacttcacatgaagcaatgaagaaaatagatacaagcatccatgcggatggaatagacggaggttcttaccggtccagctttaaaggaagcacacttgttcccctttgtcttctaaactccctgatgagtttagctctgtcttgatccaaccccgacgccttctttctaaaacaatttatgtgaactgttttaaataataacatatactttcttagtctccttttgagatcatttattttgctcacaaaacccagtccaaaaaaaaagaataccaaacaaacaaaaagacttcatttaagctgaattcttttctctgtcttagaacaccatatagacttctaccattcagacctggggccttttatgaatacatgggcttctgtcctataacactgtcacacccagtctactttcgttttcttcatcttcagcttccaccactgactctgaccctagtattgcctctcttctagagcacagtcctgcctatggagtgggatatcatcttcctgactcctcatacctcctaccaaatgctatccctgaagataaaggcacctgggtcccgtttgctttattatgatagtgaatatctgtcaagcacttaactatatgccaaatactactaagtgtttacctccattaatacatttaacttcacaacaaccctgtgaaatagatattaatatttatgcccattttttcagatgaggaaattaaggttaagagaaactgactgggtctgctctgtctgctactggctctggctctggttctaagtcactgcttctgtcttctccaggctgctgctcttttggcttcagctcctttcttctcccaggctgttgctgcagctctctctggacctcttttctccaaatgtggacacagacccttcacttatttccctctagtgatagagttgggctactgctttttagaagagttgatttaattttctttttttttttgagacggagtttcgcccttgttgccgaggctggagtgcaatggtgcgatctcggctcactgtaacctctgcctccctagttcaagagattctcctgcctcagcctcccgagtagctgggactacaggcacccatcatcatgcctggctaattttttgtatttttagtagagactggggctatcaccacattggccaggctggtctcgaactcctaacctcaggtgatccacccgcgttggactcccaaagtgctgggattagaggcgtgagccaccgcgcccagccagaacaaaggaattttaaaggcttatttaaatctggtccctattccagcacaaaaacctgtcttctaaatccaaatatgtcatcaagttaaaccctgcttggtgctcttttgcctcaagtgggcagtgtgcaatgctgaaaacatccagactggggctgcccgccttcctagggcctgagacagtaagctgtatgaggacaatgatcacctatttcattaactactatgtccccagtacctagcataggtcctggcacatagtaggtattcagtaaatattggttgatttcctaattgactccctgccagcgtagaagcagtctccatggacatttccctacaatggccacatcatggttatctccattttgagctcctgccgaccccagctggatgattttcagttgtttttaaagatctccagactctcatgggaataagaatggctgcacctgttaggcagttagctgatggaaatttttaacctatcaggtttgaggcataaaaacctgcatagagaaggttacataatcagatgcagcctgaaaatcagtgtaccacagccttctacctgactttcatttgtttaaataaatggaagagaaatttccagtttacaacccacatccaataaattatgacctcagtttttcatttcattaaggttagtacttcccaaattggtctacagataccaagaggcctatttcgaccccctttagtagtcttgagatgaatgactgttgttggatgtgattggcttttaccttcagaagctacatttgaggtgtgatgtgagtaggtgtagacctcaaaacccattccagctgtcaattttggacatattccagggagtgctaagaatgatcctgagttgatcaccattccagggtggggtgttcacctgcttcactttgtggagctgttgaatcgttcattacctctgtgaatgtcagcatctggatttatcccggaaaacctcctgatgctcctttaagcaaagggttttcctaggaatcagtgagaatggaactaaattcatctttttttttttttttttgagacagagtcttgctctgtcacccaggctggagtgcagtggtgcaatcttgactcactgtaacctccacctcccgggttcaagctattctcctgcctcagcctcccaagtagctgggattacaggcatgtaccaccacaccaggctaattttttttttttttttttttgagacagagtctcgctctgtctcccaggttggagtgcagtagtaccatcttagcccaatgtaacctccacctcccgggttcaagtggttctgctgcttcagcctcccaagtagctgggactacaggctcccgccactgtgcctggctaatttttttgtatttttagtggtgatgggatttcatcatattggccaggctggtctccaacccctgacctgaagtgatccacccacctcggcctcccaaagtgctggcacgacaggcatgagccactgtgcccagccctaaattcatctttaaatgtaggaaaatagaaatagtgtgtatttactgtgtccagacctcctaatgattagtatttccacagactctgctttaagtcgttggacagcccagctccagggccctgaatctgtatcctcagacagttgatgcttatttagtgaagcttctggtctctgcattcaggaaagggtaacagggagaggaagataacaaggataagagggaactatggctgtaatttaaactttgaataaatgtttagaaagattggagaagtcgtttgcttcttttttaaggaaactcgctcaagatagtttgtttatagagctggattttttttttctcttatactttcatccattctcccctgctctttgtagaggtgtatctatcatatacaaacctgaaattggtgtatattgataaagttgctgtattttggcagtgatattcctgtgtgtgttttggttctttctctacttatgtatgaatatcattaaatatatattgaattatttgggtatttcttttgacaaaattctacatcagagacctttaagaaaaatcagaattcaatctattataggtacatagggaagaagatgttgtaaatagagaactggcttaaggcaaataaaagttggaatgggtaaagttacttttcagttatcttggttactagtgtgatattttcctaagattctgaaagaggataatgagatatgtaatttttagatttgcaaaaagcacaggtttttctggctggaaaatgtccagctgaaggtgataattagtatgaatctctcacatgggaatgcaaatgagtaagtgaaccacttggagaaatgtaagtcaaataagatgttatgtccatttctggctatcactaatgattaagagtaaaacctcgagtcatcataaactgtgtgccaaaagtgcctaatatttttctgtatgcatagtgaatagcaagatgactaacctctttaaagagggcacttttatatagaatcatacagtctacatcttgtactaggtgtgaaggtgaccattttcacctctaaaacatttattagtgcttaagaaaatggctagagaaacataatgggatgtaatgatgcctctttaggattttctgaacattcttcagtctggaaaggtaaggaccaaggaagcagtatgactaatgtattagtccatcttgcattgctatagagaaatacctgagactgggtaatttgtaaagaaaagaggtttaattggctcatggtttggcaggctatacaggaagcatggcagtgtctgtttctgggaggcctcattcatagaacttttaatcatggcagaaggcaaaggggaagcgaggcggcttacatggcaggagcagggtgccggggctgtgcacttttaaacagatctcatgagaactctatcataagaatagcaccaaagggatggtgctaacccattcatgaagaatccacccccatgatccagtcacctcccaccaggccccacttctaacgctggggattacaattcgacatgagacttggtggggacgcaaatccaaatcatatcaactaaagttaacagaatcacgaagtggcgatagtgttaccttgtttgttgtgtgatgctgggatgcggagggggcatttctgggtattggaaagagaaagtcaagttcattgggtgaattgaaaacatgaaaatctcatatcctgaatgttgcatagattttaaaaggtttaattaaattgatagatgatagatccatcatgaaaggtaaatttaaggggtgggggacattctgaatgtttttaggacaatgtcagtaaagggcagtgctcacccaagagacatatattggtatcactgtcagaatatagggccggatgaactgttgtgcttgtgaattattgggttacattattgaattgtaacccatttaatgacgtgttctgcttagcgtctttaggccccacctaactcttccagctctctattcgacattctctttggattgttttgctataacttgaaatttgggatgtcacaaacgaaactgtcatctgtttccgccaaactgtggttctgctaatctcccaggctggcagcattggagacttgctgacttctttcatcccccactcttttcacctgaaattcctttccttggttttgctctaagtcctatgcttcagtcaggggccaaccaaatctcactgcctcctttttatcatgaagcctttgatcactgatagttctttttatatcttgaaaaatcacccttcccagtacagttaatatttagtatctctactcatcttggcacttactcacagctccataattcagtgtttctcgtacctcttcatggtgatggggagccctttggaggtggtgactgtgctttatactcctcatgatgcttcacatgtggcaggcatggagtgaagactttttagaacagaatgctttaaatggcatgtggcctgaggagatgattgtcttgtacctcttgctaaaagtggttttcattctttgtaggtttcatgtggacaaactctcttcggctcatgtataccttcgattacataaggtaactgaatttaaacatggattcttgacttttctcctgatgatgcatcatatcttgttctttatcctttgcaattaaattgcttacagtaataagtcggtacgcaaatctaaaagttaacaaatgaagacgtgtcttccctctgacccagaaaatcactctaacattctagatgatttttgagatatagaaggaggcagtgtacatatttcccagctagatgcactgcttatcctgtcacttccggtgtgctgtctgtcatctctgctttccttttctttcaattcagttgacactcccagactttctgtctcctccagtggatatcatgtgtggctcatgtgattctcctgcctcagtgaagggcccgtgttcccagttatcatgggcttctttaggaagtttaaaagaacatgctagtaataaaggaaaaaaatttttagtggcccctagtaatacaataccactatttttccaatctatctctattcatatattttatatagttgaatcatagggtatatatgcttgcgagtgtactgctttctttttgataaactttcaactttggaaaaatgttagatttccagaaaagtggcagaagtgatacagagttcccatctacccttcacctagtttcccccatcatcaacatcttatattactatggtagatttgtcaagacaaagaaactaaccttggcacatcgctgtcacctaaactctggactttatttggatttcaccaactttctattaatgccctctttttgttctagtagccagtctagagtaccatattacatttagttgtgtctgcctagtctcctctagtctatcacaatttctaattctttctctgttttttatgaccttgacagtttgagaagtactgatcaggtgttttgtagactattgcttagtttgcatttatctgatattttttctcgtgactagacgggttatgggtttagggggagaatatcacagaggtgaagtgcctgtctcgtcacagcatatcgggtgcgtgtattaccgtgacttatcattgatgacgtgagccttgatggcctggccagtgtagtgtttggaggttgctctactataaggttgcttttctccccatttctgtattcttatttggaagcaagtcactaagtccagcccacactcaaggaagtggaggatggaattaagcactacttcctggagaggggagtgtctatatacattatttggaattctggaaggaacatttgtctcttttcccctatttatttattcagtcatttatttgcatcagcctagactcctgcgtttattttatcctttgagatatgttctggaaccaggttattttactctgatattgttgcagcttcagctggagctctttcagcgggctcccgtatgctcccatgtcctctgacatgctcccatccttttgttctttgagcacatccttgctttctggcactacagagagctccaggctcgtcttgtattttccctgtcccagctctagaatggggcatttctccaaggaaccctggttcttttcagtggtaatggtgtttcgaaatcaagatctagaccgatccttctgtagtttatgagtgtgatgattggctgttcatgtgcatgtatgagatgtgccacccttgaaccttgtcatgtctgatgtgaaaaaatttaaaaagatctgggctctgggtgcgcctgttactactggagtgtcatcacttttcggccctctgagctgacagagaaggagatacatgtatgtgtactaacccatgtatatgcacatatctgtaatcatttctgtatctttccatctgtatttatattaagctaaacatgagctcatggggatggctctgattgtcatcctttgctacaggttgtctttttgccttaaaccatttccaatcaaaacattgttttccatgctagcatctggggaggctgagcaaggaggatcacttgagcccaggagttcaagaccagcctgggcatcatagggagaccctgtcactacagaaaataaagaaaatgtagctggttgtgggatacccacctgtggtcccagttactcgggaggctgaggtaggaggctcacttgagcccaggaggcggaggctgaggcttcagtgagccatgatcacattactgcactctagcctgggcaacagagcaagaccctgtgtcaagaacaacaacaacaaaaacacatcattttccacagttagctgtaagctactttttttccccacccctttcagtgacgtgatgtcctatgtttgtaatacagttaaattatcttgtccacattccatcttgacatcccctggttgattagattaccttttaacatgacattttatgaactcttttatgttgctatataattttcatatttgttattttgactggctgcattgagttaataatatgctgcaattaatatgaaactcttttgtcagaatataggttgtttccaatttttcagcattatgaatcaccaagaaataacttttcatgaactaccttctggttttattttttgttttttgtttttcattattttcttagaataattcttaggaatggatttcctgggtcaaaagatgtacatagtttgctaactgcttttttgccagattgccctctgaaagtattgtttaaaatgctctctactatttataggttttccaaaacccttttgggttttataacttaaaaaataaaaataaaaccttttgaccattttgatgaatataagatgctacttcattatggcaataatattcactttttagtttactagcaaggttaaacagtgtgccccatctcatactatttatgtttttgaggactatatggtgaaggaaaagaggattatgaagtctgtgctggagcaaaattctgaattcttttaggcaacttcttgccattttggaactattagatttagagaaaataaattatggtgttaccaagtttcattttgggtcagattaatgtcttctttgggggatctgctgtgtcagaagatggaaaatactggtggtagtcccaagttctcattaccaccaattatttgtttgaatacaagttcaatttcactttcttttggaaacacataatgagctcagtttaattttttttggtagatatgggatctcactgtgttgcccatgctggtcttgaacgcctgggctcaagctgtcctcctgccttggcttcccaaagtgctgagattataggcacgagcccctaaacccagcctaatgtgcccagtttgaaagtgtatgctccttgaggaacttttacctgattaatttcctgcagtaaatgacatagccattgtaattagtaggtaccaaggaagttggaaatgcagtaagactaagggattcattcagaccctggggccagactgctggctttgaattctggttctgctgcttactcaccacgtgactctgagcaagttacttaactggcctgtttctgcatctgtaaaaggggcatcacctcacttattcacctttgattttgatacaaatttctatagagaaaaaggatcagtgtcatttctgttatttcttctttacagtgaatggttgagatctacacaacaataacttttttcctgattaaagctgaggatagatgacctaccagatgtctgagaactaaaactacacgtattcttttgaggggaaggtcatagggacctcggccacgaagacatccagttgtcaaaaataggcaccattttcccacaaggtttctagaagtcagaatgagaagaaagagaataaaaattactcagacataattataattaatattctgggagtttttttcatttcctgtttttttttgcttttttttttttttacttattaagtgtcaatattttcatattacagccttctcttattttaaacaaacattcccgtaatgcacacagtaaatttacttttcagtgttctgtaacagttgaagaacctctgcttttagtaaaatcatgcctagtaggtaaggcagcaaatgccctttgagtgctccagtgtcaatggataatgaggtagtggaccaattggtttatttttgtgtttcagggagagaatatagaagacatcccaaaggaagtgctgatggactgtgcccaccttgtgaaggccaatagcattcaaggtcagttttcctagaggtgtttttagaattagcacggactttctctgtgtctgaaatggattacattttagtgagcatgctgttgactttggcctccatcaaagaataacatgtgctgtgcctttgccatgttttgttctttaagatggatggcaattttggtacctgtcaaagaactaaaaactgatctccccacccctgtcattttgacggtcctgtctaagtctcggctctttttactgtttccttaccttgaatagaaggttgtctagatctgtctgtacttagtgttattataaaaagactttgggaaatttggcaatgttgatagctaagcaagaacaatgtgttttatggctttatttttaatgttgtttgatatctttatttctattatttgtcattagattctagaattaaagtccccaaatcatgcttctctactttttctttccctcctcctcttacatactttttccctcttaaattgcgaagttgtcaagtcagttgatcttgttacttcccctccccaccaaagagaatcttatttagtttgtctggggtgattcccaaatattactgcttttaaaagctctctgggtgattctcctgtgcagcatgggttgagaacaattagcctaagtattttagatggggcctggcataccgtgcttggtgattacctggtatttatttctgctatgcaagatttcatctcatagtcatgaagggtcaagaaggatgattattagggtaggggtggggtttaagaagggaaaccaggaggtggtgctctgctaataatgagccagtagatccgattttagggtgtagaacacaggtctagatcgggtagaggttattgtggcttgagatggagtgaagggatgctccagagggttggaaagcaatcatggtttgggaagaagataaacatggggcggacccacagctgataacaggtaccaggagttggcaattacaggacaagagcagcgcagcattcccctttccccaactgcgcttcccacaccttcacttaggctgcctgaatgatgcgtcagcacctagccaaagaaggtagaactgttgctttacagagccactgattttcaactctataagttaacaaattgtaatacattttgggacattccattttatgaggagaacagaattttctaagattttcagctaagatcttcagttactgaaataacaagaagaattgaaacaatcattatattctttccttctgtgttccaacttcctttacatgtccttatcccttccagtgctgctggctagcagacatgtctttgttaaaagagctttggaggccttattcttggcccagctgctttcttcttaatctcttcatagtttactaattctagagaaaacaaagaggagcaaagagtcatgacactgaattactgtttctctcctcttcagccttctgcaacgatagctcagctagcaaataaggacctatgcccaagggtcttgctcttgtgagtcagtagaagattatgtgccgaggagtggagaaaatggtcgttgctatgagatttccagaggacactccacttgtggcactttgtagggacaaagttttcccccggtttaccatctgcagtgctcagaaccaagggctttggggctaaatttgtttgtcgctatagaatcagcctgttctgggtcataggtctagaatcttaggtcagcctgttctgtgttcacccagtgaatctttccagattaaacttttagaagtttagaaactgtcttgactctcctcggcctaaactgttcagtccggacttctgaaaccagcatttaagcgtctctcatttgactgcagacttctttcccttcacgtatttcacactacagccaaagccaatatttgctgttttctgaccttgcacctggcttgtattgttccctctgccctcaggtttgtctttgtcagtcatcagagtccagattcaagctaaggttcaaggtccacatagtaggtgtagtggtggtagtaattgctaacactgatggagtgttaattacatgcctggccctgtgctaagtacttcacaaattatccaccctgttgagttagatattattttcattttatagaggaggaaactgatcttaaagagaattaaggaacttgttcaaggtcttagaggtctaaagtgcagtagagactggatttgatgtcaacccatttggctcaagtgttctgccgtaacccctgagctctgtgagcctcctcgatgaagccttttccttcttcagctttgagtggccccactttctctgtgctgtcttagcagtttcctgtagctttccaacagcatttgatcagttctccttttgatccaagttattgatgtgcttaccctgctccgttagagtcgtggagagcaagattcattgtctggtcatgtttgtgtcccccacagtgccttgcacatggagattttctaaagaaattttattttgaaaaaactttcaggtatacagaaaagttgcaagaatagtacagctaccatataccattcacttagattcatcaatttttaaatttttccatatttatttgctttatatattgcatactcattaacctttttagctgaaccatccaaagcgaaattgtagatatcatgacccttgaacatgtccttctgaagaacatggacgttgtcttaaataactgtattacagtggtaaaattcaggaagtttaacatggatagaatactgtgttctgatatacagtccatatttaagttttgccacttgtcccgctactgtttctttatagcttttttttttggatccagggccatgtgctgtatttacttgcgctgtatttacttctctttagtctcctttaatccagagatactgctttgtctttcaaaaagtacagaccagttgtagtaatgggattactaacccacagttggggtttgtctgatgcttcctctggattagaatcccatcatgcactttggagcaggaatattacataagtgaagttttgcacattatagtcaggcagcacatgatgtcattttgtgccatttttggtggtgttaaccttgaccccttgggtaaagtggtcttccagctttttccagtgtacatggggatttaataagcattgaaatcccttgccatctaatttggaaggaccagagagagtgtcagaccagtgattaaactgcgatttccagagctgccagggagggtatgagtggtggaggaggcggtgaaggggcaggaggaggagtgaacagggtacctggcactccttccatccagagcgcctctgctttgatgacttctgtgttttctttggtaaaagggttccactgctgaagaaactataagcaaaaactctattaaactagtccaatttcctcacatttcatatgaaattcagagggccaggggacttctccagagaggctcggctagctcgtggtagtcccggatagagtccagggcttgtgagttccaggccatggctttccgttgctgcttaaccttcagagtcaaggacttctttgagaatctgaggaaacatattcagtccttttctcttgaaaaaaaaactcaatgataaattttgcatccaattttagagagtcctcagaagtccctgaagctaatccatggactcctacttgccatagtaatacttccgtttgaattttgtcagctttaccatttgccttttgtgggtggcttttgaaaaagtattggtggtttaaaacaaggggtggcctgttcgttctaagccgtttcccttgttggcttatggcagtttgccagtgggtaagggaacacattgctcagtctcatcctgcctgcatgttgaagacagtctctcttggcaggctgcaagatgaacaacgttaatgtggtatatacgccgtggtctaacctgaagaaaacagctgacatggatgtggggcagataggctttcacaggcagaaggatgtaagtgttttgtgccactgaaggaggcggagccctgatactgaatggagtatcctatcttttctgtctgacaccattgttgttgagggctgagcatgatatatgttttctaaagggaattaaactgggttgctaaacccctggaaagcctcatccctcttctgggagaaaaaaaacaaaaagatgcaatatcttttctcctatctcccttaaaggtaaaaattgtgacagtggagaagaaagtaaatgagatcctgaaccgattagaaaagaccaaagtcgagcggttcccagacctagcagcagagaaagaatgcagagatcgtgaagagaggaatgagaaaaaagcccaaattcaggaaatgaaaaagagagaaaaagaagaaatgaagaagaagagggaaatggatgaacttaggtatgtcggagctgtggcattgagactgacctcaaagattattccctgatgattttaatcatgtattagccattaagaacgatatattggtggaaggagggacatgtaacaagctcagcttaagctcaaccttaaatcagtttttttaaaaaaggcatttatattaatgtgttggttaaaagaattgcttgtttatggcagcaggatatgaaagtggatgaaataaaataactaattttattcatagagaaaccttcataggttatccctagtttggtttggtttgtaaagttcttctggaaaggaaaaggtgctgtgggaggtatttactattgactagctgtgctatttaagtaaagttgtgttggctctaaaaaccaatgctagtaactctcaaagctgtttttaaaactcttttttacattttgaaagtttaaagtaatgtagtgaggtctgcttcaaagcactacatttttaaacagctaaatagttcaaatacaatttggctcctgaaattctagtgaagaaggccatgagaataatgattatgttagttttctattgccattgaaacaaattgccacaaatgtagtagcttaaaacaacacacatttattgtctgtagattagaagtccagcaagattctcactgggctaaaatcaaagtgtctggaggcactaggggagaatcttccctttcagctttgagaggcacccccatttcttggcttgtggctccttctccaagctttccatggtcacagccccctgtctgaccactgccttttctgcttttaaggaacagtgtgattagattgagttaatccagataattcacaataatctctccattttaaggtcctaactaatgacatctgcaaagtctactttgccatagaagataacatatttataggttctacagactagaatgtggatgttctgccatacagtgctgtacccgcagagcccctagttgttctaattaaaggaaattaatcctgcgaattctcatcacagaactcctagatttttccatgtttttttatttgcaatacatatgccaaaaagaaaaaagagttacttataacatatattgcctttggaaatggtgtagaatcagaaacatgttgcttaggcatgtcctaacccagtttccttggaatgccctggattcttagaaagattgttgggtcagaatgtaggtataatgaacacgtactgttatttattattcgcatgcacgtgtttctggttggggttctgctaaaacaggcttcacttaaaatacagtgttcaaatggagagcttcagaaatgttaccctgagttacaatctgctaatatgaggccaactaacatatatgtttaagtatttggtatggcctagaattctgagtctgctttgtgtttgaagtgaaagaaacggtattaactccatcagtgaggtaaaatttgtgaaattctgagtgatgcaggatttagagcagttaattcttttttgttttgagtttggagtggggggaaactgaaaatatgccttttagtgccctttacggatcgaacataattttgtttaggaacatgatggaacatatattaggaacataagatcacctaatttacttacaacattgaataaggaagactagctaacccttctgaacattttccatctgccaaacactgcattgcaaagtgctttactgcattctgtcatttaattccaacaatagccatagtagatttttatctgcatcttatagaagaggaaactgagcctgagaagcaatcaagaaacttgttataagctcatttggctagttagtctcagtctgattctcaaacctacacatattacttactatactcttcttccctttgttcaatttattccattttaaagtaatttttattcaatataaatcaatcaagtaatttatagatgtcataattcaaattaagctgcatgctactaaaattaaggacattagtatgatttttatgagtttcaaaaattacaagcatttaaacaaaatttgtccaccaaaacacagtttcgtatcttctgggcttttttccatagtgtcatcaacatataaaatactcctattaactgaagggaaaactcaatcttattgaataagatttttccttcaaaagtttaatcagtcccactttctaagttgtcactggtcatttgtattttttaataatctccatggatctcagaaaaccaaaaacaattgctatgtttatttccgttaaccgtgtgccacacagacaactttctgtcacatgctgcagaagacagaagaacgtggcacagggctgcagtgccgggaatggaacgcggtgacattgcaagtctttgcttggcacatccagagctgccgtttgctgtgttctgcagcatctgtgaaattccagcaataggctctaagcttctgacttgttttgtaatgtgtttttatacattttgcagtgctagcattcactttaatttctgtctttgaatcttccacccaagatatagaaatctgtgtctattacctgttttaattttgcattcttttatttggctttttgtgttactgtaccaaacatttattacatcaaaattaagtcaacccatgtagatgtcgaaaccagaagaaataagcaatagtcagggaaacgtcataaagaggatgggtgaataacagatgagaggttgaggcagtcaaaacaaagggtaaggactatgactacctgagagagggatatttaaaagttgagatgcggccaggcaaagtgattcatgcctgtaatcccagcactttgggaggctgaggcagaaggattgcttgagcccaggagtttgagatcagcctgggcaacaaaattaggactgtctctacaaaaaatcaaataactagccaggcgtgggtggtacaagcctatagtcgcagctactctggaggctgaggtgggaggattgcttgagccctgttggctgaggctgcagtgagctcactgcattccatcctgtgtgacagagctagattctgcctcaaaaaataaaaataaaaagctgtgatagagactgggagatcagaattggaacccaaagctcaggtaattggaatgagagaagtacaagacccaggtgaaatggtaagtcagtaaatatatcatcaatttgaacattgacatgaacttgattttcatgcaaagattacttcagcatggaggataatgtggaaagattgtagcctgtaactgacaaagcaggaatccaaactcaagtctaatcctgaagccaatagtctatcgtgcttcctttgaggcaaggaatgaacaaactggcaaggccggagtcaaggtcacacataggcaagtgaaagaatgaaaaattaggtacattgtagagtgacttaaaaggtttagtccagaatttcatgttgtaagtgataaagagcctttataggttttgtggaatattggggaatagacttacaggatgaatgaagtaacatgtaggagaggaaatggtgagaccagtaactaattaaatggatgacagtctcatgaagaaccaacttctttgtacctttttttgtttatcttatacacactgccactgccttctactgtaaataatgctgtgtgtgctgtgcctcttcgtgttacctgtgaggtccttcagggaagcaatcgtgcatccttgcctccccttagaggtgacagagtgctttgtctgtgcagtgagtgactagtcatacgtcatgaatatactgagattagcttccctggtatggtgattccttttttgtttcaattttaaagtaatttttattcaatataaaccaagtaacttatatatgtcataattcatattaagctgcatgctactaaaatttagggtgttagtatcattttatgagtttcagaaattacaagcatttaaacaaaacttaaaaaccaaaacacagtttttatatcttctgggctttcttccatagggtcctcaacatataaaatatttgtattaactgaggggaaataattcccagtctcattgactacaatttttgcttcaaaagtttaattagtccccctttctaagctgtcgctaatcacttgtattttttaataatctccatggattcagaaaactaaaaacaattggtatgtctctttctgctaaacacatgccagacatatcccaggctgaattgctggggtgccatcatagcccactgcagcctccaattcctgggctcaagcgatcctcccacctcagcctccttagtagctgggactacagactcactccaccatgcccagctaatatctttattttttgtagagatggagtcttcctatgttgcccaggctaatctcaaacccctgagctcaagtgatcctcctgccttggcctcccaaagtgctgggattaaaggcataagccaccacacttgtcccctgatatggtggtcttgaagccaagatcaaaactctgatagctaaagagttggaaggagtgctgtaagcagagggaactatgtatgcaaagaccttgtatgggagcagcaaggcaaaatgcaggactaaagtcccaaatgtctgaagcagcaggggtcaatgggcacttggatcaaggggccagtccatgcaggcccttgctggccgtgtttgtcttcatcctaagagcactgtgaagccatcaaaaggctttaagcaagggttgatacaatgaagcttgtgtgttgagaaggtcactttgctgacctgattgtaaagggaaccagagtgggtgtgactaggttaagagcattccacatcacagatggtagcttagaatatggtggtgacttggggtggagagaagtggattattgtttttctaggtaaaacattaggatttggtgatagtttggattgaggcaaagggcagggaaaagggggctaagaatgactcctaggttgctagttggaaatggaatggatagtgatgacattctttgagctggagaacactgggaaagaactaaactggtttggtagggggaagaccatgagttggatagggacttaagaatctgaaaatacccttgagatctccaaaaagatgtcagggaggtagttggactaatggaaatggagctcagaggaaactaaagaaaggtaaatttgtttttgtttgtttttttgttttgttttgtttttgagactgagtctcactctgttgcccaggctggagtgcagtggcacgatctcggctcactgcaacctccacctcccgggttcaagctattctcctgcctcagtttcccaggtagctgaaattacaggcatgcaccaccacgcctggctaatttttgtatatttttagtaaagacagggtttcaccatgttggccaggctggcctcgaactcctgacctcaagtgatccgcctgccttggcctcccaaagtgctgggattacaggtgtgagctaccgtgcccagcccaagaaaggtaaatttgtgcatcattgtcacatagatgggaattttgacccagtgattcttcagcctgggtagatccccacaactgggcatatggatccagttaaatcttcacaagtgattttcagatgcagtcaggactgacattctctgttctcaccacttttgtttcatcaacatgtctttctcctcctgctcatgcaacctgttgatcttgtctgttttttgtttgtttgtttgtttttgttttgttttaattccttgtggataccacttaactcttacaagcttacaagtctctccagagggaaagacttactggtctctccctctgggtgtctcccaactcattatctttgactgtgacatttctccttcccactggtcttcagttttcagtttctacagttcatatttacttgggtatctcactatgacttcaaatgcggcatgtctcaaaccaggcacatcttctttgcaacattttcccatttctcctatttttttcaaattgcccaagctacaaaccttgatgtcattgttgtttcttctctgtattccttcttaccattacagctgttaactccagggattcatgccctcaaattggagtatcgcaataagctgtggcctgataagagtataagcttaggagtctgacctgggttcaaaacctggcatatcttcttatctctaagaccttgaacaacttacttaaccatcctgactctgctttcttattttgtacaatgggcttaaaatactctggtaaatactgttattgtgaatggaccttcttgtcttaaccacctctctaatcttgtttgctacagattattcttttcaaaacattggtattatgtagtctcactttcctttgtctcttggtgtatttgttgttgttgtcgtttgagatggagtcttgctctgtcgcccatgttggagtgcagtggtgcaatctcagctcactgcaacctccacctcctaggttcaagtgattctcctgcctcagcctcctgagtagctgggattacaggtgcacgccaccacgcttgctaatttttgtatttttagtagagatggggtttcaccacattggtcaggctgctctcgaacccctgactttgtgatctgcccgcgttggcctcccacagtgctgggattacaggcgtgagccactgcccccagccgtgtattttttaatagtgcttttcaccatagttattgatgaataagtcttatttcccctcccagtaagttctgtgggtccaggctttgtgttagtcatcattttctgttttcttctcatccgatcctctacccaggcttagcacagggtcttatgcacatggatatttaatgaatgcccattgaacctcattatggctttactcagttgtgtattatggcttcttgcggaacacattgtgttcagtcgtgcaatcaagacaacataattgggcaccacatccagcctgatttcccactactttatttgagaacctacctgagttagctggatattcagcaagtcattaaagataccatctctgtctctttgctcatcccactctctggatctgaaatgccccctcactcatcctgcccacttgattggcttggtttgggttccgccttgtctgtgaagggtgccctgacagctcctgcccacactgatgtgtttcctcctttgaattcctgtagcgtttacaatctgagctgtatacctcagctgtgaatcttatcagatcttggctgtaggtgaatttccccatctgaaaagtaggaataatgccacctgtctcgccaagttattgtggaggtggtgacatgaaacaagtaggagaaagcactttgtaaattataaagtgctgtgcacatcttttttattgtttataaatattcatcctttgaatgttgcaatctccttgagcgcagagattatatctaatagctcttgtgtttcttctaaagcccctgagcagtgctggatacacaggaaatgttcatcaaatatttgttgactggatcaccatattttaaatgtgtgtgtgtgtttttttccttctaggagctattcatcactaatgaaagttgaaaatatgtcttcaaatcaggtatgttcaagtggtttgcatgaatgtttgccttgaaataattcactaagggtttttaataattgtgttactggccattattgccttacatgttgcaaatagctaaccatgatttggcaaccaggacaccactcaggctggattcttttaggcactgcacctccttccctgtggactttctcatttgtgttgttaagtaggtcatctcagggaaagagattgtcagagcttgtctactgtggcgtacaggtctattcattttatatttacaggactttattctttatttcccctcttttctggttgcaggcatgcaaaagtgcctttatttattagtgttctttatcactgtgactgtagagtccatattataattgaatgagaacaaaattatcaccttcaattaaaataacttaccctaagatcttatgtgactcagtgaagcctaagtgacaaaattgtttgttttcatgttccttaggacctgggatagaaacagatggtgacctatgacatagtactgaaaggatcttcttaacattgcgtctaattatttgattggaactatgtcagagaattattgtccttgagggctgtctttcccaaaatttatcttgaagtgtctagagatagcacaatttagctgctattgagcagtctgcagaaaatggaaactgggtggatgtatttgggattttgcatgttttatagtatagtttaaaaatatagtcatccttcagtattcatgggggattggttccaggactccccgaagctaccaaaatcctaggatgcttgagtcccttgtgtaaaatggagtagtatttgcatataacatatgcacatccttccatatactttatctctagattacttataatacctaattagtgtaaatgctatgtaaatagttgttatactgtatttttttaatttatattatttttattgtatttttttaattgtttttttcctctaaatatttttgagctgaggttggttgaattcacagataaagaaatcaagggccaactgtaacagaatttaagatcccttacaagtcatctagtcaaacctcagatttagtgcatgaattagaagtaataggattttacatcttgtttatatctacatattcttctaaaaatttgtaagaacaacattcttattcccatctctatgaagaactaaatgtacgaggctcctttatgaatcagagatgtttctttataatttattcctgaaaaattccagaatagcattattaaattaaatagagctttgaatttgaagtttagagacttaactgtcatgtgctaattgaggtgggggggattaaacatcccttgggcaagggaacgttgtcacagtggttgggttagatcctaataaagtcatttaacctctctgagggagtattcatcatcagtaaaatggacacatattatttcacagggctgcttagaattgaagcaaagacacatcgatgtgaaagtcttccttgacctactttgtaaatagtcatatttttataccttatccagatagtctttggttgctgtttttccagcatatcattatgaaaagatgagatgtgtttaatcctttctggaagctaattttagatttcttgaaactattggaacagtttaacactaaacagtagtcttcaacataccacaactcagatgccattgttgtggttattttgcttattgaagttttctgtgttttagaggcactttccaccagaaatctagcccccatattatttcatgaccttagtcattttattctcatcattttggatttttaaagcttgtatataattctagagttgagaaataaacaaatacacacacacacacacacacctacctaccgacctacatacatacatatacaaacaccatctgatcagtgacagatgttaaaagtcccgagactaggaaattgaatttgtagcccaaaagattgctaatctttctaccctaactctccctctgttgcttgcaacccctgttcctgagctccaagtatgaatcaagttcaagattccaaggaagttttgcactgggtgtttttattctctctttcagtgaaaatgttttcctagtttttctccatactttaaaagaatagactaattctccttgtaaccgtcttctgttaagggatacagatgtttgtgttttgttttgttttgtttccataagttattggggtacagatggtatttggctacatgagtaagttctttagaggtgatttgtgagattttggtgcatccgtcacccaagcagtaaacactgcaccatatttgtagtcttttatccctcacccccctcccactcttccccgtaagtccccaaagtccatcgtatcattcttacgcctttgcatcctcatagcttagctcccacatatcagtgataacatacaatgtttggttttccattcctgagttacttcacttagaataatagtctccagtctcatccaggtcactgcaaatgctgttaatatattcctttttatagctgcatagtattcctttgtgtgtgtgtgtgtgtgtgtgtgtgtgtgtgtgtgtatacacacaccacagtttctttatccactcgttgattgatgggcatttgggtttgttccacaattttgcaattgtgaattgtgccactgtaaacatgtgtgtgcaagtatcttttttgaataatgacttcttttcctctgggtagatacccagtagtgggattgctggatcaaatggtagttctacttcagttctttaagaaatctccttgctgttttccatagtggctgtactagtttacattcccaccagcagtgaagaagtgtaagtgatacagatgttttatgatccaatttagaacgtgatcagttgatttttaagttaaaggcaagtgtttatgtaatataggacttaagttttaatttagcatatacaggttcatcaagaagaataattactgtaattccaaaacatagccccagacaagtggggactctgcacatctaactcacagcctttatagggaatggcttactttcgttgatgacaacccagactgtcttactgagttgttcatcctcagtgtttgggatctaaagctggcatttgaagatactaaatgactctttcaaacattgctactgcttttatttcagattaagactctggggcaatcatagtctttgcgcctggatataacacaatcattagtctgttctttgtacaattatcgaaggcatttttaccttggcttcagttcatcgtgctaatggaagagaaccacagagaaaaccactaagtgaagttggagctaaaaccagacttcacaggaaccaatgttttctacccatatcgtatttctctaccatctttaataagggccatttagataagccttagtctgatccctttctctaacaatgctggtgttaagcaatgggaaagagaaaaaagataaaacaactgtagtgttcagattgtgacattggcaagcaaatcagaatgcacactcttagtgaatgttgtccaaaaaggagtcagggctctacctttgtgtgtggccttcaggacttgcttgtaagccacacaataaaatcagtccctttgtgctgtataccattatgcaggttttttaaattaaaaaatgtggcaaaccaactaagttggtaaactagcctatgtttgacttcctgatggcctttcctattaaaaaagaagaagagatcaaagccatgttgtgaagtcacaaatctgtgacaatgttgaggctcaaattactggaacttaggccagaatcagtttgcatattggcagaattgttggcatgaggacattgaggcagtgtttgcttggtacatttgttgaaggatctgtcatgttttcttacagtcacatttgttttgcactatactaggtcaggtgggacttactgcattatttagagatcagtggtcacttactgctgtgtaatcaggccatgtaatgacacctcacaaaatatagctgttaattcagctatgtcaggaaactgacaacttaaggcggagaagtgatgagtcaatttagttattttactttctgaactcagtgactgagatgagaaggcagctcgctaattaagataattgtaaattttaaatattgaattattttcaaggcttttatgttctcatttttgtgtttcctacaggatggcaatgattcagatgaattcatgtaaaaggagaaaaggagaaaaggacctttgaaagatgtgaatgtagagacaattgcagaccttttggtttcatctgtgttctgaagtataaaatacaaccaaaattctaccttcatcctacccagaaattattgattttcaagttttaaaaaaattgtaccttttttgctgacagaaaaggatcagatatgtataaaatagttgaacttgacagcatataacttaaagtgaaaatgtttttgccagaacatgtcttggtaccttgtgaaagcaggctgcccttgttcttgagatagactttaaaatgaaccagctctgaaaagtacttctgctgctctggtctatccctgaaaacagatgtcttgaaacacttttcatattcttaaaataatcttcacttctgttaagaagaacatgttggtgggtaattatgcgaatgtttccctgtccctgatttctcgattaggcgtatgggttttgaaaaagagatttttcagaagattgtcagcttcagtattcacgttccatcgtgtcatctgggtctgttagtgtagtgaccctcagtgcagtctgtcccagcgtttatgtccttgcttcctctgagcagaggcctccatcttagtatcaacatatttaaagaaattgatggtgttcatcaagctggggcctgtggcagttgttgcctgagcaccaagtaacccaagccacctatgtgacaacttctgggcccaggagtaatttctcagcattgagggtaaaataggatggagtgctctgttgatcatttgggagatgtaggttacctgatttgtgccttaggatgcagcgtgaagcagaagtccatattgcaattatgattttagaaggaactaagcattttactcacacccacagcagcaagaatgacctcctgcagcagatattccacctgtaatagcactttggaactgtgggcaaaaccaaaaggctagtgtttccatttattccatgttggtgtatggggttgaactggaaaattccctgaggcaaaactcactggccaaattttgagagggtatagaaaatgactttagagatgagtggttttgtgtatgtgtctgatgatattcagtctgatgttccgcaattttaaaagttataataaaataccatttttttaatctggaaggacattgatatatgaattcttagaatttgctattaaaaagggtagcccccattccacaagctggttttgagggtgatcttgctctaaaaaacctcattcatcataggctcagtctgacaggttctgtacggggctatcatctttctcctcctctgctaaatgcctctttcttccagctgctcactgggtcaaagggatgtcctttctcagatgtattcttgatacatctcagatgtattcgtagctgtgctccttccatacttccaaggagtccggcttctacagaattcctctgtacctcacactgcaacacatgtagatagcgcttttgaaaaatacatatatttttactatagtatgagaggtcctggggctcaaactttaaacatttcctaactcagcttacactggtttaaaatgtccaggtctctgctgaattctcttgttgaattcatagctctccaacctcctctgtgttgattcctatgcccctaaccctgcagcctctttgttttatttttttccccatctctgttggtcccagggaaagcaaggaaattttcttttgaggacttataggttgattgcccacaggtcaaactgttggcattgaactcctctcatttcttgccattggattgtttcctaaacgttggataggagaattcgaaattgttgctatttttatgagctgtgcccttgatcaaatctgtgctgtgggtctgagtcactttgccaatgtcgtcttcagtttcaacactctgatcagcatgcaggcgaggggcatgtttaatttacttcactaactgctatattctatagctttagacttcatatttcttatccacctttgtctaggctcacgatctttgggcaagggagctttgtcaccgtggttgggctagaacaaatattgagaagtttaccaacacagatgttgagaagtttattgaaaggcactgacattagcagaataagtgatggacattagttgaaccccttcagtgtctatgtgttttattgtattgtctttaactcgttcttgaagcacagatttcagcgagcctttcagctattcagtgccagcggttttccccactcaggaaagatggtgtgagccatacacacagcaggattagacggggagagtttcagctgcagcttctagtttaagaccaaagcccttcctcccgctgctgcatctgtctgagaggggaagctcttgttttccaagctggaaccgtttatgaggaaaactgagcagggtggcaaaatggaaaaggaacaattttctagtttttcctacgcgtgatattgacgcgtgctttttctttgatttgaggtacagcatgtaaataacaaatttccatattcaaaatgatcatattagagtgactgagtgaccttttgattttgaagcagactaaaatctgaccagaccacaatgaaaagtataaaattagaaacttaaattccaagctaaatttcagctttgacccacctaactccagtgaataggtggcagctcagaaacaaggacagcactgctgctgccagagcaagctcacatccagctggcacttcgtgagagctccttcctgccgggcacgtgtgagttcagcgtgggcaagagacttttatgcacattctgtcattcaaaagggaaatgatgccaaccccagatgcagcatgtcctgaatgaatgatctgtaaaatacaataataaaagcttatagtttgagtagaactgtgtgtgtgagagagatttcacttcttattttctcccgcaagttccagtctcactgatgggatgtgcctgcttgttttaggcaagtggggagacggaggtacttggctccccatgtgatgatgcctgcccttcacacagtcacagcaggaggagaggagcaaatcctagtaaagggaaggtcgcccaagaattccaggaggaggattgaagaacccagagctgaaaggccacaatatttgaacactagtacttggagtttacagcttgaccctctgctctcccaaaattcctgggggtctgcctgaaattttggccaaggcaagcctgcaaatgtgaagacttcctgggcggtttcatggatgactgtagggctatgggttgtgttctgttgatagattttcacctcttttatgatagagtttacactattgtgagaatgcttgcagggaggttttaggctcagaggagccacacaaacatacaagtttttctcccagctgtaaaagcatatttgaattcttaaatgtttaccagagcacatttggtttgcatttctagtcagggcaatacctgcatccattggttttaactcccttagctgctagtgttctggggtttaaatgtttaagtaaattagtctatatagggaatgtagtttgaatccagaatttttatacagaaaaatttagagatgtgtgtatatactaggtgacttagcagtgcagtgaaaatacaaatacctacccaatgccatcttttaacctgggtttatcattagattatacatacctctttttctgtcttaaattgattgcttagttttgtctttctgatttcattattgtgtcaatttttggaggggctgtgagctttctaccttagcggtatgactgtaggtctacaccatagccagatgaaacaagaaactggtctctgcccttggcatgtgctgagtggcaccgacctggcaaggaatggcggccagaggaaatcattgctcactctagaaatccatgtagcttttctagttctcaagcctggtgagtgggtgtcaatatttaacgctgaaaaaaaaacacaaggaattctccaaagtcagtgttgtgttttgttccaacatcaatcccatcttgtaaccactgcagtgaaaatataagacaaatggcctgacatttcacatcctgcctggatgaggccttagctgcctgggctcctgctggtgttttggtttctgcatcagcagtttgctatccatagacaaggctaacatttgcttatgatttcagaagagaaccgggatctttcaggtggtaaaggctgatctgtcagacttgaagctttttgacccttggtgaagacacaatgcagggtcagcagatgaaaaccacagactgaaaaagaaaatattcggggcaccgtgcagtgccctggaaccagcctagccttgccagaatcgtcttccactgtgaagccctggtcttcatgtaatgtcccttccaaactctgaagttcgtattttattttatgtactctgcatcagtgaggcttacataacatttcaaaactggaattgcttttaggagagtctttggaatcagctggaaggtctgaaatagacaaagcttaaatctggttaccaaacagcatttttttttttttttttttttttgagacagagtctcgctctgttgcccaggctggagtgcaatggcaagatcttggctcactgcaacctccgtctccgaggcaattatcctgcctcagcctctcaagtagctgggaatacaggcgcgcaccatcactcctggctaatttttttatttttagtagagacggggttttgccatgttggccaggctggtctcgaactcctgacctcaggtgatccacctgcctacatcaacagctgaggcagaagagtgcagtggctcaatcctataatcccaacactgggaggccgaggcgggaggattacttgaacgcaggagttcaagaccagcttgggcaagatactgagaccctctctctacaaaataataataataatataaaaattagctaggcattcctatagtcctagctactcaggaggccaaggcaggaggattgcttgagcccaggagtttgattctgcagtgagctgtgatagcaccactgcactccagcctgggggacagggagaccctgtctctatttaaaaaaaaaaaaagaaaaaaaagataaaagcgggtaaacaaaacacacaaatctcccctcattttagctgctgcctcctccctgcaggccctctgttaacgcccccaaagcccaggaggtcctggaggagtggccccccaggatctcctgggctttgggatcaggaagaatttttcttttccacaaaataattaattttttaaaaatttacaggcataggtactcatggtgcagaatcaaaaggtataaacgggaatagggtgaaagtgtttccagttcccctgcttggggccaatcagcgttacctttttaaaaatcaaaggcagccaggggcagtggactcatgcctgtaatcccagcactttgggaggccaagagggacagattgcttaagtccaggaattcaagaccagcctgggcaacgtggcaaaaccccatctctacaaaaaatacaacaataaaaaaagtccaggttgttggcagtcgccttatagtcccacctacgcaggaggctgaggtgggaggattgcttgagcctgggaggtcaaggctgcagtgagccgttatctcaccactgcactccagcctgagcctgagtgagacccgattaaaaaaaaaaaaaaaaaatcaaaggcagaagctcttgttctggactcagctgagcttggggattctgcctgcttctaggcctggcggaagcagtggctcagctacagggaagggggaggggcttctctctgcctttgcatcctggggcttgtaatccaagagaaaataccgcattcccacaccatggggctgaggggaagataatgagttgagaaatgaagaccaacaagaagattaggagccacttggtgtccctacccttgagcgggcctctatttggacacagagttacaggatgaatggtttcttaataagctcctctgatccaattaaaatctgagctccatgtagaatgacccaaagaagaaagctgtttgctttcatccctgtgcttgagggtggggcagaagtgggagtgtctgcaggtgcgagggggtgggaacaggactggccccaggcacctccagtgcccctttgatcctctccccacgcccagcctgccagagcttcccagggccctggcacctcttcttaccccatcagaatggatgggagaagagctcttgtgtgggtgaggatatttaatgcactgtctactgaaggaaagggagcacacaccatttccactcctagactttaccttccgcggtgtgcatttaggatacagctctgctccttttattgtttatatttttaattttttaatttttttaaattggagatggagtcttgctctgtcatgggctggagagcagtggcatgatctcagctcactgtaactttcgcctcccgggttcacgcgattctcctgcctcaggctcccgagtagttgggactacaggcgcccaccaacacgtctggctaatttttgtgtttttagtagagacggggtttcaccatgttggccaggctggtctcgaactcctgagctcaggcaatccgcccgcctcggcctcccaaagtgctgggattacaggggtgagccactgtgcctggcctctgctccttttctatgtgactttagatgcatgacttgtcctccctgggcctccatttgcccactgggagatgaggaatagagctagagcaggactgtacattctggtgctgcaggggcaggtaacacctgtgggagggtgaggaaagtggctcacatcctgtgagctgtgggggctgggatgagccagagagcacatagctcttcctttagggcagctgcttcagttgtggggaaatggagttttataagggaagtcaatgagtaaagtgcattgaaagagctgaacttggtaggaccgaaaaaaggaagttgcttgtttctcccactttcttcaacaatgctctgaattctcttccccgcccttagatgccatcttggatgaacagatcagattccatgatttcctgatcactttccaatacaggaattgttatatatatttgagacagggtcttgctctgttgcctaggctggagtgcaacggtgcaatcacagctcactgcagcctcaaccttctagactcaaaatcctcctgcttcaagctctcaaatacctgggactaaaggcacatgccaccatgcctttactaaccacctttactaaccacttaactaaacagcacacccagctaagtttttaattttgtgtacagtggggccccctccatgttgccccagctggcctcgaactcccgggctcaagtaattctcccacctcggcctcccaaagtgttgggattacaggcatgagccatcccgcccagccaagaactgttctgttttacaatgacaatttccctttacatatgaaaagttcttctcatttaaatcagaacttcaatctcacatataattcagaacttcagctcacctcctggttcacatctgatacttcaccctgcctcttccagaatgccccatggtcctcctcttccccagcgacggcccctccagaatgggagtggaggctggagaaggtgggtttagggaggattagccgctggatcctctaggacaggggcagagggcaggagtcagagaaaaagaggagagtctttcatggcgggcactcttacaacctggctgttggcagccccactgcagcagaggccccagggctggttcttttccacccatttgtgggttcttcaggctcgctgtaaggattgtcagtgccatagttgtctgatcctggaatgcgcttcccaactgggtctttacaatctcacaccctttcccagtcacaaagggcacacctgcagccacctctgagacttgagcccactttgccagcagccctcgtcggtgaagtctcaacaatttagctctcacctggaacccagctttctgctattgcttccctgtgatcgagggaaaccacttgctaaatgaggcaagtccagtttggccagctgctaccactgtctccccaacttgctgttgtgggtagctctagcttgtgtcctgccttaagaattatccaggtgagaagcaggatctgtccacccccggcccatcgccaagttccagaaggctcctcattcagcttggtgtagtaggattggaagagtggagctctcccttcctgggcccgtggattcccttcagtgcagtcctttaaattgtcacatcttgtagagctgttggggtgattggtttggctctctttctgtatatcatgcattgtgtgtcttacaaccagaatcccttcttgctctctgctttgagacttcatgaatacccggtaacataacattacaaatctagattttttaggtaaagtttccaaatttttatatattggctcaaaattatttaatattgtataggccaaacaaggtttgtctgtgggctgtccattgtccaggagctatcagtttttaagggctctggagagctctggctcggagcccagtttagaaagagctctgggtcttctccagtcctcatcatctgtgaatttctgattttcctggatttagtatgagccactggaaggaactctaggtgacagagtattatccagtgtggataccaccagtgtcctagagaaagaagagatgcagcgaaggaccagcaggtggcaggagagagtaaaccctggtctcggcgcgcatcacgcggaggttcagcggtccttgagaaggctggacacaggaagtgctgcacctcacaaaaagctgtgcttcaaggggggtttcaaagctctttgcctttgaaatcttaaaaatgtgggcggaaggtgcctgaatcttcttctaaaccaatactacgtgttgatctcagaggcaaactgagccaggtgctgtggctcacacctataatcccagctacttgggaggctcaggtaggaggatcatttgagcccaggagttcgagaccagcctgggcaacatagggagggcccatttcattttaaaataaatgctgtcggctgggcgcggtggcttacgcctgtaatcccaacactttgggatgccgaggtgggggcagataactgcaggtcaggagttcaagaccagcctgaccaacatggtgagacctcatctctactaaaaatacaaaaattagccaggtgtgatggcacacacctgtaatcccagctgaggcaggagaattgcttgaacctgggaggcagaggttgcagtgaggcaagatcgcaccactgcactccagcctgggtgacagagcgagaccgcatctcaaaaaataaataaataaataaatactgtcaaagcacaatgctcatatttaaaatcaaatctctttggtttcagaataaactgtttttattttttattttttttgagacggagttttgctcttattgcccaggctagagtgcagtggcacaatctcagctcactgcaacctccaccttccagtttcaagcaattctcctgcctcagtctcccaagtcgctgggattacaggcgcccgccaccaagcccagctaattttttaaatatttttagtagagacggggtttcaccgcattggtcaggctggtctcgaactgctgaccttgtgatccacccgcctcggcttcccaaagtgctgggatcacaggcgtgagccactgcgcctggctgttgtttttaagagacaatgtcttgctctgttgcccaggctggagagcagtggcgcaatcatagctcactgcagccttgaactcctgggctcaaacaatcctcccacctcagcctcctgagtagctgtgaccacagatgcacaccactacacccagctaatttttaaaaattgtgtagatgcaggtcttgctatgtcacccaggctggtcttgaactcctgggctcaagtaatcctcctgccacgggctcccaaagtgcttctatgtttcctttgtgcatgtcatgcacaggtttcatagactcatagcctgtggaggttggaagagactttaagggtcatcttagctgacctaactgtgacctctgcgactccctaaacagaagacctaagcctgggcatgaatgcatccagagacgggagctcatgactcacagtgacttctacctgctgctctgtcctctggagccacacagtacaagttgaattcatcttttcatgtgacagtttaaaaagtttcaagacagctgtcagctgccacctgtgactgcccctaaacatcccattctctgtgatccaacgagacagcaggaaaagcaggcatctgcggacagaggatggcttctgacatcccatggggcaagaccccccaactcttccctgtttggcttactcccagggaaggagcagctcttgaactgtgcatggtctccagccatgactccagccatgaacccaaccatgatcccagctggcctgcacaggaatagggtagagacaattctccaaatgtagcctagacacctgactctgacttacaccacccattaaatcccctgtcttttctgcactttgtattgattagattattctggtttttttttttttttggagggggcagtggtttggaccatggtatagaactttagatttattccttaaaatttctttttactatataatgtaacaaacacacaaaagagtgtatgaaaagatatgttcattttcaaggataatataaatataaatataaatataatataaatattatatgttatatttctgaggttaggaaatagagcagtactcacccatccttcctcaaagtcccgtttgcaccctttcctaatcacatgcctggcttccccccagctctcctgaattttgtgataatcatctgcttcttcttcatatcttttatctctgatgtgtatttctataaataatacactgtttagttcaacctgtttttgtttgtttgtttgttttagagacagggtctttctctcttgcccaggctggagtgcagtggtgcaatcacagctcactgcagtctcaagcttctaggctcaagtgatcctcctaccttggcctcccagagtgttaggattacaggtgtgagccaccaccgattcttcctattttgaaactcattcatggaatcttattgtaatgttttttctatgacttgctactttcagtcaatattatgttttgatgaattttctctgtcaaagacatctagttggaatctgcctattgagttatttatggttctcattatttccttgaacataattccttttacaaatatatgtacatgtttgtaaatattccttctatattgtcaccccccaaaatttggaagaatgggataggtctcagaatagtgccttcagcaaacatcccttctgactgaggttaatccattacttagcactctttgggcacacttaaccagttttttgtttggttttgttttgagaaggagtctcgccctgtcgccagggctggagtgcaatggtgcgatcttggctcacggcaacctctgcctcccgggttcaaacggttctcctgcctcagcctctcaagtagctgggattacaggcacctgccaccacaccaagctaatttttgtatttttagtagcgacagaattcatgttggccaggctgatctcgaactcccgaccttgtgatctgcccgcctcggcctcccaaagggctgggattacaggcttgagccactgtgcccggccacacttgaccagttttaatcctcctgattttactttaatctggactatattctcctacttgctcacatggttgtcaaaaaacaaccttgctttagagccagataaaatatatttatggcgtcttcctgatctaccagtctagcaaccctgccaaaaataaaaaataaaaaaggaatgaggctttgagaacttgtattgactcctagtaattgctgtactattttctaaataacataaagcagccctttggtttctataattttgcctgtgattgatggcaagtcatcaagccgagagttgtgggaattcactgttgacctctggaaaataagaactaccctttccaggccaggtgcagtggcttgcgcctataatcccagcacttcgagaggctgaggcgggtggatcacttgaggctatgtgttcgagaccagcctggccaacgtggtgaaaccctgtctctactaaaaatacaaaaattagctcggcatggtggcacgtgcctgtactcccagctactcgggaggctgaggtcggagactcgtttgaacctaggaggcagaggttgcagtgagctgagatcgcaccgttgcactcccgcctgggtgacagagcgagactctgtctctgaaacaaacaacaaaaagaactgcactttttgatacctagtcttgctttccatggttgctcaaagttcacaaataacacttgagaaatctccactgacaagttttcagtacctggggtgtccgtcatctgggccaggaagctaggagttggagaggacaagaggtatttttagtacagagaagggatcgactgggacaaagctcttaatgattggcttccagaacgtggtagatgaagtaatttgtaagaaatcagcagtcggagtgagattaagactctaaggatgaaggggaaagattgagacagtcagtgcgtgacgaaaagctcactcttacaagaaatgaatcagaaggttgccaaaaggaagtggtagagttagaacaattttgtagtcggtccatttagcatggaatgataactttctccacctgcc

SEQ ID NO: 1289 - DNA, 3598 bp, Homo sapiens
aagtgcacggaggagttctgggggccaggcggccgccgcgagtctggtatcctgagcttcgtgagttgagcgctgctgctccgcggtggagtcaccgcaccgctcccgggatcatggtgttctacttcaccagcagcagcgttaattcatctgcctacactatttacatgggaaaagataaatatgaaaatgaagatctgatcaagcatggctggcctgaagatatctgggagagaatatagaagacatcccaaaggaagtgctgatggactgtgcccaccttgtgaaggccaatagcattcaaggctgcaagatgaacaacgttaatgtggtatatacgccgtggtctaacctgaagaaaacagctgacatggatgtggggcagataggctttcacaggcagaaggatgtaaaaattgtgacagtggagaagaaagtaaatgagatcctgaaccgattagaaaagaccaaagtcgagcggttcccagacctagcagcagagaaagaatgcagagatcgtgaagagaggaatgagaaaaaagcccaaattcaggaaatgaaaaagagagaaaaagaagaaatgaagaagaagagggaaatggatgaacttaggagctattcatcactaatgaaagttgaaaatatgtcttcaaatcaggatggcaatgattcagatgaattcatgtaaaaggagaaaaggagaaaaggacctttgaaagatgtgaatgtagagacaattgcagaccttttggtttcatctgtgttctgaagtataaaatacaaccaaaattctaccttcatcctacccagaaattattgattttcaagttttaaaaaaattgtaccttttttgctgacagaaaaggatcagatatgtataaaatagttgaacttgacagcatataacttaaagtgaaaatgtttttgccagaacatgtcttggtaccttgtgaaagcaggctgcccttgttcttgagatagactttaaaatgaaccagctctgaaaagtacttctgctgctctggtctatccctgaaaacagatgtcttgaaacacttttcatattcttaaaataatcttcacttctgttaagaagaacatgttggtgggtaattatgcgaatgtttccctgtccctgatttctcgattaggcgtatgggttttgaaaaagagatttttcagaagattgtcagcttcagtattcacgttccatcgtgtcatctgggtctgttagtgtagtgaccctcagtgcagtctgtcccagcgtttatgtccttgcttcctctgagcagaggcctccatcttagtatcaacatatttaaagaaattgatggtgttcatcaagctggggcctgtggcagttgttgcctgagcaccaagtaacccaagccacctatgtgacaacttctgggcccaggagtaatttctcagcattgagggtaaaataggatggagtgctctgttgatcatttgggagatgtaggttacctgatttgtgccttaggatgcagcgtgaagcagaagtccatattgcaattatgattttagaaggaactaagcattttactcacacccacagcagcaagaatgacctcctgcagcagatattccacctgtaatagcactttggaactgtgggcaaaaccaaaaggctagtgtttccatttattccatgttggtgtatggggttgaactggaaaattccctgaggcaaaactcactggccaaattttgagagggtatagaaaatgactttagagatgagtggttttgtgtatgtgtctgatgatattcagtctgatgttccgcaattttaaaagttataataaaataccatttttttaatctggaaggacattgatatatgaattcttagaatttgctattaaaaagggtagcccccattccacaagctggttttgagggtgatcttgctctaaaaaacctcattcatcataggctcagtctgacaggttctgtacggggctatcatctttctcctcctctgctaaatgcctctttcttccagctgctcactgggtcaaagggatgtcctttctcagatgtattcttgatacatctcagatgtattcgtagctgtgctccttccatacttccaaggagtccggcttctacagaattcctctgtacctcacactgcaacacatgtagatagcgcttttgaaaaatacatatatttttactatagtatgagaggtcctggggctcaaactttaaacatttcctaactcagcttacactggtttaaaatgtccaggtctctgctgaattctcttgttgaattcatagctctccaacctcctctgtgttgattcctatgcccctaaccctgcagcctctttgttttatttttttccccatctctgttggtcccagggaaagcaaggaaattttcttttgaggacttataggttgattgcccacaggtcaaactgttggcattgaactcctctcatttcttgccattggattgtttcctaaacgttggataggagaattcgaaattgttgctatttttatgagctgtgcccttgatcaaatctgtgctgtgggtctgagtcactttgccaatgtcgtcttcagtttcaacactctgatcagcatgcaggcgaggggcatgtttaatttacttcactaactgctatattctatagctttagacttcatatttcttatccacctttgtctaggctcacgatctttgggcaagggagctttgtcaccgtggttgggctagaacaaatattgagaagtttaccaacacagatgttgagaagtttattgaaaggcactgacattagcagaataagtgatggacattagttgaaccccttcagtgtctatgtgttttattgtattgtctttaactcgttcttgaagcacagatttcagcgagcctttcagctattcagtgccagcggttttccccactcaggaaagatggtgtgagccatacacacagcaggattagacggggagagtttcagctgcagcttctagtttaagaccaaagcccttcctcccgctgctgcatctgtctgagaggggaagctcttgttttccaagctggaaccgtttatgaggaaaactgagcagggtggcaaaatggaaaaggaacaattttctagtttttcctacgcgtgatattgacgcgtgctttttctttgatttgaggtacagcatgtaaataacaaatttccatattcaaaatgatcatattagagtgactgagtgaccttttgattttgaagcagactaaaatctgaccagaccacaatgaaaagtataaaattagaaacttaaattccaagctaaatttcagctttgacccacctaactccagtgaataggtggcagctcagaaacaaggacagcactgctgctgccagagcaagctcacatccagctggcacttcgtgagagctccttcctgccgggcacgtgtgagttcagcgtgggcaagagacttttatgcacattctgtcattcaaaagggaaatgatgccaaccccagatgcagcatgtcctgaatgaatgatctgtaaaatacaataataaaagcttatagtttgagtag

SEQ ID NO: 1290 - protein, 155 aa, Homo sapiens
RYLGENIEDIPKEVLMDCAHLVKANSIQGCKMNNVNVVYTPWSNLKKTADMDVGQIGFHRQKDVKIVTVEKKVNEILNRLEKTKVERFPDLAAEKECRDREERNEKKAQIQEMKKREKEEMKKKREMDELRSYSSLMKVENMSSNQDGNDSDEFM

SEQ ID NO: 1291 - DNA, 50013 bp, Mus musculus
  misc_feature (1)...(50013): n = A,T,C or G
agcttatgtcaagttgacataaaaccagccagcacccctcccaggatgctggagtcacaggcctgtgctgctgaccgccagatctctccatgttccagcttggagtcgtagtttctcagagtcagaggagaacatgtattcttctctgggccagactgaccagcctgcagctccaggcaccccgagaaacattgctctggctggctgcctttggactccacaaggagatgcctgagtttaggcatccttagactgctgaggcccagcaagtgaccatcccagctccttccaaggtccctgctgctagacgagcatcgacacactctagaagttgatggttgttcattttctgtcctgtcgggctaccctggcaggcaggacgcagcccttggccaccaaagccaataaatgaatcagtaggcagaatcatgaacaaaatctcacatttaggagtaaacttttaaagtggggcatggggggtcatgcctgtaacctctgtactcaggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttttcagcagtcacctaaccctacaagagaaaggaaagcccaccatggaaggaaagtcaaacagaaacccagacttcccatggcatggtaagtcggagtgctccccagtgctctgattgtgattctgccctagagagctctccttggctatgaaaattcagtgttatagcctactccatgttcaaggcctccatctgtcttttgctttctttagtagtggaaggacacctggacacccagggtagagcatcagcccctgagtatcaggggaaaaaatttaggtattgtttggggttatcatgagtagcaccaacatggcatttaatgacactgtcacacgtcttgtgataattgtctcttcccctctttcctttctttgtacttggaattggatctagggctctgtgcaagacaggcaaagaccaccactgagctacaccctcacctggcatccctttcatgtctctgatgatgagcacagtaaagcactttggctcaggggttaggtatcttcatggtatctttgacacttgatccacgtcttttaaaccaaagatgttatcactgtttgtctttactggctgtcttctatttgtggcaggaggcaattttccgtttaccaactttaaatgtttccactaaattaacgtgccaacattgagtccagggctagcgacatggctccatagtaagagtgcttgctatgaatgcatgtggacctgagttcaaatccctagcacccatgtaaaaaagccaggcatggctggcccccatgtgcctgtaaccccagcactggtgggtgggagagagagattctgggagctcactggccaacaagccaagccaaaatggggcccttccagttctctgagagacctttctcaaggcagtaaaacaaggaaagaccggggaagaaacctggtgccgtgttttggcttctgaatgtatgtgcaccgcaatatctgtacacctacatacatgaaccatacattacacacacacacacaccccacacacataagcataaacagtgagtctatttaaaacccaagtaagaacccagacaacactgagagggtaaagatgaaggctacagagctgcctagcaaccagggtcctggagagagcaagacaggatacagatgtccattgacttggacaaggttatctgccttctcagcaacaattctgggcaagagcccaattctctcagcgctctgctctctaagcccttatcactcagctttgctcctcctgctgacagccacactgttttgtcccacaagaggaatgccttggctttctccaagtcagtttctgatctcttgggtctggacagaggtggagaatctgcatccccagcaagcccaagttgatggtgatggggctggtccagggcccacatctgcacagtgctatttcatactaacaaggcttccccactggcccatgtgtgggatgcaccatttggcttcccaggggccctccctgcctgctaactgactaaggctcacagcagcccctcattaagagatggcagcttcagccctgatccctgacccaggtacatttttcattttcaagccaagatgctcatgatgcaatgtctgtctttctgtctgtctgtctcactggttctactgtctgcctgaaaaacggggctcatcatatagggcaggccagccttgaatgggcactcttccttctgcctgcaaagagtggatttaacatctagttcctcacccctagaacactggaaagtcgcaaatttatcgttatagatgtgttaaaatgtgattcttatgtcttacagagctggatgagtaaaatcgtacacacaactgtgttgcaatctataacaaaagaatacatacagagccgggcgtggtggcgcaagcctttgatcccagcactttgggaggcagaggcaggtggatttctgagttcgaggccagcctggtctacagagtgagttccaggacagccagggctatacagagaaaccatgtctcgaaaaaccaaaaaaaaaaaaagaaacaataacaacaaaaaaaagaatacatacagttgcatatgtaacagtacttgggaaacactgatatttgagcctcatgtcttcaatcccagcacgtgggaggaagaggcaggcaaatctctgtgagttccaggacagccagggctacacagagaaatcctgtcttacaaaacaaaacaaaacacaagcaaacactgacattcaattcacattnnnnnnnnnnnnnnnnnnnngtttatatttcactagtctcaaatctgttatattatttatctataatcttgggtttaaacatacttgcaaggtcctgatggctcaggaggtagaggcacctaaccccagtcctgatttcctgagttctatcccagggacccacgtggtggaaggagaggagactcctgataactgtcttcagacatccatgcacaaaataaaacgaaacttgtaattaaaaacttaaaacatacgagcaagctggcagcaatactttctctgaaagggcctctgagccgtgtcacctgagtgctggtaccaaagtaaagtgtttgttaaagacacctccactttgaatgcatctgcaagtttgtatgtgtctatctggactggaaagcaaaaccatcattggtgtattcccggagtgggtcaggaagatgtggcatgcagacgacacccacagttggtcacagctgtggaagtgttaccgagctcctcatgcaaaccacttccgttctctctccccaaagctctgcctttcacctcacgttactatggttaccttaggctttcccccatgggagggccctgtccctcctgagcacaggatactttgactgaagaagaaagcattcccaggttgtgtctcctgcagaggtgccaagtccaaatcctgtcttatctgcatgtagtgggcacatgaaaatactggctggagggactagaacatgtgtgaaaatactggctgtaaggactgaagagacggctccgtggttaagagcttgttactctcacagaagacctcagccatttgcaactctactggctccttagacagcaagcatgagagtgacacaatacatacataaatgcatatgcacgtacaaacatacatccacacatattcatacatgcaaaccctcatacactttgaataaacataaatcctttttttaaatgttgatgggggggggcagggagcactttctgctctcccagaggacctaagttcagatcttagcaccttcattaggcagctcacaactgcttgcaactacagctccagaagacccaatgtcttctaggctctgagggcacctgtgcacatacgatgcatacacacacacaacgtatgtatgtatatagatagatagatagatggggaggggagagaaagagtatgtgtgtgtgttagtcagggtttgtattcctgcacaaacatcatgaccaagaagcaagttggggaggaaagggtttattcagcttccacattgatgttcatcaccaaaggaagtcaggactggaactcaagcaggtcaggaagcaggagctgatgcagaggccatggagggatgttacttactggcttgcttcccttggcttgctcagcttgctttcttataacccagaactaccagcccagggatggcaccacccacaatgggctgggccctccccccttgatcactaactgagaaaatgccttacagctggatctcatggaggcatttcctcaagagaggctcctttctctgataattccagcttgtatcaaaaccagcatagatatgtagttttttaaaagaaagagttcctctgtgtagctctggctgtcctggaactcactctgtagagcaggctcgctcagactcacagactcaccttcctctgccacctgagcgctgggatcaaacgtgtggaccaccgctaaggcctagccacataatacataatacataaataaataataaaaaattttaatgttgagtgtagagctaggtatagaggtatacatctgtaattccaacacttggaaggtaagcaggaagatcagaagttcaaagccagcctgggctacatgggacccctctcaggagaccaaaacagaggtgacagaggggagtgaatggcggtagggagaaggggtggaaagggagcagttggggactctgtctcaagtaaacaaacaagaagccattgcccctagcagctgccatctcaagaccctaaaatgaggacccctgtgaggcttaggctcagccccctgtggggctggggtggaggtgggttgtcacattctgaacggcaggatctcacctgttaggatcctgctgggacagaagctgtgcccactccatcttagcaatgcagcaaaacgctgggcttttaagacaacctggagccaactagccacggggcctccaggggtgtcaagggacagtttccaggtccacacacacgagtcaactcccgtgggggcaaagtggctgccttggattatgaccagaggagagggacttccctttgcttatactaccttagatcaggtgcctgccccgacagtgtgaataaccttttcacagacacacactcaaattactactactcattcacccacacaaactcactcacaaatacatctcctccacatgccctgctagtctctctttcacacatttccactgctttatgtgtgcgcgggcacgggcacacacacacacacacaccgaaacatactcaaattccaataaccctaaccgctggctctgtgtggcagtgtgatgcacccaaggattcctcctgtcagctctgggtgcagaaataaagattggaggttctgggagaagagactatgtaggtgggtcttaagtaaccctgtgacctaattagtcacaaggggacttacagtcacactcagacctatgcctcacttctttttgtttggtttttttgagacagggcttctctatgtagccttgactgtcctggaactcactctgtagaccaggctggccttgaactcaagagatcctcctgcctctgcctcccaagtgctgggattaaaggtgtgcgccaccatccaggggaaagcagatggttacactgaatcacactgtatgcgtagtttagacgcagagagccatgcttagccatcctgagaatggtgaaaagccctcccaagtccaagtttccatgtgctgatctagagccacccttggagctggctctcctaagcctggcagccaggcacactgcatagacatacgtctgcccagaaacaaggattggcagcatcaaaagaaactggcgctcacttctacattaccgactgatccatgtcatttcagtcccaaggctggatgtaggggtgagctcacacgtaggccggatacaacaggtttgtatcagagccaaggagcctctgaggttaggaatgccttgccttttacaatagaccctgagcatagctggtagagctgtgtctctaagacaccattatttatctgattttcagcagctggcgattgggaagcagaggcaggagaattgctacaagttgaggtatctctatctctatctgtctgctgggtggtggtggtggtagcagtgtacacctttaatcccagagctctgggggcagaggcaggtgtagctctgagtttgaggtcagcctgagctaaagagcaagttccaggccgcccagggctatacagtgagcccctgtcaaaaaacaataggtgtctattggtagatagatggatgaatttttttctttagcaaaaataaaatctggtctgcaatctcgaggacgaaagttatcttttaaggtcgtcagctgcagcactcttgagaagataacagatcagaacaaaatgctacatggtctgctcagatatgcagaaatggaagatacacattgcaaggttggagaggcagctaggagcagggatgggatgtagctggaagcagggaataccacagggaaccaaagggtgaagtcggtcactcaatgataacagtatctatttgcactggttctttggctctgcgatgttctaatgcctcatcaacttgagccccgccttcccccagtgacagacagcctaggaacctgtgacctggggctgcttttcatagttttacatttcttgagttctgttcaatccaagaactgtcatcaagagacccgggtaagttgctagtgtgtgcttagcatgcacgaaggaagccctgactccatccccagcacctcacagatgggagggggaggatcgtcaggatttcgaggtcattttgaggccactatgtgagaccttacaaatcaagcaaagaaagcccttgtcgacaaagagcaaacctcacgagaaaccctgcaacggctgcagatgcttccttctctttttgcaaagatggcagtgagcccgcccagactcattgcagaagacggcctggggctttagaatcaaacgcattctctcagcttttggaggcttcttgttgaatatgtttttttctaataaccaacattctgtaccatttcctccacaagaagaaagaggaaacggtgggtggtggtgacagcaatctggcctcgcttacgttcagtccacagagaggatggaagtggtgatgacccactgagcagcttccagtgtgacaagcactgggtgtcatgtatccgttttgctgcaaatacattttttttttaagagagggtcttgctgcgtagcccgggctagcttcaaaagcaccatcttcccatgtgctaggattataggcatgtaccgctccccaacaaataatatttataaaactccttgggccagagggtgaaacaagtcagtggataaaggtgcttgctgatccacaggatccaaatagtggaaagatagaaccatctcctgtaaactgttctccaacctccacacctgagctgtagtctacgtacgtacatgcatgctggcaaaccattcaaacacataaaatgaaaataagtttaaagacttttgaaaattctaatacacagtttttgaggcaggaaagatagaaaggaaaattctaagggacataggaggcaaggaaactctcacctaggttagtttgaatttttcacagagagaagtgtgtcataactgaccaaatcatttttgtttgtagatttatttctgtggattcaaggccagccagggatacacagtaagcccctgtctcaagaagagtagaaggagacagaggaggggaggaaggagtaggaggaagaagaggaggaaaaaggaggaaggaagaggagaaggaagagggggcctagaaactgtattccttttaaaagagattcattaaataactacattaagccaggcatggtggtacatcccttaaaccccaggactcaagaggtagaggcagccatatttccaagagttctagggccagcctggtctacatagtgagttccaggccagacatggctacatagtaagagcgtgtctcaaacaaaaacaccagggctgttaaaacaatgtaagagctgaggctctgcctcactggatattgtgtctgcctattacacacaaagccttggggggcataactgggtgtggtggtgcacacctgtgatcccagcattgaagagactgaggcaggaggatcagaagttcaagatcacccttggctacacaggcacttccacctttccgcaaaccaccaccactgccagactatgtttccctaaggacagaatacctgtgagcctttggggttctctgaacctgcacactcctctcacccctaaaccggggcaacacaaccatggcaggaaactaagagagccagttcctaattttgtacttaatttttgtttgtttgttttgagacagggtttctctgtatagccctggctgtcctggaactcactctgtagaccaggctggcctcagactcagaaatccgcctgtctctgcctcccaagtgctgggattaaaggcgtgcgccaccacccacctggctttaacctttgattgatctctgcattttgtggcaagttgcatcctttgagctatgaaatttcagaagccacaaaatcagatgcagaactactgttaagacacctacgtgtgactctctcccttgaaagagccattgacaagttgagggtgtttagtgtcataaagctgaaggcacagtaagtcacttcttaggcctgcaaccacctaggatcccaggagcattggagtcccagaggacacagcactcccctaagtgagggtgaaaaggcagaaaagatggtcatctgagactatctggtcactttaagcagtgtgggcttcagaatggccaccttgcaggactggtgtagacacagaaatgaaggaggccatacttatcccaggactgctcacttatgcataccatttgcccctgttgttcctctgggcctacagctcatgttagtaccccaaaggcagactagggggtcactgaaccccttatttgttctcttcccaatatgatcaccctcccctttctctgtctgcactaatctctgtagctggtacaatgggatgagtggctactctaagcttgttggagacactgtagccctagcttctgcccaaaatacatctggatacagggtggagaggcgctcagtggctaagaatgcttgctgttctttgagtaagcacaggatggattcccagaaccccagcagctcacaaccatatcaactccagtcccaggaagatagaacaccctcttcaggcctcgacaggcatctgcagttaggtagcgcacaagcaggcccacccaccacgtcttttttttttttttttttttaattttatgtatttgagtacactgtagctgtcttcaaacacaccagaagagggcatcagatatcattatagatggttgtgagccaccatgtggttgctgggaatggaactcagaacttctgaagagcagtcagtgatcttaaccactgagccatccctctagcacccacaacgtcttttcttttctaagtctggatttaaaatacatgagaggtagctgagaagacagattccggccatctcctccttagacttacagcactactggtctgcaaaaatgccagagacgcagacctcgggacaaccccgacaaatgttctcccgtcctccctcaggcccaagcttacggaaccacagtggaaaaaacagggaccgcccacgaccggaagtggacgcactccaagggtgctccagcacgtcgccctgaaaccacgcccaactcccggacaagattttcaagacaattggtgtggaccaaggcctcgcgcggcgaccccgcccctttcgcggcgcgctggttgtgtgcgtcatcaaggagcgccggaagtaggtagggtttcgccagagaccccggaagcgacggcttctcgtctttgctaaggcttctggtttttgctacggtttctgatttcggctttgggatgggttgcgacggaggcaccatccccaagaggcacgagctggtgaaggggccgaagaaggtcgagaaggtcagtggggactgcgggctgcggggctcgggatgaacggtggtcacagcgcttgtggagggtttactgtttgcaggcactgaacagtacggttagactgggattctccccacagacgctgtgttgatttgtaaacattaacgttgaacgggacggagactggagagctagttagtggcctagccaggactgggacgtatctgtagctagcgacgattacggtgatagatgctatttatggactttgtttttgtgaaaggctctcactgtgtggccctggctggctgggactcccacctctgcctgctgagcactgggattaaaggtgttggccaacaagccttggtatttgaataatactttttttaatgttttgtgtgtgtgtgtggtatccaaggaggccagaagaaagcatcggacccccgggagctggagctacaggtttttgtgagccattaatcttggctgttagaaccaaattcggatcctttggaagagcagtacacaggcttaaccacggagccatctctccagcctgaactttgtgtattaaagtctccccaaaccattcccccttgtgaagtcacacccttcttaaactatatcagctcttagcactctgaattggtggttgagcccagctgatggtcacgtgactgcaagctcctcctggtgaactctgtgcactgtttttcttccagaactagcacagtttctgccacagtgaatatttttgaataaatgcgtgggcattctgtaaatcttacaagacattgagcaaagtgtgtacttaatggatgggaaattgaatgccgcaaagttagttaacaccactgacgtggcctagagtcatgaaccactgtccccatccatttatgtgcatttcaaagctagtgttgatgatgactgtttaataatagaaggcacagaatgcccccgatacagttcccagcacggggagagaatgcccccgatacagttcccagcacggggaggatcatgtttcctgatccaacattcagagaactttgggatgggaggtgaatcccatccagtgttgtacttaagacactgcataacttcctgacacatccctaataaactccattgggtcctgtgtgaacaaacctctgcttgtctttttgccctctcttctgcccctctttagctctttcactcttttctagataccatagaccttgccccagcgtcctgaacattcctcactcatagtgacatcatgacttgggggggaggggccacttgaagcaaggtcttgctgtgaggtagcccaggcttgccccagcccccggagtgctggttacagtgtgtgctgcttggctctttcccctcatttgtccacccagccttcaccacagtcagctgcagtcactctttaggcccgccccctctgctgctttccttttttttttttttctatgatccctgcctctgtggttatcgactatgtatctctctctcccatgtgctctgggatccttgcatgtcttagctctgcagtctataagatgtttctgcacattatagacatccactgagcatatgttgaaagtctgaggacagagtgccctcggaccaggccaacatgtcacattcaagtgtgcataaagtattcatcttactgttgttgtcttgtgcccagggctgacatggagtaatggaagagttggcaaaaaacagccaaccacacccaaacaattaaaaacaaacaacaaacaaaaaaccctgatcttagaagggtaacgaaaagaaagaatgatcaggaagagtagtttttattaacccatttgtccaagtacttataaaatgcttgttatatatacaattctgggccctaatggcaaattatcccttctagagcttccatttgaaatgcctgttatgaagtaatcatatagatatggggtagggatctgcccctgtcttggcaacacagcccctaagtcccatggaaataacacttgccctaagtgagatgtgtggtgacttttttttttttttttttttttttgaaatacagtgtcactttgtagtcctggctggtctggaactctctgtagatcaggctaggctccaaccaatggagatccatctacctttgcctcacatgctgggattagaggcgtgcacgaccacatccagctcgtggggactagataaactcctggttggggaccagtcaccagaaagacaaaatcgtgatcagaagttgacacttgtttttctatttttgctctttctctctttctttctttctttctttctttctttctttctttctttcttcatttatttatatatacatgagtttatttgcaccatgtgtatgcaggaacctgaatatatatagagagtgccctgaaactggaattgtgagctacctaacactgtgagcttcctagcatgattattggtagcccaaaactggatcctctgctagagcagtgagtgctctcaaacactgagccgtttctccagccctgaagcttggcacatttataccccctccatattgcaggaagatgttgtatcaggtgttgccaggaagaagttatgttgtgtaagatgttaatttactatataagtataggcattaatgttggtactaggattgagatagatcaggatgaggacctcttggtgtgtgcagagttcactccccgccctccctctattctgtttttataaagcttgcacacacggtttaaagatggatatgaacttgccttgtgtgtgttgggtgttggtggatcttaacataatactaatttaaacccttttaaaatgtgtgttatgtgctgcgaatgtgggggtcagagaccagcttttggaggctggttctttccaccgtggtttccaacggtcagattgaacttgttttgttttttcacctctgagccatctcacctgctctaatttcttaaaacttcttaaagtcccaagttcatatgccactattctatttacttattatcaacttacttattaggctggagattgagccccatgtatgctaggctgatgtcctgccctggagccacgttctccacatcccggccattgacatggttgcttttatagtttttaaaatacattaatttatttagttgggaggatgtatggcaaacatgtggaggtcagaggatagtttgcaagagtcagttctctccttcaccttttacctagggacaaactcagatcttttgttgttcttcttattattattgttcggattttttcgagagacaaggtttctctgtgtagccctggctgtcctggaactcactttgtagaccaggctggcctcgaactcagaaatctgcttgcatctgtctcccaagtgctgggattaaaggcgtgagccaccaggtcattcaacatagaggcaaacaccagtgcctgctgggtgatcaccggttccattgttttagaagtagcatcttgttgggttatctaggctggcctcagactttatcctcctgcctcagactctcaaatactgtgattatggtcactactgctactggatgtgggtcattattctgattttaaaattaaacaccacagtatgcgtattagttggaatgttggaatggaggggatgtccatggcttaggcatctggggggagtgtccatggcttaggcgtctggggggagtgtccatggcttaggcgtctggggggagtgtccatggcttaggcgtctggggggagtgtccatggcttaggcatctggagggagtgtccatggcggcaggtggcagagaggcagctgactgatccattttcatccccaggcaggagaagtagggagaggttataaacctcccaagcccccctcaggcctgtgcttcctcccacaaggctccacctccgaggtttcataaactcctcaaacaccacccctggggaccccgtgttcacttggatggggagttaggtacatcttacaggtgaccggactggagtgactgtgtgtgctctctttgttaggttgacaaagacgctgaactggtagcccagtggaactactgtaccctaagtcaggaaatcctgaggcgcccaatagttgcctgtgagcttggcaggtatggacccttcgtgtaaccgagattcatttgttctgttggttttgaagaaaatactgaagtacttgattgataggagctgtcctaagcacactagtggggaaggtgagctcgtgtctggacatagcctggaccttctatctcagtttgttttatactcaggagccagtagtaaatgctgagatataagccccagagcataaagcagccatgagtgctgtcaagagcaggaggcagttgggagtggagcgggcatgacatgtgggggggggagggggagcgggctgctactcagttccagctggtatttagagtgaagaatgtgggcctagtggttctaaatcttctgatctttactttttgaaggacagggagagatagataagtgcttgcatgttgattctccaagtcttaaagtccaccatcctggctttaagccgctgctttgtgtgttcgggcagcaagtgaagcagtgcagaatgtttttagcaaaggcaggcacctttggggacacggtcaggtcttcccctgtttggtcatctagaatcatcactgcagtagtaaactcaccttcctcttgtagactgtataacaaagacgcggtcatcgagtttctgttggacaaatctgctgagaaggccctggggaaggcggcatcgcacatcagaagcatcaaggtaggacactggtgtggctgcgctccagacacctctcagggaggttgctttcataggatctgtgtcttattagttagggtatcattgctgtgaacagacaccacaaccaaggcagctcttataaggacagcatttaactggggctggctgacaggttcagaggttcagtccattatcatcaaggtgggaacatggcagcatccaggcaggcatagtgcaggaggagctgagagttctacatcttcatccaaaatcaaacaagagaatactggcttccaggcagctagtacaggggtattaaagcctatgcccacagtgtcatacctactccaacaaggccacacctactgcaacaatggcacacctccgaatagtgccactcccatgctaggcatatttatacaatctgtatacattagggactgaactcagcactggcaagatggctcagtgggtgaagcacctgtaaccggggttccctggggctcacgtggtgcaaggaaagaaacggctcagcagcttgttttctgaccgccttggagcactccaatgtatttactaaagccaacacagaaagctctgttttaaaaacagcgttcaggggctgtggtgattgattattgggtaaaaggcttgacagacgagcacggggacttgaattcagatctccagcaccgaggtataaagctgtgtgtgtgcctgtgcctataatctcagcactggggacctggagacggcagagcctctgcggctcactgggcaggcagccgtgctgaagtgttgagctgaggttcacgtagactttcttagtgaggaagccgcagagagggagaggacacctgagctgactgcagtggctctgccaggagcacgtgctggagaggtggaggcaggaggatcacaccggacattgacctggccagagcctcgggcacatacagaggagcacatagacattcatgcaccacccccccccacacacacacacatgtacacaaatacatgtgataagatcctatgctgaatgctggaatggtctctatcttcgattgggtcagcttacagttccttcccttctggtgctgctgaaatgatgggcgttccatagaagtgagccgccctctcaggccagcgtgctgtgctgctgacctgtagagctctgtggtcaggtccctgcgcttatttcacgtcagcattattaatgcttccccacagaatgtgacagagctcaggctttctgacaaccccgcctgggaaggagataaagggaacaccaagggcgacaagcatgatgacctccagagagcgcggttcatctgccctgtggtgggcctggagatgaatggccggcacaggtgagggtgacatggctgatatgaccccagtctcgcctcatttctctgtgttgtcttggagatgtagtagggccttgtgggaaatgggaccgggcatggtgggctctttccccagtggccatctgtgcacttaactgcctaccctgcttagctcactcaggagagtggccctgctctgccctgtgccctgctctgcacgatggttgggtactgtatgcacactggtcataatgccggccagctcaagcttgctctcccttggtccctctccaggttttgcttcctccgatgctgcggttgtgtgttttctgaacgcgccttgaaggagataaaagctgaagtgtgtcacacggtgagtttccaccacactccatgtgttccttcttggcagctgagggagtcactttaacatctttccttctatttaaatcctaaagttgttctgaaagcagtcagtaggtcctctcttcttccatagcgcttcaccgctccaggtacatactcaaacacattgaggtcatccctagtcacactcttgaggaccgagttctttctactccaaactggcagcctgaaggccctgctctcctcagcttcacgtgctccttccttgtctctgttggggaccttgttacccatcccatctcattgtcacaaaattgtggcatttagtgaggtgtttgtacagaagccatggctaagtaactattcagtgagtgtgagtgtgcttagacctgtcctgggtgatgccctctgctggtggctttagtgagcagttgtcatggcagctcctgtcctagcccttactgctgggatgtcctgaaggaaaagatccaccagagctctgctcttgtcgatgccccttgcactggagagaccgcacagaagtattgatcacggtggcctgcttagaagggagatcacaaggatgtatagttgagggggaacgtcgacctttgcagtgggcagcaaaggcatcttgaagcttcttgaagctttgacttcagagctggagggcacaaggcactggcaaaggctgggcaagagcagggtacagcagcagaagggtcaggggaccccaattccaggagcagccggcatggccggggtgaggaggcacaggcgtagttgtagatagtcatctcacatcgagggctgggctgaccacttggtgttcatggattttagtctaaggtggctccagatgctcttcacattaaagcacaccctccacttgtagcattcatgaagctaatggatggtgacgtcagtatgggatactgactagtcttcacagcatgtgcaaatgtcatgtcactttcttttttgaaagtggtacccttgggaggtaaccttgatgcagtgaggtttgaatgagtggagaaggccccgccctgcgtcgggtgcttcccgcttagacttcagcagtggggcaggccctgtttcatctgcaagactgcaagagtcagagtgtcaccgaacacagaacagccacgacgcgcgggcagggatcttctggccactcatttatccctcccgtcttaggctgcctgacagacactgtctactgttacctggcagttttatagagaagagaaattcacttcacagttggtgaggctgggaaaccctagcaaggtgccagtgactgcaagggtgcattagtccatgtcataatgtggaggacgttagcatggggtggggtggtgattgtgagggcagggagtgacgtgtcacaagcaagcacagattcaaatgttcctgagcatcgggtttgcgcagtgctcttcctgctgacagattctcctgtctgtggagtgcccctccccacctgtctctcagccaggacctctccccccactgaccctgccagatcctctctctgaagtgtggttatgctccatgagcagaaagaacttgtcctttataaggaatacacctgtgacattaattaatgtcattaacattaattacttcatgagactgtgtgacctaaatgcctgcctgacaccaggctctgcacactgctacactggggactgactttgcagcccaggaactttgaggaacatatccccgtggtatgtccatatagcacctctctggacccagagtccggtacgtgaagtgaaggagttactatgactcttcagagcccttctttttacatccaaaagttctaaacagggacatttttaagttgggaaataaatagtcctattgctatgaggaaccagactctgacttgcagtgtgaagtgtctgaagtttgttagtaagagcattgatagaaggttggcttgctgctggaaccatcctcgggtactgggtgcccagcacaaagaagtctggctgggcagtttcttccacccatctttccttgatttgatgaaaagcagagagagcctctttggggaggttttataggtcaggcctgcaaactatacctggagcatctcacatttcgttggtcacttcaaggagcctttgaaaaggagtcaggctgggggtgtagagcgaagtggcaagtgctggtcctttctgcagcagcagccactgcagcgtagagatggcacagcatgcgccctgctgtgcctcctgaggagggaaggaggtgaagccacaggggcaagaccaaaagattgccaggttcaggctctttttgaaatttataaatcaccaataggacagtgacggctacgcctttaatcccactaatcaggaggcagaggcaggctgatctcaaagctgagttcaaagccagcctggtgttctgtggcgggaaggcagcttgttctctgcttgtcagcctgggtgcactgagatctgttccttgtctccacaagaggctctgacacactcacagacagtacacacagcaataagataattcaggctctcagaggcttaagctggctttgctcacactgtactacatggtgtgcactttgcctccagagaacagcacccatagacgtacaagtgctgcagtttggttttgcagaaaatgaattgtatttctgctctctgctctgtggcttgtaataagaaacacatcgccatgcaagggggcagggaatatcttaacattttcagtgtatagtaaggaaagtgttgcctaggcagagattacttcaatcttatatattttgcttacagttgatttgtggtgtctgcctttagcgtctcttctctctgctcagctcttccagacccctcagtacctcactgacgtgatcagctctgtgtgggggaagcctccgttggctgaggtgctaagatgtggcctttacagtgtgttggtttcttctctgggttcacttaaaaaacagctgcagggttggagaggtggcttggtggctaacagcacgggctgttcttggaaaggacctgagttcaaccccatggtgtctggcaccacatggtgtctggcaaccatttgtaactccagttccaggagtgccaatactttctgacttacatgggcatgtgatacacatatgtggtacacatacatacatgcaggcaaaacactcatatacataaaatacttgaacatgtcagtctttatgccaccaaggacattgctagagaaagagcatctatagaagtttcccagaacagcagcagcaacagtcagggacataggaaggaagggcctgcacctgaggcccaagatggtcatggccttttatgtcttcagcccatacaccagggtgttggccacttgccacatacctaactcgaaacactccgtaaaagtcatgctcttgtgtgcagaagcccctgtggaagtggcacgagcagtgcagttgtggcccccaacatggcaggaagaacagcagatggcacgccaagactacacagagttgaggcagcattcttaagaagcttgcttcctctgtgggattattcattctacccctaaatgctttcctggaattttctagaacaaagttgtactgctcttagtccatagggacagctccagagaagcatggcttcctgtgggtggggctttgctatatatgcgcctcttactcaggctctctaggccttcagaaccagacccgctgctggtgtgtcccacgtgagctggattgagcaggtggagagattcggcagctgataatgcgctgggcctccagctgttggcttgggctcctagccacagcctcgggtgttttcctcatagttctctccctgcctgtgtagtggtgaagtctggtggcacatgtctctgcatcattttttaaatcattcacatccaagaatttaaaaagcaatgctgacaagtgccttaatggtgaggttgactgttgaagtggctttgctggggaaactgccagtgtggctctggagggacctcggcctgctgtagggctctgagtcggtgccgcctctctaggcatactcccaccagcgggtctgaggagggctccagcgtggcaaagaaagctggcagccggatgagcccaggcaggtctcccaggccatacacacaagtgtcttgggcatcgtggtctgcagaaagaagcagaaatgtaaccgcctgtttccccaggcgttcagttccagtacaagtaaggcaagtacacttcctcaggtgtcagctggggggggggggcaccctcactgtgcacaagagctcaaattgagtatcgttctgaagctgtaattggtctccaagggtggattttgaatttacactggagggaatttcacctttgggctggtatttggggaacattctaaacagcatgaaccactaacgagtgctgctgcaccaggcaagggggcccgtgcctataaatcaacactttgggaagctgctaaggcaggaggattgccatgattatgaggacagagttagtatccaggcagtctgggtctaatgagccttggattctaattcctattttaattaacttatacttacatcgagttttactcagaagaactgatagagttgataactttctagaccagacctttctgatggacagcccacaggcaaggagaagcctgaaagaccatggagtggccactcacacctctaattgcagcacttgggtgaatgaggcaggaggatcatgagtttaaggccagcccggctacacagcaagaccctgtctcaaaagtagaaggaacgtggtctgtccatgaagctcagtaggtggtagggagagggttttgttagatgctgttgtagctccctgttgaattacaatgtctaccttaaaaaaaaaagttctaaccagacatggagggatatgcctttaatcccaggaggtagagacaggaagatctctgagctccaggctagcctggtctacatagtgggagcctgtctcctccctgtcaaaaaaaaaaaaaaaaaaatcaacccagtgaggtgaacacttgtggctctctgacctggcactgtcaggacagtgtgtttactcacctttgagctaccttggcctcacagttggcacccttccccgtcattaacctgtttattttaggtcagtcttttaaatggctgggaaatggggaacctggtggctctctgtgtacgtccagtttactgtcttagtttagactccatatccaggcacaccattgagcggaatacgtgtagtagctgatgcttaggaagctgcttgtggacaaatggcagcacccaagagaggtgctgtgctctgccacagtccttctgtagccagcctgtgtggcctgcgactggtaccccaacgtgagtgcacccctgcttctgtgtattctgcagagtattgagcacctattcactcattagcgttgtgcaataaagtaatggtccctctccaatcctcaagcagccatctctaaagtgagctggggggtagaggactggactttaccctccaaagaactctgtagtttgctgtaccccaagtgtttgccccagacaggttggccatcagccaggtccctctagacctttcataactggactcaaacctctggaacatcagcgagaggtgaattcgtggttcctgggggaggatccaccagagaacagaaagactcgcctgcagcaagggccgcccgagagttgcttggccgcccggtgccctgcatgagcagcacttgctggtgcacatccttagtcctagcaccccacaggcagaggcagactgctcctcgagactttacctgtgcaccccttgcgaccatctcctgcctctgttctccacttcgtggcccgaatgtgtccttcccatccagcatctggtgtggcacctggagcgtctgaggggagagaaatccagggcacactggagcatacagtagtgtacagttcccagctgttgtagtgcaagctgtgcggcctgccattgcctcccggagatgcagtcactgtgagaaagacctgtgcagtggccatcagtgtatgggctgaccaggggccatcctgcccttcactgcagtcttcgcccttttcctgcctctcagaactcactggatgtgtgtgatgtgccctcaggaccatgctgggggctctgcgctgcattcctgtctgacagccctggtaggtgatctgggaacagggcttgcagtgggcctgagagatcacagaatcctccaaagccattcctgctgggtccctgtctgcaaatgtgttatttatcaacagccgtaggtggccatgcttgaagcagcatgctgtgagggaaccagtcagcctgtctcaagaggatgacacaaactcacctaaaggaccgcaccaaccagagtcccccacaagtgctggggggttgccacagacaacatcacttttcctgtttggggtttttttttgtttttctgttttctagtcaagacctcactcagctcaggctgtactgtacagctgtcctcctgcctcagcttcacaagaactgtgatttataggatgagcccttagcaaaaatgcagatttttccaaacatttatgcccaggatttccaaaagagtctgttgaaagagacacaggttggataggcacatggcaagactgtccccctgatgccacattcctaaaacaagaggctaccccaagtggaaggccttgtgagatgcaggctctgtacgtaggtagtcacagcaagacatctaaaagagtcaaccccccgccagcttcttcactgcgtgtcacccacatggtgagttatcctacctttcagtcggttcagggtcacccagtagtgcttctccgggctttggatgtctttggaccactgcagcatgtcttttgcacggggatcagttaggacgaactctacaaacttcctcgtaagtgcatagtgagcacttccagaggaaattgttagattgtggggtgggctttgtttgaaaattgtatttggagctgtgtagctgttttcatcgggactgggctttggagggccttggcctgtcttgggtttggagtttgcgggtggggtcaccccaggcgtgatgtttttacccttccacctggttctgatgtcatagatgatttctttgttggttttgatagggaattcctgtccacagagattcatgacatagtgccattgaaatggggagtggaccaggtccctcatgcagtcaatctctgcctgcagcctcctgaggttgtcatgagccaccttctgtgtctttgatgaaagaaagatgtttccaaaacagtccacgaaggtttgcatggcactcttaaacttctttggggcattttcatcactgtggatacagtagacattctgaggtgcataaatcgctctgagaagccgcacaaacatgaccagctccctcggagcatgtataacataggccaaggagaagttcccctcttctgcagacaggggtctggttatgaagtgcagcccccgagccagcctggagcagtttccaggtgtgcgcaagcgagcaggaacttcagagttctgaggaggtttgcagaattgagcgatttggggggctgcctttttcccgtcaaataaagccgagcacagttcatctggatagaagccacattccaccacagctgggttggtgggctcagcctcagcctcagcctcagcctcagcctcctcaggacctgggtttctcaagtaaagaaagatgaaggcgcaaatcatgccacatgccaccagcccagcctttgtggtccggagctggctcatgctttgagctctcagtgtgttgtcgccaccatagcttgaaaggttttccttttagttctcctaaaggaacaacagaacatttagagtagggtgacctcctccagcccctgctgaagcacattcactgtatgttcttttttttttttttttaaagatttatttatttattatatgtaagtacactgtagccgtcttcagatactccagaagagggcatcagatttcgttacggatggttgtgagccaccatgtggttgctgggatttgaactcaggaccttcggaagagcagtcggcgctctcaaccactgagccatctcgccagccctcactgtatgttcttaagggagtcacttgggctggggatgcagagcagtgggtgcagtgcctgcctggcatgtgtgaaaccctgggtccccatgtctgtcagctctgcacatttgggtagagacaggaagagcagaagttcaaggtcattgttggctacacagtggtttccagggatcagtggatggatagataggtagatggtcagatggaaaagtgccatttgggcttctttctttctgccctttttttttttttttttttttgaggggcttttatgttgcccaagctgaccttgaacttaagggtttacacatcctcctgtctccggcgcctaagtctgtggactgcaggtgcaggaggcacatctggctaatttgaccacttttaaatgtgtttataccctgaaactaccaccacatcagggcaactttgccctacctttccttatacccctggtgactcgcctgcctttctacaccatttgtgtgatttctgtgtcctggttggtttgcatgttctgtaatgtgacatagtgacatagtagactcagacagtggattcttggtaggggtgctttttcctagttatgacagtcagcctcatcagcccagttctccgtagctcttattgctgagtgatgctctatctcatggccatgcacaatctatctgttcaactgttgatggacacgtgagtcatttttggtgtctcattgttacagggatgctgtaatcattgtgtgcaagtctttgtgtaagcatgtttttgtctgtctccagtgaatgtggggtagtgaagtggcggtctcccgtgttggatagcttcacagtgggcttctctgggtcagtagtacagcagcaggtaggagagagagttccttacactctgcactccattcccatggtaaccatcctaattgggggtgattccctgtggtgtcactgtgtgtccctgatgactccatctgctgagcacagctcatgagctgtgtattcacgcctttctctgttacactgagttggagtctttccgtaaagaacttaaatgacaagttgagagcagtctatggttacacagctaacctgctgaagtgagctgatggagctgataggttgcttttaggcattaaaatcgaggtgtgtaatgatgtctctttataccaatgtggtcagctgcctagaagcggagtaggaacttgagcaggtaccactgcggcagacagttgctgagagcacattaatgaggctactgttgtatagctaccatcattgtccttctgcactgagagaggagagctggccgagtgagaggtcaggaggtcttgctctttgtgactcctggttctgtggtgccacaagtcacattgtcatggccaatggacgtgcaggagctctttccttaagtgacatggcggttggtagagctctgaatcactcttaagactcacagccttgagagttctgcctgtctcagatggttaaataccacattgattttcagtgcagtttctgatcacctaatgtgaaatacaaagcagctgctgccccgggcgctgctcacagattcagtcaacacatgccaattgctgagagcatcaaaccttagggtctcctttattaaagagtttgtgagtttgtagggcttgcaaggtctaccttcataaacactctgatggctcatcatttcaagtctggtccccaaaataaacagcccctcccccagtatagaagtcccctagggcggagaaccctggttgacgtagatgcagatcaagcctctcgcaacactgaggattcttgggtgctgtcacttcaggctttacttatttttcagcctgcttgggttttttgagacagagcctcacagtgtcgtcctgactagcctggaactcactgtgtagaccaggctggcctggaactcactgtgtagaccaggctggcctggaactcacagagctgtatgctggggttcagggcttgtggcgccacacccggctgaaacttgggaattttgagcaaggtacacagtaagtgctcgtggcttggcacacccttcctggtggtgtaggttttgccaggaagaaggctcggggtctgcttggttctcacactagcagagtgtgcccctgtaagcctgctgtagccacgcaccagggactgccttttcagacatctatataattaaatgaagacaatcccaggggtagcccagtgtccttcagggcactccctggcctaaatggttttctgccttttttaggtggatgagagcaaggtgtgtctttcttatcaccttctcctggtcctcagcgcagctgatactgcagtctgactgtcacccactcagacaccactgcccagccagctgctacttcagcacaagccaccactgtttctatttagtgtgttgtcacatgaactatagtcttgctccctttgagaattctcttcattcgatcagcagtttccagaatttcctcaggctttaccacagcccagctcactgtgtattcctcaccctgagagcctgctgtggaacctggaggctgagcgcaaaccagggagccaggccagcggctgccacaggacctcctgagtgtcccttcccatgatcttctcactggggtcatcaccagcctgccgcttggttggttgcagaccctgtgtgtcacagctactttctgagcatggtgacacaagtcactgtggtcacagcagggcaggttctcatctgtcctcttagtcctccctgggctcaggacagtgtccacagcaccatgaatgtcagcttttataaatcgctagatagatcatgttagttgggctaatttgaacccacaagctgtccataagatgggcatcttgttcgcagtgtgcttatgcctaggtctgtgtgctggcccagctgtgtgtctgcagaggtgggctcctctatggagtgtccacctggagcaagcacagctgccagatcatcttcagaagcaggcttcggcagtggccttaagtaagtcggggttgagacacagtggctttttaacacctgtgaaatgtcatctgtcacatgctatggaaatggtccaccttggttttctttggcttaaagccaaaaaacatgggactatttttgaggggaaagtggtgcccacctaccataatcgctaaaactgggtctgctgtcacaggcagctgtgcctgttgctgtgtttacagtcagagaaagctctgtttccttcagaacgcacacctgcttgccctgatgcccaccgtcccctccccatcctgttagcgacacactcaccaggtgcaggtcccgttcctggcaggaacctgggcaggtgctggcctagccacctctcctctgacggacggatgcttccctcactgcggctcctgcttcttagagttgcctggcaggctgggctgcctctgtgtcccgggggacctgtattcttgttgatcctgatgcgttgtggaaaaaaactgctgtatttgatcctgagaatccttcaagattgtatgcctgcccccaaagagggatggggcataaaacaaagccctgagagatgctgataaggtgtgtgcatgacacgccaggtgtggcgggcctggcggggcggggctcaacctgcagactctgaaaacccctgcttctggtggccttgtagtttctaagatcttggtcagattccttcaaagccaggcatggtagcacacgcctttaatcccagcattctgcactggagagagagaaactgcggcaggcgtatctctgattcccagttagcctagtctacaaagtgttctctaggccagccaagctccaccgtaaaaccctgtctcaaaaacaaacaaaaaacaacaaaatactccttttagaacaggaggccaatttttctgacacttctgtctttaggttcactctgcatagatctgcttttgcacattcattcattcattcactaattactttaggggagggctcccgagcccctgagcatgagagggcgtcagaggacactttgcaaaggccaattctccttccatcatgagggttctagggattatactcagagctcaggactcagcagcaagtgcccttacccgatgaaccatctcactggcctgacagatgtgttcctcgcacggtgctgctcggtgcagctcggtggcagcactcagctagcatgcctggcttctgggttccacagccgcagcacagaacatggagggagaagtgcatcactgaagatttgtccccttttatgtttctcaattcctgagctagatggcgggatgagtggatgtgtcttcacctgccagcggagcctgagtgtgttttgtggagcagctgtcacagctgctatgaaggaggtcttggtggggtagctgacagagtcgccgtgaccttcaggcctggtcctcatcagagcccagatggatagagcaagcacagctggtgtctggggggtcagccccatcctccgaggctgtttctctacagcagtttacaagagcagccaggcatggagcacacgacttcacattggaggccagcctgggctaccagtgaggccttgcctcaagactcaagatcttgcctgtcacacttggaaggctgaggcaagagaattgccaggagttccaggccagcttaagttaagtacttctcagctaacctgggaaggagggaaaatgtgttcctcacaaatgtggctcagtccccatgaaccatctctgcatcagccctgccctttctccccatcacagtacctctgtccatggctgctagctaccggatgcgtctctcacctacatccaaggttgggggtaaggaagttctcccaaggccagagcatgtgacatgtgacctggaggaaactgtcttaagggacagtcctacttagtttaggtctaactaaccaatgtcattgagtgttaatgggactttttggggggggggcgccgaatgcttctgtttttttgtttgtttttgctttgtggtcagggttttgttatataatctatgttggcccaaaactctatgtgtatgtagcctaggctggccatgaattcacagtagtcctgcttcagtctccttatcgctgggattatggcttaagatagctcattaaaggactggagagatggctcagtggtcaagagcactggctgatcttccagaggtcctgagttcaattcccagcaaccacatggtgactcagaatgtaatggggtctaatatcctcttctggtgcatctgatgacagctaaagtgtactcataaattaaataagtaaataaatctttttttttaagatagttgaatttaaaaagaaagacaggtttgttgtgtgtgtgtgtgtgtgtgtgtgtgtgagcgtgtgtgtgtgcctacatggctgtgtgtgcaccacttgcattcaagtgcccacaaggtcagaagcgaggtcagatcccctggaattagttacaggtggtgagccactggatgggggctggggactgaacgtgggtctctagcaagagcagtaagcacccttaaccactgagccatctctccagctccaaattcctaacagtttagctatcaagatatttcagtgctgggtatgtgtgtgtcgtgagtcaggccacagccatggctgtttccaaaggaggttgttgccagcaccataaaggaaagagcaggggcggagaggcagggaaggtcaccctgaggtcccaggaggatagccactagtgtgaggccaagtctgctctacacagatagttcaaggctacagagttgcttagtgagacccaggttcaagagagaaacactcagcaggctttaaggttcagcctctttccaggtctgggctctttctccacaaccacctgaatgtacagagaatggtcggtgggcagcatcctgacccctggaggtggtggttgctccttggtggactcttaggtcaggggtgctaaccctgcctgtgctgggatggctgggtttcctcaccttgacacaccctagagttacctgagaggaaggcacctcaggtgagacggtgcctgtgtgagcctggcccgtaggaagctggtgaggcattttcttgtcgggtgattgatagggaggctccagctccctgcgggctggccgtgccactcctgggtggtttaagaaagcaggctgagcaagcagggagcagtgtttctccgtgatccctgcttcagttcctgcctccaggcctcagtggtgagtgcagccggagggtggtgagtggaaagaagccctctcctcacaagccgctgtggccatgttgtttatcaccgcagttaagatatgctgtgctagtcctggactaggaattccatccccacaaacttctccctctcagtcttgtcttgtatgacatggttttgtgtcaagcttttcaatgataaaatccactggtggcctctccgctggtgttaaaactcagaagcagggaggtctggggcctctggagagaaactgcagctgaggtcccagcagggagatggctctgcactaagggtcccgcctcctgcacccttcaccgtcctcaggagggttagttacgccagcgagtgcctctgagcccctggggccttccttcccacctcactcagttccagaaaaatcccttttcatcctctctccaaggaagatccctcccttcttcactgagggggtctctacccaagtgtgcctggtcccagacttcccaggggccacctgcttagaggttgttcctccccatctccctgcctcatggtggctgagatagccctctccctcagtgggaacctcctttccttcaggtcatttctctggaggccgccaagctcggggctggcagataccttcagtcagcagcactcctcagggcagccctgagcaaggagcaaaccactcgtcaggctcgcacgctgacctctgacctgtgtgcccagaggtgccagagaccttgggccctcttaaaagagggtcctgtttatcagctttcttacagaggatagcatggcacctcttcccaggtgtgacagccagaatcatctgcagactgtgtggagtccctggggaacagagcagccacctttgagggtctcttctctggagtttcaccacccttacagctgaggaggctgccctggaggcaggagcagaagcctcagttctgtgtaggagccttgctctccgacattgtctctcttcctgcagagactagcattgagaacaactcggataacgtgaagaagatcccaggctatcagtgcctaggacctaattctcaggggcgaagggacttagtggtttggtggcaggtggcctctctaaggtgggggcttgcttgcttacaattctgtgaatatgggcatgtgtgcagctggcagagctgagcatgaactgacaagtgtctgtccctgcctctaggacaccactgggacaccttggacatggctcagtcctgttctgctaaggtgtgtctagggtcaaccttagaactggaagttagcagacacttgttctttcagctagggctgctgccagcagtaggtgtgctgttggtacccagcagtatggtatgggcatggggaggatgagcgggctcacagagtaaccattagcccccagccacactgcacaagcctcctcagatggtcccactgcttagagtccttgctcaggcctggttagtcaaggattacagacttccaaaaggaaaacaggtgtccagcttggaccagtgtgtacaaagtctgatacatgagtcaccctgttggaaccctccagcgtcgggctgccaggctatgtttctctaggcacatggacctgagtagcagctgatccaagatggaggcaaaactgacaggagcctagcaagggctggaggccaatcgagagtgaacggtgggaccatgggtgcctccctcctctggtgactgactctcctctcttttgatcttcagtgtggggctgccttccaggaggaggacatcattgtgctcaatggcaccaaggaggatgtggagatgctgaagaagaggatggaggagaggaggctgagggccaagctggaaaaggtagtgccccagagcctgctgcaaactatcctgcaacctcagcagatgctgcccagcctagggggcctggcctctagaaacagatttggggcttggctgcattggtcttcatcaccagataagtaggtggtcggtggctcaaggcatgatggtgtagggaagattttaaaaggatgggtcaagcacttgcgcacagtgtcgcggaatgagctctcaggagaagcagtcatggaggtgaaagagcacaggcgggctgggcttggagcttagcagtagagtgtgaggccctaggttctgtcaccagtgcagaaaaagaaaggagtcatagtgcattttcataacttgtaaagatgagagcagaagtcagtgtcacctcagcaggtctgaggtccccctgcagtgtagtccagcaggcatggagggcatacaaagcaatggacctcatcgtggctccaattgttttgttgttgattgttatagagaaaggttaggctaaaggtaaactcgagcctactgtttgttttactaaggtagaaatccagatgtggcacacctgtaatcctatcctcctaaggaagagttaggagagttggaggagtttggagagccaagggctaagtgtggcttagtggtagagcacctgcatctcatgtgcagtcatgagtttgatcccagcactgaaacaaagaaaaccctcagggcaatgctgggttagaaaagtagtgtggtgaggacacactgaccagaaacagctggcattaaatcagcctacatctgccagtgtggtctgaaggtataaggctgtagtgacaggaggagcttcagagctttgcttgtgcctttttgtcatagatgaaagaacagaaagaatcacatcacccgtgggtgacagtggttccatggttgtgaggcttaaaaagctgatggccacacaagggacccatctctcagaagcaaacccatcctcatctcctctatcagcttggaaaatagtgcatagagcccgtgcaaatgttcagctgtgggaatcgtggagcttcaaacatctgtgtgtgcatgttaattccaaattagttttctaaaattcacttaccatcataaaagcatagaaaagttgcagtgtctttggcaagagacagcagccaaggggatctgattggtttttgctgttcttggtcagttttttaaaaatgtaaggagaggcatagtgtgctaaaaagcagcaggagccctgtcagccttggagtggcttcccacgtggctgtcctatcacaggcctcctgccaagtcctgcagagcccagtgggattgcatcccctctgcagcctcttcagcagggcctctgtgaacgcgcttagatactgctaccaagatacaaaatatttcccaaatatcctcacctgctgtcagggcttgtgtctctgcgcacacctccagctttgaacagcccaaccgtcaatgaggggagagaactaagcgttcgtctcagttgttttgtgtgactgggggtgtgtggacactgagtgtgtgcacacaagatgtcaggtgtcctcctctgtccctctctgctgttaccttgagacagggtccctcagtaagcctgaagaacaccatttcggcatgactagctaaccagcaaattctcaggatcctagtctctctacctgtgagttctggggtacaaacatgcacagtcatgtttctgcagtgggtgcttctgcaccaagacatctctgtagtctgtgaggtttttgctttgtagtaacagccttcaaagatttgtgtgtgtgcatttcatgtgtaaatgaactgtttcttaccatttttttcccaaatgctttaagtcaaattgcatgaatgtcacacatcaaagtccaccaccgagaaagatcttttgttcagtgcaagagatgagggccttccaaaattcattatcttgttttactttgttattttaaagacagggtctcatgaagtccaggctggccttgaacttactggtcttaaactcctgattctcttgtctctgcctcccctgcgctgagacagcaggtgtgctgtgtctctggtacagtttggggttcttatggaaatggtgttttaaagtaagctgtgacctgcctttctgatggtctgtggggttaactgtaatttcagaatgatcagccttctgggggatgaacactgttacccatgcagcatctaagagtccagtgacgctgacctagagcctcaccagctgacgcttctcagtgaaaacctcctcacagctgagcaggcgtcggaggctgacggctctggggctgagtgaatgaggctccgtgtgtgttcacgtgtgtggaagttgttattgtttcactgctcttttgtgtacgatagtcactggagagagtgagtggccttttgtttgtgctgcggttttggagatcatcaatgcctcctcaacactgaatggctgccccatcacagagcaactctgtatgagtctgtgtagactcagtcttctgtgaggcatggctgctagactggagacaggtcgtcctcagagaatgtgtctggccatcagggaccctgggccctaggcaggcccactgacactgtggtctgattatctgagcacaacccttccccttctcccaccctgtcagttacttctctgtgttcgagaaccccgtgaccagtggcggcctccagaggcagagcttagtttggctcccagttccacagggtgagagtccatcgtggccaagaggcacggccacaagagtaggaagctgagaactccatccacacacgaagcagagtggactggaactggggtgaggttgtacacccagtaagtagtgcaccaccacccgctgaaggttccctaaactcccaaacagcaccaccagtttgggatcaagtgttcaaaaagccaagctgggagactctcccattcaaccaccacaccctccaaaggtttctttcttcttacagaaaacaaagaaaccgaagacagcgaccgagtgtgcgtcaaagccgggtaccacacaaggtacgaccttaggaacctgggtgcgggttgtccacggataccaggcccttgctctgctttggctcaaggtttgttttgctgattctgtcttctccagattctgcagggccatcaaaagtgaagtctggcaagcctgaggaggcagaccctgatcctagagagaagaaaagcaccctggctcccaggggcgcaggtgggtcttactgagacagcagagagctgagaacaaagggatgagaaactcaggctctcctgatcgttcacccgtggctcccgtgtcctttgaattaaagagtagtcaaagcttctgagcacaaagcccatatcttactgttgtgcaagcttatgatgccataccacagcagcacacagagctaccctcaatgcttcacactgtggagggcttaggcactgcagccacactgtgtggaggccttggacactgcagccacactgtgtggaggccttgggcactgcagacacactgtgtggaggccttgggcactgcagacacactgtgtggaggccttgggcactgcagacacactgtgtggaggccgtgggcactgcagacacactgtgtggaggccttggacactgcagacacactgtgtggaggccttgggcactgtagacacactgtgtggaggccttgggtactgcagacatactctgtggagggcttaggcacttcagtgccttcctattctccccttagcgatctttgtctctacttgcctcttttttctttctttctttctttctttctttctttctttctttctttctttctttctttctttccttctttctttttttttttctctgtgtagcccttgctgtcctggaactcactttgtagaccaggctagccttgaactcagaaatccacctgcctctgcctcccgagtgctgggattaaaggtgtgcgtcaccacgcccggcccaacttgcctcttttgccaagtggccaaactgctcttgaaactcaatgtctttacttcagaggaagcatcgtttacatcagcccagtggcagaggtgactcagccatgagcaccaggccagtctgggccacatgcttgagttcaggctagcttaggtcacatggtgagtttctgtctcaaaaagaaaacaaaggacaggagagctggcttagcagttcagagccaatagtgctctgctcctagcacccatatctggcagctcactgcttgtacctccacctccaagagacctgacagcctcttcaggcctcaccaggcacacacacacacacacatacaccatacacgtacatataaagaaaaaagaataaacaaaaaaaggaaaataaatatttataccatgcctggtgacacaggcctctcatcccagctactcaggagctgaggcaggaagatcaaaagtttgaggtcagccttggcagcttagtcaactcctctatcaaagtaaaccatcgaagcgacctggggcagagctcagtcagtagaggactacttactctacttactctgttgagcgtgtgtgaggagagagagaagagagagattgtgttattatgtccagcataaatagtggccagtggctcccattctggcgtcaatcagcatagtaagccgaccagaacaggccactggggcttctgggctctttgtcctggttcaataccaacctgagcggaccaggccctcagcctgagtgctgagaagcaggggacagtctggtgctggcgtacagtgctcagcaaggccttatgtggttggggctctgcctggctttcaggagacactaataagagtctgtgcttcaagccaggcatcggaggcacagttaggaaaatcactccaaattcaaggtcagactggtctacatactaagttctaggccagccaagactacatagtgaggccctgactcaaataatatattgtaggcaggaaatatagctcagtggttagaatactagcacatatgcataaagcctgggctcagtatgaagcagtgtgatggcagcttctgtaatcccagcacttgggaggtgacgccacaggacccgaaatcaaggccagccccggctgcagagagttcaaggatgggctgggctgaatgtgtctctgcccctttacttcagctgctttccaaatagcagcaagacattgggagcttagccaagtggcatgcatgacttggtccctttaaaacttagtcatttggaatgatcttcagccccagcctcaccggttttggctttgttttctagcaactaatgggagtgcgtctgggaaagttggcaagcccccatgtggggccctgaagaggtccattgcagacagcgaggagtctgaaacctacaagtctatcttcaccagccacagctctgccaagcgctccaaggaggagtctgcgcactgggtcacccacacatcctactgcttctgaagcgggaccgggccctcaccctgggtttcccgtggccttctgtgccacacttgcttggtgtggcactgtgctataaagctgtcctctgcagtcctcagccagcgtggtcacttgctgtgagatcttgagggccctgggagtgagaagtggtgtgtgacctccctagtagcaggtccacaggccgtacctctcacctagcctggtgactgctgcttctattaggtaacaaaagactccagctctcgtgtacactcagctcataatggtcaaggagggagtggccccgagcttagggacagacttccaacagtcttagaccttgctcctcacagggttcttcttgcctgatcaaagactgcagagaggacgcatgcctgactgcctggtgcacactaacatcctttctctgtcttccttctctctccctccgctatcttggtaagagaatggcagccatccaggtgccggtggcaggcaggaatgactccttttccatccccacagttaaaattggaacctctgtgacacttcatgtggtgtgatagatctgcctctgggctgggcagatggctcactcagtggataaagcactcgccatggacacttgtggaccagagtttagatccccagaacccttatcaaagcccggtgagtgcagtagctgcctgtgatcccagcccctgtaaggcagggttccctcagcaaggcactgagttcagggttcgaggagaacctgcctcagacactagctggagtgcagttgagagattcccagtgtcagcctctggcctccacacttaaagtccctgttcccaaaccaaacatggtggcatgtctaatccaagcagtcagaagactgaggcaggaggatcgccgagatgtcagagctggcaaggttaaatagcaaaccctcacctcagaaaacaaccccagaaaagcccctgttcctgctgccctctggtttgctgcttgcaggcgatgaggcttggcctcaaatacacttgcatttattctgggacagtgctgggagcatggtaggagtgtgcagcagggtgggagtgagcatggtccaagggaccctgggcgcatgacctttgtacttagaaaattgaaataaaggttgtagaaatatttgggggggttggttttgcttttgaaacatggcctcactatatgcatggctggcctcaaactcaagatcttcctgtctaacctcccagaggctagaattagagctgagggtaggcactctccccagggtagagtgcctacctagcatgcacagagccctgggttcttccacgacattacataagccagatgtgacaggcacccgtcgctccagcatttgggagatggaggcagatggatcagaagttcaaggcccgtgctggagagttggctcagtggttcttcagaggtcctgagtttgattcccagcaaccacgtggtgcctcacagccatctataatgggcaccttctcctggtgtgtctgaagacagcgacagtgtacccatatacataaaataaatccgatttttaaaaaaagaacttcaaagccatccttggctacatagaagtgttagacaagcctgggatacgatagaccctgtctttaaaaaaaaaagaatttttattttccaaaacaaagctaattaactcttttatttctctgagctattttcaatacagtgaaaactactttagaggtattttttgatgttgttaaattctcataacggttactttattttggtagttttcttttaatcaaaagagaactttattgaggatgaaaacagtgtaaaactcaaagctgctctgtcattgaattagcacaccaccatttctcttatcctatttttacaaagaaaacttagcccttgtaagccatattttattaattacaacctttaaatgtttaatttttttaaagatttatttatttttcttctctttctttttttttttttttttttttttggtttttttgagacagggtttctctgtatagccctggctgtcctagaactcactttgtagaccaggctggcctcaaactcagagatccacctgcctctgcctcccgagtgctgggattaaaggtgtgcgccaccaccgcctagcacttacttatatgagtacactgtagctgtcttgagacacaccagaagagggcatcgggtcccatttcagatggttgtaagccaccatgtgcttgctgggaatcgaactcaggacctctggaagaacattcagtgctcttaacctctgagccatctccagccccttgatgattaaaaaaaaaaaaaaaaaaagaatactttcacatttctcaaccttaaaacttcgatatcaggctggcgagatggctcagcggatggctaccgaatgccagatctgacttcaaaagcagtacctacagacatggatacctagcccagcaataccttcaccatgggaattttcacgatcttgctcagggcctgccaaggatgaccctccaaacagactgcactgcacccctggccacagccagaagcaccagggccgcctgcttctctagtgagcgtctgtagctgtctagatgtcagggctcgtttctgatccagcaggaagcctgtgccagcatctggtaggaggcccacagaaaccgatgctctgccctaggggaacgccctgctgcccactggcccctggacacaggagtctgtagaagccacgccaagctcagagtgtaacacatttggaggcagtgtgagtgttagcagaaagtcatttctcaggtcatttctcaagatccctgcagtgagctacgagggacaagcgtgggccttaatgctgcatgagtagtgcgtgtgtgtgtgttgtgtggtaggtgtgtatgttgtgtgtgcacaggtgcatatgtgagcatgtggagaccagaagtcaaccttcagtattattcctgagacactgtgcatcttgtgttttgagatggtctcactggcccagaacccaacaagtacttgggctgggtagccagcaagtgcacgttcaggctgtcccggcctccccagctctgtgactacaagtgcccaccacaactagctttttaatgcatgtgctggggactaaattcaggcccctatgcttgcattcagacactatctactgagccatcttcccggctccttgggtgacagtccccacaacccttagatggtagtgtaggccaaaggaaagaaatccatgagccccagtgagtggcctgtggctggtaaccttgtttctcgatctacccctgttgggacaccttgtacctgtatcttaccactgtctggatcaaataagtgaaaccagaaacagacgatggcctctccttagagggtgccaagctcagagcattccagcaaggaaacagcatcctctcttctcgtccctggaagtcctaccaggcaggctactcacggtgagtgagcctcaggcttcttaagctaaaggcatcacaatgactggagctgttggctcagggccctctgtgacatcacgagcccccaacactagcccatcagtgtctctggcaccacggcaggcagccccaccatgtgtagctccctggaccagctctgctcaccatgcggacgctgctgagatggtgcctgttcttgtctctgtgcgtctcttgtgcctgtgccttcatgttttcttcgctgagggagaaaaccaaggaaagcccagggaaggtgccttgcggcggacacttccggattagacagaatcttccagagaatgcccaaggctggcttgggaacaaatggctctggctttttgttgccattatgatatatgtgatgctgaagtttcgaggagatggcgagaataaggtaaggatgtccttggtcacaccacaaccattcattcgctctcagaaacccaggttaggttcctacaagtaggaccactagtgtctgaccttgaactttggccagaaagccctatgatgatagctaggtgaagttgcttcctctgaggatgagatggtttgagatgggttcctaaacagctcatggttttcctgtgaagtaagctttgattattttccccgacttgagagtagactctggagctcacggtgtgttctgtggtgtcagacctgctcacagggccaggctcacacactccaggcgaggtgagctcttatttcccttgcttttgactcactgaaaatgtctgagccaaaggaagtttcatctcgagtaaagtttgaggcctctactcaagagtcactacgggtgtcccccacagtggcttggagctcttcggggattggagggacagaggttcagtctaagataaacccagcatttcaagacactgtggccagggtctgggagatgcctcagttagaaaaatgcagccttggggacttaagttctatccatagcacccagatcaaagtcaggcctggtggcgcccctgtccctggagagctggcatacccctgtccctggagagctggggagggaggcttaggaggaccttgttagacagccagtctagcagaattctggagtcccagcttcagtgagagaccttgcttgcctcgggaaatatggtgaagtggtgaggaagacaaccactatctatcaacctccacacacatattctggctagagcaaaggcggccaagctgcctgtaaaggctcaagtgggagtcattttcagctctacaggccatagagtctctgtggcagctccttcctccctttctgtcatttgagcctgagaacaggcccagctagtaacagagcttggctgtgtgccaataaaactttatttacgaaatcaagtcgcgggccaatttggtcacagttaaaaccaacaacatccagactaggtttgttattgtgtcccctcttggctgagtctaacttttggaactgcgtaggaactagtgaggccactggaatacttcacccggaatctctctctcgacaggagcagcatcctcctggcctccgaggctgccagctccgctctccaccaaagaaagctcaaaatatttcccccagcaaagacttcactttcaatactttaacccagctcgagatggaattggtgaaatttgtgtccaaggtgcggaaccttaaggtctccatggcaactaacagtaactccaggcagcaggttccagagagccccacgaacctgtacaataatgtcacaatatatgagatatggggggaggaggactctgagtgaagaggtttatagtaaagtataagaaaagacaagtattgacagacagtatccgaactaataaagactattctgaagaagaaagagtcccccacgtgagctctttctcccctccacaacccctcttgtttgtttgtttgtttgtttgtttgtttttaactggagtttaaaatgccaagtcccagtcgccttggaagtacaggcacgcacagatcactgatctgagcacaggtcgctggtcctgggaatctgccaggctccagaatgtggaggcaggcgctgacattttcctggacactcttggtttctatatactatctatatactatcatatcagattcgaatgactaatttcatcccaaagtcaaacttcatgggtttaaaatgacagtgactccgtcaagagaggtagttctggaaccttctgcttcccctgcaaccaggagaatctttattcattccatcctacaggccttctgcagcattacaaactttttttttctagtaaactggcaattacatgtggacttttagagtacagaaacagcgggttttatctgttccagtctgtggttccagaattggagacagttagtgcacagggactcaatagggaggaggggaggagataacttctatggctttgggtttaagatactgatgaactaaacaaggactctcgagttagtctttttaaaatgtatttttgaaatatttatttattatatgtaagtaccctgtaagctgtcttcagacactccagaagagagcatcagatttcgttatggatggttgtgagccaccatgttgttgctgggatttgaactcaggacctttggaagagcaattggagatcttaaccgctgagccatctcaccaccccccttaaatgtatttttatgtatgtgcacatgcctgccgtttgaatgcacaccacaggcatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctgtaactgccaaggtagacagctcactggccgcacctggcccactgtctgggtttgtgcggctttgcaagctgttcattgtttttatattgtcaagtgggtttttttttttttttaaatcaaactcacttccatgtgatgtgaaaacgacagatcagggtctaaatcctcccagagcccggccacgctggcttacttaaacatcatcggtggctgctttgatgccaccggggcagacagaatgactacatcagagtgggaccctttgcagatttgactggtctgacccaggagaaacttgctaccctctagtctgctctccaccaatgggaatgacacaccccacctgcagcctttcccgtgagtgttatgagatgccccggtggcccttgggaagaaaattgaaatgtgagacatttgtggcaggtgggggacagcctctaggacccaaaaagggttcccaagtaacagaaagtgggtcattcaccactcaacacaggaggtggatccaccacaggccctggaagaaagaatgaagccttgagtgacagctgatgctggcacctgacacagccttgggagatgtgtagtaggactcttctggccagtgggtagcctctgccctcagagggactgtgttgttttaagtcgtgaagtttctggtaattttcttacgtagcaatagaaaataagtccaatgtgtagtgcatgcgaagtgggttaaagagttgtttccatctgctgcttttgatacactcaaccctgcctttcccctggcctctggtcccaagccacagaaatgaggccaaagaaataaacagcagagggccgtgagaaactgttccttgagtcaagatcacacatctcacccaaaggagcccttgacccgcagcagtctgcgccttattctgaaaatggcagatcccagagccgggtgtgcagctcgagcatctgccttgtgtgtgtgatgctaggttagatcccatgctgcataaactggggtgtggtggttcatgcctgaggagacaagaggatcggagcttcatccatataggaaggtcaaggccagcctaggatattatgaactcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctccctctccctcctcctctctttctccccactgcttcccagaatagccctaaggacagccagtctctacagtctatttttcgtcctgtgccttttgctctgatccgtgtgcctgccttctcacaggaaggcaagtgtgcctgcagtttctctttcttcacagccttcctaagaacacatcttggttttccctccggcttcaggacagaccatgtatgtgcaggtgcctctgaatgtcccaccacacccatctatagggaatctcagggagtttccaatcatttgtaaccacaaacacctcgtacgtgtccgggttggttgagtgtgaacctccaggcagcctcttgagagagggaactctgacagacatttccacattacctctagaggtagtgtgcctgtctgcactatcaccaggaatatatgaatagttgtctaatcaagcatggggttgcatgtctgaagacagatttgctcgacacagcaaagttcctttagagccagtgtatgaagcatgaagatccttatatggccactaggtggcagacaaagcccattggaacaagaatgcagtttccaaagcctgagctgggatactgggggcgcctttcacttacaatcttgtcatatgcaaagtgaagctcactgtcagttaacatagaagccggcattgaacagtgtagacctcttggctttattttgttttgagacaaggcctgaaacaggctggactagaactcactttgtagttcagatgacccctggacctgtgtgtgatcctcctgcctcagactcctgaatggtagaatcaggtgtgggtcactacccctggcttccacctttgatggagatagaagatctaaagctggctgtgtagctgaggatggccttgaactctgaatctcctgcctctgcctaaacaagagcaggggttacaggcataccgcaagccaggcttccatagtttattaacaacctgtatttgctcatgggctcaacagatatactgctgttttagatgatgcgaacaagacagaagagaagacaaaacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacctggaaataaagacacaagtgtcatattccgagagattgactcacttctgtccccagacccctcggaggaagcataagcaggaatggtgactggcactgggcccttgggacttaaattccctggggtgtcacgggtcaagtgaaaactggagagacttgcctagaagaggggcagggagtgtggaagagcagatgggtcggacagagcctggagaccagggctctgctgctgcaaacaggacactaagctccctggcaggacctgatacaccaatggggttcagggctggtggccgtgaagcatctgaacgccccatttcttcctacaaggtcacctaagcaccctgacaatgcccactcaaatcaaggcaacgggagaggcattgggtctcagagagctttgaactccaggaggcctgggactgggggttcctgcttggaccctctcaacccccaagccacttcaggtgatcttgtcactccagagttaccctctctcacgggtcctctcatttcccaatcagacagtccttcgcctatttgttgttcaagaagctttcaagttctttggaacatgcctgtagctcagcctgggggcagacggggcaggagcagcatgagggaaccagggctgcaaagcaagaacaccccagtgtgtaagctgagggctgagcagaggaaaccggtggagaggacaaaggcagggtgcagggtacatgcagcctgctgcagacaggatgggggtggggggctgaggctgctgctgagggtacaaccacagggatggagtaagaaaccccagtgactgttgctaggaccagaaaacaacctggccgccttggaaggcagcgtggagagtcctcagcaagttaaaaacagagctgatcagaaagtgccacgcagaatctctcgtgtttatcttcaaggacccctgaaccgtggaggccaggaagatagacgggacccttaaccatttaaggaggggaggtagataccagcactggaaggtaaaggcaggtggactcaaaaacaaaacaaaacagaaaatgactttttgaggcaagagtttttctagtctgaggctaacctggtctacagagcacgttttaggagagccagggctatacagagaaatcctgt

SEQ ID NO: 1292 - DNA, 1146 bp, Mus musculus
caaggagcgccggaagtaggtagggtttcgccagagaccccggaagcgacggcttctcgtctttgctaaggcttctggtttttgctacggtttctgatttcggctttgggatgggttgcgacggaggcaccatccccaagaggcacgagctggtgaaggggccgaagaaggtcgagaaggttgacaaagacgctgaactggtagcccagtggaactactgtaccctaagtcaggaaatcctgaggcgcccaatagttgcctgtgagcttggcagactgtataacaaagacgcggtcatcgagtttctgttggacaaatctgctgagaaggccctggggaaggcggcatcgcacatcagaagcatcaagaatgtgacagagctcaggctttctgacaaccccgcctgggaaggagataaagggaacaccaagggcgacaagcatgatgacctccagagagcgcggttcatctgccctgtggtgggcctggagatgaatggccggcacaggttttgcttcctccgatgctgcggttgtgtgttttctgaacgcgccttgaaggagataaaagctgaagtgtgtcacacgtgtggggctgccttccaggaggaggacatcattgtgctcaatggcaccaaggaggatgtggagatgctgaagaagaggatggaggagaggaggctgagggccaagctggaaaagaaaacaaagaaaccgaagacagcgaccgagtgtgcgtcaaagccgggtaccacacaagattctgcagggccatcaaaagtgaagtctggcaagcctgaggaggcagaccctgatcctagagagaagaaaagcaccctggctcccaggggcgcagcaactaatgggagtgcgtctgggaaagttggcaagcccccatgtggggccctgaagaggtccattgcagacagcgaggagtctgaaacctacaagtctatcttcaccagccacagctctgccaagcgctccaaggaggagtctgcgcactgggtcacccacacatcctactgcttctgaagcgggaccgggccctcaccctgggtttcccgtggccttctgtgccacacttgcttggtgtggcactgtgctataaagctgtcctctgcagtcctcagccagcaaaaaaaag

SEQ ID NO: 1293 - protein, 336 aa, Mus musculus
GFARDPGSDGFSSLLRLLVFATVSDFGFGMGCDGGTIPKRHELVKGPKKVEKVDKDAELVAQWNYCTLSQEILRRPIVACELGRLYNKDAVIEFLLDKSAEKALGKAASHIRSIKNVTELRLSDNPAWEGDKGNTKGDKHDDLQRARFICPVVGLEMNGRHRFCFLRCCGCVFSERALKEIKAEVCHTCGAAFQEEDIIVLNGTKEDVEMLKKRMEERRLRAKLEKKTKKPKTATECASKPGTTQDSAGPSKVKSGKPEEADPDPREKKSTLAPRGAATNGSASGKVGKPPCGALKRSIADSEESETYKSIFTSHSSAKRSKEESAHWVTHTSYCF

SEQ ID NO: 1294 - DNA, 70242 bp, Homo sapiens
cactaagaatgccgtgctcacataccccagccctgccgcgctggggcacctccaggcggaggctgagaagctggagcaacacacgcggcagttcagagggacactgggatgaggactgtctacctcccttcctcctctgctcacctctcagcttcacacccacaccttgtgcaactctgccctatgggaaaagccagccggggcatacaccaatgagctgaaacagacctggtgcccaaagctggtagtaccaagtggctaagcaaccccagggcattgacttaccccgcagggggtcaggaaagagagtcaggtatgaggtaaagaccttgtgaagtttagcatatatggagtatgcagtatcagcttgaagtgacttcgcagaaataatattttatattgattaaatgtgtgcatgttttgtttgttttttgagacaaagtctcactctgtcacacaggctggagtgcagtggcgcgatctcagctcactgcaacctccgccttctgggttgaagcaattctcccgcctcagcctccagagtagctggtactacaggtgtgcgccaccatgcccagctaatttttgtatttttttttaatgaaaggtctcacatatttattactgaacccagccaaccaatgcattcataacagattcagaaagaaaaaatatattcccaataaaacatgtacaattctccagagagcggtgacattttcagcttgatgtggtaacatgactgtgaccttcagacagcataaatatgtgtgccctctcatgtgcaattccttatagggctagcttggttcttcttcaatgtctccttttggagttgtacctgattttattaccagttttcatctgaatccactggggagtggggcgattttgttttaatttctcggtcaggaatcacttaatcctggaagtcttatgagaagacatggcaagaagcagagtcaagcacacaccacaatggcagagaaaggaagagctaatttttgtatttttagtagagtcggggtttcaccatattagccaggctggtctggaactcctgacctcaggccatcccccgcctcggcctcccaaagtgctgggattacaggcctgagccaccattcctggcatgtacgtgttttaaattcactcatttaacacttatgtattggatgcctactacatgccaagttctaggtgctggagacatagcagtgtttcagagggcttgccctcttggaacttatgatctagtaggggagtcaggcagtaaagcggtgaagaaatacatacacagtatagcaggtgccaggaaaaacgtaagtaggggaagtgcaagagaacttatcttcaaatggttaatttttattgcatccattagataatagagtaagttttttgttgttttgaattgaattagttctgtgagattggtacaaattatgtatgtgtcttgcacccataaatatatatttttgctatgttactttaacctaaagatagatgttatatttacaacataacatgatctgttgggttctctattaatttatttcatacattatagattctgggttgataaattctgctcaatttgaaaaattttatattttgtctcaaatctgttacaatttatattggttggtgcaaaagtaattgcggtttttgccgtagacagtaatggcaaaaaccacaattgcttttgcaccaccctaataatattaaatataatcatgactttaaacatcatttgcagcattctttttttggaaaagtctttgatctgtgtcacccaagtgaagcctccgatgtttacttttgtcactccagtgcttctccctgaagtctgcagagagatggagtagaggccctgctcttaggcaccggattggtgctggaaaacaaagccatcacctgtggtggtgcagacaggaaggcgtggtgtggacaggatgcccatcattgggcacagatatgaaagtggcacagagctcccctcaactcaaaccacctcctcttcctctccttgtagctgagtcctcagctcacgttgccatggttacatcatcacttcattttaagtgatggtctgggcctcctaaatgcataaacacctctacagcttggaagagcatctccaggctgtaagtcacctgaaatgataccaagtccaactcctatctgctactctttccttggtaggcacttgtaaaatgttgactgctggaggctggttatttttattaagttagtctcagggtccttaaaaaaaggatcccatctttgtgaggcttggttctctacaactggacagaggccctccagggggcctattctttgaacagccatgatctgcatcagttaggacttctcttacaagggatagaaaatcatacccaatctgtcttaagcagtaaaggaaatttattaactcatatgtcttaaaatcatccagaggcaaactagccgcaaggctggctggtttcaggggctccaacagtgtgatccaggaccagtttctcggtcccacttgctctgggttaacccccatgattgcaaggtggttttcccaggttacactcttcttgattcttggccagaggagaagaaaaggacttcattcggcttggactggcttagatcaggtgctgctcctgaaagctccatgataagcagggcatggaacacccaagttaatttagatctggaattcctacccaccccacactcactctcccatgggtcctgagaggtaacgggattgctctttcaagcactgtgatgggcctgaggtttcatctttgaaattaacaagttaacctgtcaccatttcatggatgcagacagaagatctaagattctgggatcagagactatgtcagtggtccccaagaccacctccaggtccaatgagtcactaggaaaattcacaggactcagaatacagtcatattcacagctgtgacttactacattgaacagatgcaaagtgagatcagcaaggggaagaggtacccggggtgaaatctaggggagaccaggcacaagcttccaagagttttcccccagtggaatcacacaggacacgcttaattcaccccagcaacacttgtgccaacatgtgtgaaatgttgtcaaccaagaaagctcatgagagcctcagcagccagggttttactgggggctgatcaggtgggaagcctctgtctggcatgaaccaaatttccagactcccagaaggaaagcaggtgttcagtatgaatcacgttgtttgtataaacagtttaggcacaatgagccattcttataaattctggcaatggtgggaaccctcccaaaatccaagtttccatgcaccaactgaaggtcaaccttgcaggcaggccttcataaggatatttgtcaggcctgcagtgttcatccttttgtgcatggagacaaaggactctttctcctggcattgcaagcaacttggcttcaccttcacatcatttcccatgtcctccaagtcccagggggtgatgcagtggtgggctcaggtggatgctgaacacataggtttgtgtcaaagacaaggaaccttagcataggaatccccaattttttataacgggctcggagcaaatctgacaaggcttggcctcagagggagacatcatctttactatatatttatatatgtaatatatgttatagctatgcaatatagatgttagatatgtaatatagatgttatatatgtgagagatatatatatatatattcggatagggtctcgctctgtcactcaggctggaatacagtggtgcaaacatagctcactgcagcctcaaactcctgggctcaagtgatcctcttgcctcagcctgcaaaactgctgaggttacaggtgtgagccatcgtgcctagccctcatttttaatatactgcataccaaacaaacctgccctctgctctggagggagacactatctctatattccaaggctgttggaagatggttaaacaacatcctttaaaagatggttcacaacaaaatgccattggtgcctctgctctgaatatgtgcagaaaggcaagagacctatggagaactgtgtcccgagaggatcccctaataaaagtcaggaatattcttggaagaaggagggattaggccaggcttggtggctcatgcctgaaatcccagcacttcgggaggctaaggcaggagggttgcatgagcccaggagtttgagagcagcctgggcaacaaagcaagatgctgtcgctacaaaaaatacaaaaaaattagctgtgcctgatagtacacacctgtagtctcagctactcaggaggctacagtgggaggatctcttgagctcaggaattcgaggctgcagtgagtgagccatgattacaccactacactccaatctggatgacagagtacgacttcatctcaaaaaacagaaaattaaaaaggggagggattattgtgaggaggccaacaataaatttgtattgcagtggataaaattatgttttacgcttaataacagtggcatatatttattaaattattactacattgctactaaagcactgttctaatgctttatattctttaacttagtcgttcataagtgagtctttcatggtgttctaataggtaacgaaaagtccttttttttttttttttttgagatgagtccaaattgaagacctttgtcaacaaagtacaaaaccactgggtgtaaaataatgaaaaatgctgctgctagctaaatgtgtttccttcctttttttgaaacagtgattccagggtgaatttccactgattaataagatgattacctctgaaaaaaactttaaaataaaattaaacacaattttttagcttttggtaactttgtgctgagtatttttgcttaatgcctagaattctgtatggtttcctcccaaggaaggaagaggaaatggtgcgtggtgtggtggtagcaacttgacctcaactaagtcaaatttcatcaggaggctggaagtggtgaagagcccatgttagcgatcctccagtttgacaagttgtggggagttgtgtttgtggtttggtggcaactatgttttttataaacatctttttaaaaatgttatgttttccctatgtatgcgccccagttctctgaaagttgcccatttgtatgtgcacttataaggaggtgaatcaaagccacttgctgatgcccttttcctttcgttcattcatttctcaaatagtcattgagcagctcctacttgttcaggcctttgctgatcactagagatgctgcaggaaacagaacagaagctctggagcatggcgctttctttccagtcgagggagatgaaaaaccaggcaggaggtgggagaggagctcttatggaatgctaactataaggcggtgcccaaaacactgtgtatcaaggtaaataatattttgatgcaattatttttaagaaataaaaatcaatgcaaaaaactccatggtgaacaaaatgtccaaatttatatttataacgtgatatttgcggataaatgcaaagaagaaaataaagcaagatggggtaatgtgatggcagagcagtgctattttggatggagaggtcagggaagatggctccaaggaagggtcccaggagcagagggctggatcccttgagggggccagctgggaacacatgaagagaaagcgcgtccctggagaaggatcagcaagacatgtgcacagaggtaggagaagagggtggccagtgtggctggaacctaataaggaaaggaacagtggccaacattagctgggaggggtggccaggggccagttcattcaaagctttgtatattgccagaatattttgaatatttccctaaaactgcaaattaaaagtaatttttgtcttgaattatctcaggacttgcctcagttttctactttgttttaaccttctttgggacaccttcctgtgtatgaccttaaaggatggttgcaaagttcttcaaacatttttcatatctactgtcttagtccattttttgcagcattaacagaataagaacagatttatttcttgcagttctggaggctgggaactccaaggtcaaggggcctgcatctggcaagggcttttgtgctgcatcatcccaaggtggaaggtggaaggacaagagagcaagagagggccgaactcaatgttataacaagtccactgtctcgatcactaactcactcccaagataacaacatgaatccagtcatgagagcagagccctcatgacctaatcacctcttattaggccccagctcccaacactgttgcattgggattagatttccaacacatgaaatttgggggacacactcaaaccatagcagacagtttaaaaaatgtttaatgccaactcttaaaatgagttatggtaagctgcagctacggaagagcatatgagcagagctaccaggaaatcaaacctgccatggctcagaagtctgaaatgggccgggggcagtggctcacgcctgaaatcccagcactttgggaggccaaggcgggtggatcacaaggtcaggagttcgagaccagcctggccaacatggtgaaacgccgtctctactaaaaatacaaaaaattacctgggcgtggtggtgtgcgcctgtaatcccaccactttgggaggccaaggagggcggaccatgaggtgaggagttcgagaccagcctgaccaacatggtgaaaccccatctctattaaaaatacaaaaacttagccgggcatggtggcatgtgcctgtaattgcagctactcaggaggctgaggcaggagaatcgcttgaacatgggagatggaggttgcagtgagcccagattgcaccactgcactctagcctgggcaacagggtgaggctccatctcaaaaataaaaaaattatataaaaaaaagaagtctgaaatatttgagacctactgtaaggacttactataacagcatttaaagtactggttcttagcctgaggttcagaaggctgtgagtaaaatacaaacatgtatacgctatgtgaaatgtcgtatgtgctaatcaatacttttctggagatttagttcaaagttttcatcaaattctcaaacaggtccaatgactcccaaaaggttaagaaatactggttttactagagggtaatgattttcctttttatcatttcattcctctgcttccccaaaaatccatggcttggctaggacaaagttgtctccgaagatgcttgtaagggaataacctttattagttcattcaacaaggcagtggaagaagaagcagacaatgatgacatctgcttcccagtagagccgggagaataaaacggctcaagtccaataaagcgctgaacacagcacctgacatggcagccagctctcaacacatatttgctaccaatgataataaacctcacaaaagttctagctgtgtatagtctgaggcacagagtagcctagagaccaatattctaaaagaggaaaccaatgaggaagagaaaaaagtccagctgcctgagctagaacaccagcacagccagtactgctgggttttatcagcagcatttggggaagcagttaagtcagacgggcctcatcggagacagcccctcatcttatactccttttactcagcagctatgagaccctgaacaaagacaacttgcacatctgagtcttggggttttcatttgtaaaacaagagggattataccctctaactcttaaggttattgtgagcccaaagtgaaaaaatgcctacaaatctctcagtgcacgcatggtcatggcttaataaagagccgctatttttgttttttcttccccaaatgagaaaagaacactggtttgagtctttctaaagatgctggtgtttctgctcttctgtatttgactttctttcctttgctgtgagaaagaactaatcctagcactcattcccgggtctctcactgcctatgtgaccttgaaggagtcatttgatctttccacgcttctgtttcctcaccagtaaatggaattctaatagtactaaccagttttagtatctgccaaaactaggcttttcacccctttctcaatgaatctgtactttcttttggtttactgaggaaatgtactcatatattgagtgtgccaaagactcttctaggcactgatgatacaatgtggaataaaagtcctggccgggcttggtggctcacggctgtaatcccagcactttgggaggccgaggcaggtggatcacctgagatcaggagtttgagaccagcctggccatcacggtgaagccccgtctctactaaaaatacaaaaattagcccagcatggtggcgggcgcctgtaatctcagcgactggggaggctgaagcaggagaatcgctttgatcctgggaggttgaggttgcagtgagccgagatcacatcactgcactccagtctgggcaacagatcgagactctgtctaaaacaaaacaaaacaaaatgaagtccctaccctcatagagcttacagttattgtggttagcatagaaataaatcataaatcaatcagagaccaactaattaaagggattattttttaaaattctcattaatcacagtaacaagtaccccaagcttacatatagcccttgaagtttccacatccacgtattttctgggcaactcttcccaagtaaaaaatattttcagcgtttttatgtttcacgtaggtcaatagggtaatatccaatcataaagatctgccttcttggcaatggagaaattttcccatcatatatatgtacaaatacatacatacatacatacatacatattaatgacagagtcttgctctgttgcctaggctggagtgcagtggcataatcataagctcactgcaaccttgaattcctgggctcaggcaatccttcctaccccctcagcctccggagccgctaggactacaaaagcttaccacaacgcctggctaatttttctttttctttcaagatggtgtctcaccatgttgtccaggctgacctggaactcctgggctcaggtgctcctcccgtctcggcctcccaaagtgctgggattataggcactttcccataatatttataataattaaaggaacaaacagagagatagacaatcgcctaagagcagacagacaatcatgaatttttagcaagggatttgtgttcttatagataaaatacagcctgactcttggaacgggcatggcaacatcagtgtatattttataagaactattatatcgtctattaatgatacttgattgttaataaaatttttttagcctgggcttcaggaaactgtgaatgaaatacacacacgcacaaactgtatgcaaaatttcacacacatgccatctacaatatgcatggcaacaccagaaagttccaggccttaagggagggtcttacttcctagaatctgttgtaacatcacttcacaagatttgttgtgagtgcttgagtcacagttggcgctcaagaaagatgcgttctccttttaaacacaaaaatgtccattgatacagcagattccgttcataggcatccttaatcgcagaaacaggagggcggcccttttcctcaaggcgctctcagtccagggatgtgcccgctccgcagccacacaagctggcgtgggatagggtcaaagagcggtggatgcgcacgggccgcccacgccctcgctgccctcccggagcgtgggcgagtgattccgattgtgcagcagaaacccagggtctcacgggaacgaggaaacccgcccacgcccagcctccaagcgacgctctccatgacaaccggcacttggtaacggcctcgccctgccccgctacgccgcgcctagcgtgccgccccgccccgccccgctacgccacgaccagcgtgctgcgtcacggcggtgcgccggaagtggctgcggatttcgccggaaatcccggaagtgacagctttgggggtttgctgctggctctgactcccgtcctgcgatgggttgcgacgggggaacaatccccaagaggcatgaactggtgaaggggccgaagaaggttgagaaggtcagtgatgtgggccggctcttggcgaccgggggtggtgggaatttgacgaccccagaaaacgagaggaagtaagaagggggagccagcggagttccagacctggctgcggtcttttattccattcagaggactcaaaattaacaacagtattaagagtggacattcaatgggtgctgactattgccattcactggacagtaatcttaacagggggtatctcatgtaattatcacaatagccctatagctacatactgttgtcctcattttcagacatggaagttgaggctcaaaaggagaaatttgcaaagctagtaaatggcagagccaggatttgaaccctacctgcgactagtagcaataatacaaatacctagtgtatactgagttttgtatacactaacttcatttgctcagagaagccttcccaaactgttcccttaccacatccttttataaactgtcttagcctgcacacggctgtacgtggttgatttgtatcaagtcttccccgctagacggtaagttcctgatagcagaggctgtaccctttttttctctgcaactagcatggttcctggcacactaaatatttcgaataaacaaatgagtgaataatccctgatctcacaagtaatcgaggaaattataataatttctttgctactgacggggacattgagtccagggatattaaggtgactaagatcacacagctggtaggtagtgaagccaggattcccatccacttatttgggatttcaaagttagcacaagtaattactttttaatgataaaatatttgtaaagcacctagtagagacttctttacaaaaatatttgtaaagcacacgtggagacttcatgtattctgattcaggagctggagagcttgtttaaaaggtaaaccccttaagtcactattgtatttgaagcattccagtggcttcccatcacattaagaataaaatctcgtcagacccttgagcagaccttgcctatgtttctgacctcatctgcccctctccacctctttcatactgttctagctaaacaggcctcttgttcttcaacctggagtgtgagttcatcaatctgaaatactcttcactgagattgtcacatgatgagtttctttacttcattcagttttttactcaaatgtcatctgtccactgtaactgaaatgtgcctcacttccaatattctctcttctcttcttaacagtgcctaccactgtgttgtttattgtctctttcccacgtagacaggaaccttgtgtgtcttacctctgtaacccctaccatgtgtcagccacataatagacacctaataaatatgtgtgaatatgggaatgaatgaatacccaagaggatgaagtgtaccctctgatcatacgtacatgtaaacaggcgaatgctggataattagcattcatgagtggttttttggctttcaccaaaaaagtgtttagctcagttttgttttcttgtgcccagggctgaaaaggagtagcttaatgaaaggcttgacaagaaacaggtgtcggaagagggtagaaaagaaggaagagcgattcaaaaaagccagaatgcctaggcaggatggatttttattataactattcacacaacaaatgcttaataagtggttaccatatatacattgttgtaggccccagggatatagcagtgaacaaggcagagtctagccctggtggagcttacatttcggatcaatattgtgaaatctgccctggttcctaacgcagagcacctaaattccttgtaatttcctgggtgacgggatcatcttttgttctaataaggcaattattggtgggctcctggatggggcctggtcaccagaaacaccaagccaagattagaagcctggaactttcagccccacctcacccccatccttcagggaggagaagaggaattggacatggagttaataatccatcatgcctacgtggtggggtctccataaagatccctgaagttgagggtttggagattttctgggttgccgacaacatccacatgccaggagagttaccccaactccatgaggacagccctgcacttgggacccttccagattacttctttatctggctatttatttgtatcctttaaaatgtatttgtaataaatcagcaatggtaactaaactctttccccatatctgtgagacactagcaaatcatcaaactgggcggggggatcgtggtagcctttgatttatagacagtcagaagtgcaggtgacaacttgaacttgtgattggcatctaaagtcggggtagggacagtattatgggactgagcccttaacctttgggatctgaggccatatccaaataggtggtatcagaattgagtttaattgtaagacacctggctgctatcagagaattggttggtgtggggaaaatcccatacattttgtccgaagtgttctggaagtattgagtgttgtgagtgaaagtatagaaaaaacacttgtctggccaggcgcggtggctcacgcctgtaatcccagcactttgggaggctgaagcaggcggatcatgaggtcaggagatcgagaccatcctggctaacacagtgaaaccctgtctccactaaaaatacaaaaaagttgccgggcatggtggcaggtgcctgtagtcccagctactcgggaggctgaggcaggagaatggcgtgaacccaggaggcagagcttgcagtgagccaagatagcgccactgcactccagcctgggcgacagagcaagactccgtctcaaaaaaaaacaaaacaaaacaaaaccacttgtacttgtctttccagtacagatatgtaaaaacttaaaagaagaaagaccctaggaaagaagagagaccctggtaaacacattttttactgctttttcgggggaaacaattttcaaagccctggataaggagtgatttgtcacttttctccctgtccccaactctctgaggtgctttttgaatataacctaatctcttggtgcctcactttcctcatcttcaaaagtaaaaatactaactcatagagtttttctgaggattaaaaagttatggaaactgcttagcacagtgcctggcacacagtaagcacttaagcagtttttactttaaaaattaaattcagagggccaggtgtgttggcttacgcctgtaaactcagccctttgggagattgaggcaggagaatcacttgagctcagcagttggagaacagcctgggcaacacagggagacctcttaacaaaaataaaataaaattagctgggaattggcgcttgcttgtagtcctagctacttgggaggctaagggggaggattgcttgagcccaggagaattgaggctgcagtgagctgtgattgtgccactgcagcccagtctgggcaacagagcaagaccctgtctcaaaaaataaattaataaaataaattcagcaggattgtttttgtcttctttttttcttttctcttcctattttcttccaaatgtgctgtcctgttaaattattcagatttggcatttgaagaatgggaaagagtggtgcagtctacacagtgaaggaaaaaacaagaacgggaaggagtgggacatggaatatgatgtatgtgaaaatgtcattcgagggccagggagggtcttatgtctggattttcatactggggataaagtttgatgtatcccttagtgaataagccccaaaacacttatttctgttaaattgaacattttataaagaattatgtagtctttgttctgaactttaaaaaaaaaatgcttgtcttctcagttcttaagtctttaaattctgccgcaacttagcaggctttcccattgttagaaattaatctaacacacttttttttttctcttttgtatggcctccctaagttattattaagattcagatgttaatatttgtatgtggcttgcataaacagtttaataattttatataatcttctttttctttgtacatgtcatatttagatgggcgtttatttgatgtagtattaattacttgtgacttttaaaatcctgacttcagccaggcacagttgctcatgctttcaataccagcagtttgggtggctgagatgggcggatcatttgagtccaggagtttgggggcagcatggcaaaaccacgtctctacaaaaaatacaaaaattagccagccctggtggtgtgcacccatagtcccagctactccagaggctgaggtggaaggtttgcttcagtccaggaggtggaggttgcagtgagtgaagattgcgccactacactccagcctgggcaacagagtgagaccccgtctcaaaaacaaacaaacaacaaaccaaaaacccaacttcctatgtcattatctttgatttaaaaaacaaaaatcattacagtgcggtattactgaatatacttttatatgtagaattgtgaaccatgtgtctttcagagttgaaaattaattgaattttttgttttttattaggtcgacaaagatgctgaattagtggcccaatggaactattgtactctaagtcaggaaatattaagacgaccaatagttgcctgtgaacttggcaggtatggtttttacacttaatcaagatgagtttgttaagtgattttgaggagaattttgatgtgtaaatgcagttttccattcatcaagcgtggattatcccaagcaaatttgtgaggcataggctgtcgttccctgtctctgaacatagttctgtactcttctagtcagtttggtttatttaatccatggtttgaaaactgaggggctgggctgagcgcagtggctcacacctgtaatcccaccactttgggaggctgaggaggaagggtcacttaagtctaggagttcaagaccagtctgggcaatgtggtgaaaccccacctctacaaaaaaattaaattagccaggcacctggtggctggcatgatcctgtagtcccagctgttcaggaggctgaggcaggaggatcctgtgagtctgggaggttgaagctgtagtaagctataattccaccactgcaccccagcctgtgcaaaaaaaatagcaaactcaggggccaatagaagctaaattataagcataaacacatgaaggagccatgtgaggaacaggagagaatggcagggaatggagaatactggagggtccatgtgctgtccaaagcgggagctgccactcagttccagccagtttttacagctcaatggtgttggcctagtgattccacaccttctggttttaatttttttaaaaaaagaggaaatacgtacttatacgttaaatttcccaattaaaaaaagccttgttcaggttacattcagccttctgactgccagtttgccacctttgatttaaactaatttctggctggacccattggctcatgcctgtgatcccagcactttgggaggctgaggtgggtggatcacctgaggtcaggagtttgagaccagcctggccaatatggtgaaaccctgtctctactaaaaatatgaaaattagccaggcatggtggcaggcgcctgtaatcccagctgctcgggaggctgaggcaggagaattgcttgaatccgggaggcggaggttgcagtgagctgagattgcaccattgcactccagccggggtgacaagagtgaaactctctctcaaataaataaataaataatttccttctttgtatgctctggaaatagttgaaacagggttaaatttactttttaataattcagggtatttctcttatcaaatgtaaacgacttttggattgtgttcagtttattcttccttctttggttatttgaaagtcgcttgttgacataatattctaatacttactattgcagactttataacaaagatgccgtcattgaatttctcttggacaaatctgcagaaaaggctcttgggaaggcagcatctcacattaaaagcattaaggtaacacgagtgattctgaagtgctgtgagggtctgaacagtggctgaggtttattttatagaatttatacgccttaaaggctgaactcagaaatttgggattccattcccacatggccatctaatacaggtatgatcttgagaggtcacttaaatctcaagccacgagttccaccatgcatacttcctacattataaatctgttgtaatttcacctgtgtgttgtgctttgaaaattttgatgttctctattaatgttaggaggcattatttttgtaattaagattcacctacttggattttggatttggaagatacttttgtgaattagataattttatggatcactgttaaatcacgtggctaccatctggtgattagaggttctgattggcagttaaagttctttcataaaagttgaaaaaacaagtttttttaataagggaaatttcttgagaggacacaactttttaaatatggtcagtggggaaaaaaacttggaaaggtaatgaagaatttgagaaccatcaggctagtcaaacccttcatctcactgtaaatgactcacttgaggccccatggctagcgaagtacttaaaccagaaccagatcccctaactcccagtctaaggctctaggttttgccttctttttctttctttctttcgtattattaggctttttgttcaaatgcttggggttgattataggatatgttcatttcaggcaaattcataattctgaaatgtagctaatgatagtgctctagaaattattctgattttagtggtcttttaccttgtggaagagaatttattcctgaaaaacctgtggtagtatgaatcatcttacatcaaaaatgtgataaacgattctttagtagttcataatgctatgattgggtttccatgtgcacatgtaagatgtgcctctctcaagccttgttgtgacatcagcacattacccatctgatgagaaaaaaaaacagttattgaaattaattcatacagttctatacttaaaatacttgtaatattcagttttatgtggttgaatatttaatggaaaaaaactccaagaaattagaacagtaaagaaaaaaagcatacaaataaaacaatgctaatacataagattgtcattaccgtcaattgatagtccacaaatactcggagcagagaactcagtgagacgtgctcattctcgaccaggaagctgatcgtatgaatggtgatttgcctttcaagacactcacctgctctctagagtattgaagtcaaaatggtctcattaaatatgaagaaatgcctcgaatgcaaaagtagagttactgtatcaaattccttataaagttgggaattcttgaaaacctgaatagctgtgtcttggagtgtgacagtattttctggctaatattctgccttagctcgttagaccgtggcctcagattttactgtctattcaatgattttatatatatatttttttgtttttgcttttttcaacgattaaataaatgtagatagtcagtaacatgaagcagcctcagagaggattcatcacagggagaaagcattcccttctgggtggaactcatgcagagctttctgttagtggagtaattttttatgtaagagggtacttttccttaagttaaaaagatgtggatagtagaaataactgatttacttgctagtcagtgaattgaaaaaaatcttgttttctgttttcttttttttttttttgagacggagttttgctcttgttgtccaggctggagtgcagtggcacgatctcagctcactgcaacctcctcctcccgggttcaagcgattctcctgcctcagcctcccgagtagctgggattacaggcatgttccaccacacccagctaattttgtatttttagtagagacggggtttctccatgttggtcaggctggtcttgaactcctgacctcaggtgatccgcctgcctcggcctcccaaagtgctgggattacaggcatgagccaccacacccggccttgttttctgttttctatatatggtttaatattatatccatgtttcttatggaccagaggaaagtaactgtgagggagaggttttgatgggaagggctggaataacaatttgttgacttacgtggttaaggcaaaggatgatctgtttatcaaatgaattgttaaaatattaatggtttttcccagaatgtgacagagctgaagctttctgataatcctgcctgggaaggggataaaggaaacactaaaggtgacaagcacgatgacctccagcgggcgcgtttcatctgccccgttgtgggcctggagatgaacggccgacacaggttagtgacggacctgggacagatgatgtgggaggctggaggaatactgccggttttggtggcagtggtgccggagcttagcagtcatgtggcttgctttctggtgtccttgggtttggtggcgccttggaggaaatggtgcttggtcatgagcacgttcatttccgtcagccattgctacgggacttccagcgagatccagcctggtctgcggccttccgttcttgaggtggggaaacaaaacctgaagtgaagtgggattctgaaaagttctcatgtgacgcttatgaaacctgagtttagttcttagatcatcttttcctgtgggacagaaagcaaagagcaaatgtttcctatcaagcaaatcccatttccttcctgttactaatttttaatttttattatgttttatagttttatttttatcctttttttttaagtagaaataaggtctcactttgttgcccaggctggtcttgaattcctggcctcaagcgatcctcctgcctcagcatcccaaagtgctgggattgtaggcgtaagccaccacgcccggccactaatttttatttttgtagagatagggtctccctatgttgcccaggctggattcaaattcctggcctttaacgatcctcccaaagcgctgggataacatgtgggagccactgcacctgattacaaatgccaaaagttatgcagtaacaggcagagttatagaacctgtggttaatcagtcaaccaaaggctcaaaaacatggtaatttgccttgaatttgtagctaacagattctctggctgtagcactgggaatcttatggttgagatgtgtgtagcaaatgtaagcaacctgtatattttcctctttaaaaaatacggacggttgaatgggttagtacatgctttttcataggatgtctcactaagcaaaagcgttaagccctttcccccacttttgagaagtacagtcatacctcggagatattgtgggttctattccagactaccacaataaaacaaatattactggaaagcaagtcacacaaaattttggtttcttagtacatataaaagttgcctttagcagctcacagtggctcccacctataatcccagcactttgggaggccgagacaggaggattgctagaggctaggagttagagaccagcctgggtaacatagtgagaccctgtctttacgaaacaaaatttttttttaattagccagccatggtggcatgtacctatagacctcgctacttgggaggctgaggcaggaggattgcttgagcccaggaattcaaggctgcagtgaggtatgatcatgccactgcagagcctgggtgacagagtgggaccctgtctcaaaaaagaaagttatgtttatactatagtctagtcttttaagtgtgcaatagcattatgtctaaaaacaaagtacctatcttaattaaaaattattgctaaagaatgctagcaatcacctgaaccttcagcgagtcatcatctttttgctggtggagccttgatgttgccttgatgtcgatggctgctaactgatcaggatggtggttgctgaaggttcgggtggctgtagcagtgtattacagtaagacagcaatagaatttgctgcatcgattgactctttcatgaaagatttctctgtatgtagcatgtgatgctgtttaatagcattttacccacagtagaccttctttcaaaattggaatcagttgtcttaaaccctgcaactgctttatcaattaagcttatgtaatatttcaaatctatcataacaatattcacagcatcttcaccatgggcagattctgtctcaagaaaccactttctttgctcatccataagaagcaactcttcatccatttgggttttatcgtgagattgcagtaattcagtcatcttcaggctccacttttctcattctcttgccattctaccacatttgcgttacttcctccactaaagcattgaacccctccaagtcgtccatgaggggtggaatcagcttcttccaaactcctattaatgttgatattctgccctcctctcatgaatcacagattttttttgtttgttttttgtttttttgtttttttgagacggagtccagctctgttgccccgtctggagtgcagtggcacaatctcggctcactgcaacccccacctcctgggttcaagtaattctgctgcctcagcgtcccgagtagctgggattacaggtgcccgccaccgtgcccagctaatgtttatatttttagtagagacagggtttaccatattggccgggctggtctcaaactcctgacctcagatgatctgcctgcctcagcctcccaaagtgctgggattacaggtgtgagccaccacagcgggccaaatcacagatgttcttaatgacatctagaatggtgaattctttccagaaggttttcaatttactttgcccagatccatcagaggaatggcagaggaagcctatggcagctatagccttatgaaatgtatttttaaataagactttaaagtcaaagttccaccttgatccatgggctgcagaatggttgttgtgttagcagccatgaaaacaactttaatcttgtacatctccatcagagctcttgcgtgacctaggtgcattatcaatgagcggtgatattttgaaaggaatcttttttttttttttttttgagcagtaagtctcaacgctgggcttaaaatattccgtaagccatgttatagacagatgtgctctcattcaggcttggttcttccatttcgagagtacaggcagagtagacttaccatcattcttaagaaccctagggtttccaaacggtaaatgaacattggcccaactgaaagtcaccaggcacgttagaccttagtgagagtcggcctgtcctgatgctttgaatccaggcattacttctcctttttagcagtagaagtcctggatagcatcttctttcaatacagggctattttatctacactaaaaatctgttgtctagtgtacccatctttattaatgattttagctagattttctggagaacttaatgcagcttctccatcagcacttgctgcttcaccttgcacttttatgttatggagacgccttctttccctaaacctcatgaaccaacttcttccagtttccaactcttcctctgcagctttcttgcctctgtcagccttcatagaattgaagagagttagggccttgctctgggttaggctttggcttaaggatctgtcactgtggctagtttgatcttctgtccaggccactaaaactttcttcatatcagcaatacggttgtttcactttcttaccattcatctgtttatagagtggcacttttaatttccttcaagaacttttcctttgcatccacagcctggctaagtgtttgatttgagaggctggattttggcctgttttggctttgggcctgccttcctccctaagcttaatcatttctagcttttgatttaaagtgagagacatgcaattcttcttttacttggacacttaaaggccattgtagggttctcaattggcctaatttcaatattgttgtgtcacagagaatagggagaactgagaaggagagagatgggggaatggccagttcatggagcagtcaaaacacacacatttattaattgagtttaccatcttataagagtgttgttcctggcaccccaaaacaattacaaaagtaacatcaaacgtcactgagcacagatcaccgtaacagatgtagtaatcatgaaatcatttgaaatatttgagaattaccaaaatgtgacacagagacatgacgtgagcacatgctgctgggaagatgctgacacacctgccagatgcaggattgccgtgaaccttcagtctaaaataatcacaatatctgcaaagcgcaataaaacaaggtatgcctatatccttaatagctggtagtccagactgccctctggaatcttctgttaaacacacaacatactgaaaggtagcattttttattactttcattcaggaaaggggtggggcaaagcatctcgagtaagtaaaaatggtttcattgaactttaaacagcagtatttaatcctgagcattctggcacattggcgtctgtttatttaacaggtgtacatggacaccctctcagtgtgccaggccgtgttgcgtgtggcagactgtgcgaggggaactaactgtcctgttctgaaatggaacaacgaggggcttcatggatttggagagaagtacagtttagggtccaaggaccttttgcttttaaatattacactcttcttcaaataatctgaatttaaaccgcttagggctctcttttaaaccaccattggggtcaagtaagacatattctggggaaccagactcatttacctaaccatgtcccacttctgtatatgtgtgtgtatgtgtgtgtgtttgcatatatatatacacacacatatacacacacgtatgtatatgtttgtatttcaggtgaaagtcacataaaattggccattttaaagtgtatgtttcagtggcatttagtacattcacagtgttgtacggtcaccacctctatctggttccagaacatttttatcaccccaaaaggaaaatcctctgcccattacataggtactccccattgccagtctgtttctgtctcaatggatttacctcttctggatatttcatatgcatagaatcatacaatatgtaacctttcgtgtttggcttcccacttgcttttaagaaaactagctcaccccagaagaggaacttagcagaaacgagctccacaatggggtctcgagtaggagtcccctgcagcctgttgctctgattgtggcttcccctgttgtttctcctttggtttgctggtcagtctcttctcctttttctcttacccagtgaattgagctttgcttattttgactttgtccatctgttattgataagagcctccacacttgaaattgatgattggattagtttgtgtatggtcatcccttgatatgtgtgggagattggttccaagaccccctgtggataccaaaatccatggatgctcaggtctctgatataaaatggtacagtatttgcatataacctacacacatcctcctgtatactttaaatcaactcaggattacatatgatacctaatacaatataaatgctgtgtaaatagttgttatactgtattgtttaaggaataatgacaaaaaagtctgtgcatgttcaatataaatgcattcatttttcctcccaaatatttttgatccggtttggttgaattgatagatgcggaacgcatggatatagaggatatagagggccagctgtatttagtaaagtttgtataataaagatttaaatatatagaaaaatggaaataaactgttagtgtaataaaaacattgggcctttgtaaaaagaaaaatagcttcctaataatttgtaagtatctataaaataggattttaaaaattctaaacaacattcagtgaatttagtgcagtgttatgaactggattttggttaggccaatctgcgtctgctataatccctgggaaattagagaaaatttgtcctttggcatttttcaaggaatgcctaaagtgaaatatgaaagtgctttatgctgctctccagccgcggtggaggcattattcgttgtttgatgtttaatgctccctcccccacaccacacacccatatccacgcttctccacgcctctgcatatagacgtagaaatcgacacgtattcttcccaaactctcatggggtcacattatatgtatttaataacctctttttttctttctgttctgtccaccttggacatattttcacaaccttgaatacagatttaccttctttttaatagccgtttgggtgtttataatttatttgaccatttccctactgaggaacatgtaggtggcctccttcctttcctttttaccttgctatactacacaacttcctgagcacacatttgtacatttgcacacttgtgggcatgtttctgtaagaagaaactcttaaaagtcacactttacttgatactgccaaattatcttcctaaagtattgtactgtgttgtatccacctgacaacaaatgtgcctgtatcctcagtttccaattggatactttcaatctcttttttttttttttaaagcgacaagcgacagaatctgtcccagttacctaggctggagtgcagtggcgctatcatagctcaggccatcctcccacctcagcctccctagtagctgggactgcagggacccaccatcacacttggctaagtttttaaaaagatttttttttagagataggttctcagtatgttgcccaggctaatctcagactcctggcctcaagtgatcctcccattttgacctcccaaagcactggaatttacaagtgtgagccactgtgcccagccccaatctcctgaattactgcccgataggtaaaaaatgatgtgtcctggtttcaaaaggcatttcttttagcatttgaggttaagaatcctttggtctttatatattttttgtacgaactgcatgttagtcctctttggccatttttctattatagtgttgactattgctgtataagacctttttgaatattcataaaataagctctgaatcttatatttattgaaaatatttcctccctgagttcctgttcttttgacttttgatgtttgtggtttcagttttgatcttttttttattttggatataactgatttatttctttttttcctgccccttttctatgagaacgtactgatttttttaatagagtaaaatgtaactattttaatctttgtggttcttggcctttgtatcaaccgaataaatgtgaattgatcatgtgattaatacagtccttcccccactgggttatttctccaggttctgcttccttcggtgctgcggctgtgtgttttctgagcgagccttgaaagagataaaagcggaagtttgccacacggtgagttcctgacatgtaccatttgttccttctctgtagctgaggaaatcagatggtttagggtcctttccctccatttgttctttctgaaatcagctctcataagttgcttttctgcttccatggctcttggttgctggaagtgcagaatccactggcctcttgtcacctgaccactgcctgccagtccaggtcagaccacacgagggctgtttcctgaatgtgctgctgcctcagtttcctctagcagacctgctgtcctggagggcctgctcccccatgagcccccattccatagttcttacttcttccgtgactccctggtgctaaacctccttccacattccccaagcaccttgttttctcactcctcccatcgtaatgtaattgcgtatgtatgtgtctgcttccccaccggacttagtttttgagggtaggaaacaaggcttgttcatctctttatccgcagggcatattctctccagagcacgtagcgtgccctcagtaaatgctcgcatgggtggcgagtaactagacatgagagctagcctcagctcacgtggaggaaatactgatgctttgctttaatggcgctgctgctgctgaagccagaatgtgtgtgtgtcttgggtgtactgctggcccatcgaaagcgtgctgcttcatttaacgtcatggatgccggcagcttctgactgtattttcctgtatcaaccctgtttgtatttcattcccctccccactgtgttgttgctccctgttgtgaaagccagcagctttcactgagtgatggttaggggccatcgtctcttctaggcactgatctgtgggaaagcatactgaataagatccatgaaggcccttgccctcctgcatcccacattctgattggagagagagaccctcaagtagatgagcaaggcagaatcgattgtgaccgatgctaggaaggaaacacatgaggccatgtgatggagggagagaggctggcgtagtggtggtcggcagaggcatatctggaggtttgagctgagacccgaagggcacgagggagccagctgtgcacagcctgagtagcagcctcttcggcagcaggaacagcatgtgcaaaagctcagaagtgacagaggactttgcgagttcagtgaacagaaagtgtgagagtggagggctggtgaggggagtagatgagattaaagagttaggcaggggtcatctcatgcaaggcctgggggccacactggggcttatggatgttattcgaagagcagcaggaagccagaaggcagctgtaagccggatgggatgtgcattaattttgttctaaaaatcctagacgtggaggaggactgggtggctcccgttacctaggcccggaggcaggcagaggtgagtggggaagaggtcagtgggggcggtgagttatgtccagtttggggtgactatgaataaagccttcatagaatgaggagtctgtcttattaagctttcttttaagaaaagaaattcaaataaaacatttgggaattggttgatattcagccagaagtatttattgtggctcccgtattaagatgatggcatagattccaagggaaaataagatttggatgacatggttcctgcactcacggagattgcagtcctgcaggaatcatgttatgtgagacatcacactctattttgctttttgaggccaggtaccaaacagatggtaaagatattggcactaaggggccagagaacttttttttgtctactggtaagaaatggctttataaagggaggggcatttgttctgggcctcaaaggaagagcatggttattggttgcactcccggggatggagagattgctggtggtagcggtgctgctctggggaggcgcacagccaggtactgggtatctctgtaaggcgttgtctggcaggacagtgacgcccattttgctgtccttcagaccttctgcttgctttcaggagaaagtctccctttaatcttcgtacgtttgtaacactctcttaactgcctaagaaagtagactttaagctcagagctttggcaggcaggatctagcaaaactgtttggtattctctgcatttttatggtaacttgatatttatggcaaagagtactgtttctctatatttagcctaggaatataaagttaactgttaggttgggcacagtggctcatgcctgtaatcccagcactttgggaggccaaggcgggtggatcacctgaggtcaggagttcaagaccagcctggccaacatagtaaaaccctgtctctcctaaaaatacaaaaattagctgggtgtggtggcacgcgcctgtaatcctggctgctcgggaggctgaggcaggagaattgcttgaacctgggagctggaggttacagtgacccaagattgtgccactgcattccagcctgggtgacagagtgagactccatctcaaaaaaataaataaataaataaaaaataaagttagcagttaaaattaagcagaaacaatgggtagatttaaataaaaatattaagatattgacagtacagttggcaggggaatggctgaagtttgcaaaacactgttgtaagtcctgctgggactgtgattggttagtgggggaaagaaaggcagcagcagtgctcatggggcggaagcagccgggcagccatactgagatgagtggcaggtgtgatcgaggcctggtcctgtcaggactgtggggtggggtacaggagcagggagagaggccgaggtgtgagtcggactggattggggaaaccttcgaatgccagaaggaggagcaggagttctagttcttaagagttctcagaatcattttaatgggtcaccaggtttgggggacctactgatctaaagcaatccagttttttcttacgcccataatagtacccatctgttagatgggtgcacagttgtcctttgcgttggttggcctaaaacaatcatactaataaccgtgatgacacgtatgcagtaaaacctcactgtctgccgagcttcacagagaagctgattctgttgcatggaaatacagcgttacaagggaactctgagattatatcgttggtgcttgggaagttttactgaaagctagtaagctttcaacagtctgtaccttgcacttcaagagaagggaaggaagcaggaggaaagaggaacagagccacgtcaggattgcacaagggacagtagagaccaggtgacgaacaggagcgagcgtaggctcctcccggctcctcgtggaggccaccttggctgttgcgactttctgcagttatgacaggacactggttgaaattcaggaatacctcaggaaattgtcttaaagatacatctgttgccaacaaagaatgaacgagataatgaattatttttacttttatactgtacatcagagttgcctttgcagaactgtgttgaatactctgtgctagtttgttggggctgctgtaattaagtacccaagccggatgacttaccggaaagtcattgtcttatagttctggagactaacgtccaaaatcaaggtgtcatcagggttagtttcttctgagggaaggatctggtccaggcctctcattggcttctagacggccttcgccctgttcacatcatcttccctctatcatgtctgtctttgtgtccacattttcccttattaggacaccagtcccggtactggattagggcccaacttaatggcctcatcttaactaattacatctgcattgactgtgtttcccaataaggtcacattttgaggtactagggcttggacttcaacatatggattttgcaggggggcataattcaacccataatacacaatttagaaaataaaatcatagagcgtggggccagacatggtggctcacgcctgtaatctcaacactttgggaggctgaggtggttggatcacttgaggtcaggagttcgagaacagcctggccaacataatgaaaccccgtctctactaaaaatacaaaaattagctgggcttggtggtgcatgcctgtagtccgaactacttaggagactgaggcaggagaattgcttgaacctgggaggtggaagttgcagtgagccaagatcacgccactgcactccagcctgggcgacagagctagactctgtctcaaaaaaaaaaagtgccaatgtagagtactggagttgtgatccgtagcattggacttgctacctctgtggcttcatttatgtaggctttgtagataggtgaatggggtgtgtggatgttttaaagttagaagtcaaaaatatatatactcacactgtctacctgcttttcatggagggggtggagtagaaagagaaaaagttaagttagggaaaaggagtgtcgtcagaagtggtcagtgcagctgattctggttttcaggctttggccttcttcagagtatcttaggtttctgccatctttatagtctttgtgaatatttagcctcaaggaatcagataagacacagcataggcagccttaaactttcacatgttcattttgttctttcactctacccatcaacagactgagggtctgataaggagagagtgagcctaggcttcttgttctcatgctcacggaagctgctgctttcccttggcctccctggcctgtcgcagctgcctgtctcagcctccctgcctctcggcctccctgcctctcaagcctccctgcctctcggcctccccacctctctgactcttggccttgttttccattgctgtccccactctccactgaagcccagtctcaggcttttacattccacatgcatttagtgtacttttattattctgctttatcctgctgttactgaaatgatttttttttttagatggagtcttgctctgttgcccaggctggggtgcagtggtgcaatcttggctcactataacctctgcctcccaggttcaagtgattctcctgcctcagccacccgagtagctgggactacaggcgcccaccaccatgcctggttatttttttttttttttttgtatttttagtagaggcagggtttcaccatattggccaggctggtctgaaactcctgacctcgtgatccacccgcctcagccttccaaagtgctgggattacaggcatgagccaccacgcctggccatactgaaatgatttgttcaggacatgtcttcattatagcattaagcctgttgggggcaggtgtttgtttcaatttgtgcttctttgtgtgacgtaaggtcatgtagctacctgggactcagtagtcacactgcagagtgtagctgcctggtccaaatcccagccccactttcccagctgtgtggtcccaggaacatcccatcatctccctgtgcctcgattttctcatccgttaaaagtgtcagccattcttctgagcacttccccacccaggagcacccatgtcctcctaacggtgctggtgggcggatgcttttacagggcccccttcacggtatgtgactgggtgtaccacgggttgacattggaatgaagtgaaggcaggcttatgttttaagtaacttgaaagatgtaagcttttttattgttcctttaatggggtttacattcagttgctattgagttataaaataccggggacataatcgtggctaatctgagctttctgaatgaacagcctgtcagcatgtagccagctatcgcctttgggggcgccgtgtttgcctgtagaaatgtgtgggaaggtggtggtgggctgtcatggggctcttgtgttctttttgaaagtcttaatattttccatatgtgctttccttggattagatatccaaggggaagaaagatttgtttaaacaaaggtgttacttttctgtggttccttgatgtttgatttgtgggatctgtcttccaaatcccttttccttctgtctagcaatgatgttttcccagggctatttcacacagtgacttgacttcatttctatgcgtgggaagcttccatttactgaggtgcttacactttgcgttggaattatgtttctttaatttcctctcctctggttcctgtgttcccatctttaaatctcttgtatgttgtgctgtttaattgtcacgcacttcagtttcatatgatgctgtatgaactcttttagagaaggaggatatatataaagttctccacaacagcagcggcagcagcaaagtcgtggactttctaagggaggagacccagatctgtgaatagagataatcatggccattcatgtctcagatctgtgctgttcagcatggtacaattagccacatgtgcctatttaaaggtaacttaaggccgggtgcggtggctcacgcctgtgatcccagcactttgggaggccaaggcaggcggatcacctgaggtcgggagttcgagatcagcctgaccaacatggagacaccgcgtctctagtaaaaatacaaaaaaattagccaggcgtggtggtgcatgcctgtaattccagctagtcggcaggctaaggcaggagaatggcttgaacctgggaggcagagattgcggtgagccgagatcgtgccattgcactccagcctgggcaacaagagtaaaactccgtctcaaataaataaataaataaaggtaacttaatttttaaaaattaaataaaaataaagattcacttttgtagtcgctccagccatgtttccaatgcccaggagcccctgtggctgtggtgagcagttagacagctcagctgtggaatgtccaccatcacagaaggtgctaggagacgacatgtcaagaccgcagacacttggggcaccctttttaacaagctgtgttttctactccagatgagctctgttttacccagagaaatacactcttcattatttttctaggaccgccagaatagggttacattgcttgcagccaatgaggactgtttcagataagcatattttcattttcactgggagtctgttctttcttagtatctcatacacagtagtatctgggtcttcaaaacaggctgtgtcgttcttattccagcttgagcctggatccaggtgtttggagaatttgggttttcagcagctttttactgaagcatttggccttctaagtgcattgctatatgtcaccagtggtagcttgagtttttttgtcttgtgatttctttcccaaagctataaaagtggcctgtaatcaatagtaaagtcttgtcaatagcatgtttctgaattcattttaggaatagtttgtatcaaggaatcattttcccacttctttggttcaatgttctcttgtttcaagtcaaggaaacagaatgataccagtaagaaagcaaacactccctagcggttcagtctcatattgaaatgactctgctgttgaaaatgccagtgtggctctataggaacttctgcctgcctcagcacttgaagtctgtgccgccgctctaagcaggtaaccacaagcgggtctgtcgagggttcgaatttgttggcaaacagagaaggcgactgaatgagccacggcaggtctcctggtccgtatacgcagatgtcttcgacgtagcggcctgcagaaagaaacacaaaaacctagctgcctttgtttcctcacccattttattcacacacagaaagtggcgcatgctccgtccggtgtcagtggtgagcctcagcttcaccagagttcacatcaaacagcatttccatgattgccttgacaggggcttttatgttgaattttgaacttacggtggaaaggcgcactttcattcttttagtgatttctgaaatctttgttagttactgctttaggtgaataccatgggatttaactcaccacgcgcacacgagagataagctagcgctcatttgcctgctaaaatctcagttccgatagattctgagttccatgaacttctaagtcttttcattggttgtaagtagttcataagaatggtatggattttaaataagtcattgcttctatattttttggggaccccagacatgcaccaccatgcccagctaatttttgtattttttatagaaacgggatttcgccatgttggtcaggctggtctcaaactccagggctcaagtgatcttcccacctcggcctcccaaagtgctgggattacaggtgtgagccactgtgcctggcactgctttttatttgtttttcagagtgaacatttgatacaaacattgaggtgggaattacaggccaggcacggtggctcacacctgtaatcccagcactttgggaggccgaggcgggagaatgacttgagcccagaagtctgagaccagcctgggcaatagagtgagatctcgtctgtaatttaaaaaaaaattttttttaaagtgggaattagagttggaatccagtggtgactggattccttggagactcagtgacactttttatgtgcttttgacaaccgtgtttggctctttctgctcttgcttttaattctcacagtaacactctgaagtggattccatcatcattcccattttgcaagggaggaaacagattagcgaagtgaggcctcagcgtatgtgtgagagggaaggaggtctgtttatttcagaaacgttgctctttctctgcccagctccttcctgctctctttcctcacaccagcccagtaatcctacttttaaaaaacgtatcttggctgggcgcagtgggtgacacctgtaatcccagcactttgggaggccgaggcgggtggatcacgagggcaggagatcaagaccatcctggccaacatggtgacacctcgtctctactaaaaatacaaaaattagctgggtgtggtggtgcgtgcctgtaatcccagccactcaggaggctgaggcaggagaatcgcttgaaccagggagtcagaggttgcagtgagccgagattgcaccactgccctccagcctggtgacaaagcaagactccatctccaaaaaaaacctatcttaaggaaatactgtttttaaaaggggcagggggatgtatgcacaaaatgtccagtgttgtttctaagactatgtaagtggcagctgttaccatgatttaacaaattttacctgatagacatatttgctacaatgtgctagaatctcagtagagttacatttaactactttaatattataagtatgggccagatgcagtggttcatgtctgtaatctcagcactttgggaggccaaagtggtaggatcacttcagcccaggagttgagggccagcctgggcagcatagtgagaccccatatctacaaagataaaaaattagctgggtttggtggcttacacctgtattcccagctacttgggagactgaagtgagaaaatcacttgagcccagaaagtggaggctgcagtgagctatgatcataccacctgcactccagcctgggtgacagagcgagaccctgtctcaaaaaaaaaaaaaaaagattacaaatatgaagactatcagtgggagaaacttaggacataagtgaaaagcaactcagctacaccttgattataatgatacagctgtgccatttagacacagatgaagttgaactagaagggaatacaaataaatggaccattttcagagctgtgttaatgatatttgagtgattaaaaataaaccctttgttgctggttctaatgggatagctgttcttctgcacgcagagtcggactgggagcttgcccattgtagtggtggcaggcggttgctcccagtctgagccccagccctgcccctcctccctgtgcctgtgggagtgacttcacttacctgagccttgggttccacatcagtaaagggtgaataatgattgtttctacctgagaattgttgtgaggattgagtgcaggcccaaagctcggacccggaagatttaccacctccctacacaccagggcttggcctacttagggtgctgactctgaatgctggccatggatggccacgctactgcctaactgtgagtaccgttttcatactgaagctagtgatggtaagaactttctgaagtatttacttttagggaatgaggactttgttaggatttatactaactagggtttttttcaaacattgttgaaacattctgatttcattgagaattctgaatcattactttattattgatagtatcaaccctttatgacttcttataccatgtgcacacctgaggggctcctgttttcaggaagaatctgagccccctgctttttctgagcatttactgactagtcctgacaaacccaagtgtgtaatgacagggagcccctgctttctaaagaaagggcagagctcttgttaacctgttgtttacctgtcacctttctaccatgtgaatggatccctaattgaatcatatctgcttttgaaaaaaccccttcactagaaaattgttccagctctctaacctggtccctctgcttcaggagggtggctgtgcacattggcagcaggatttacttgtctttgaactagtctggtatttgatttacattttttgtttgtctccaatctgtttattttaggccagtcttttaaacagctgaaaaactgggtaaacctagtttatttttaatatctagtctactgtattcaaacccaaggtctctacccaaaatcactgttaaaatcagttattgtatctctgtgcagtagttcctgccactgggtaggaagctgtgtggagacatatggcagggcctagctgttggtgcagagggtatatttactttgggaaattttatcaacctgtattttttgtgatttgtgtacttttctgtatgaatcttatataaaaagtttttttaaaaaattgactcaacctatactaattggatcatcactaattccagattactttaaacatgatcctccgtcttgcccactaggattgaggcagcagttttatagttgttgtaaaatttgaagccttttttgttttgttttgtttttctttttacctttacatccatcatgaacatttccttcctcacttttccgcttaatggctcgaacatttccttcccagccagcgtttggtgtagcacctggagcatctaagaggaaaacaaaaccagcattcagtgtggaatctgcttcccagttcttttagtacaagttcttctgtgctatcatttccatttcctctagatgaggtagtcaatgagaaaagtagaggggaaagtccaaccttccttgagatgtttcacttgtaacatcggatcaaaggctagtgcttttgggggtgggagcatgtactacgctggcagtagcatccaggtggaccaaggttggggatccccatctttgtacttgggtttcatttttcagccctttctccaccccttgttactcccttgctgtatggagagtactctttgtgattctcttggggttctttggattgttttctctgtaacagccctcggagattatttgaaaatcaaacttgcagtggacatgaaattatattaaaaaaaccccaaccaatgtctactggactcatcgtacaccactgtctaggctgattagcttagttgttcaggcttgaagccacactccctatagaagccagtccaccttttacaaagagaaaatactgaagtccacttaaggatggtatctgatttccctctacctctcagagaacccatctgaagtatcagatttgccacaaaatcattactagctttaacattttccatcttacagagagcccttagcacaatgcctgacaccagtaggtatccagtagtatttataaaataaatgaagaactttctaaagatttatactcagaattttccaaagtctcaggagatgcaaaatgccagtacttctttctagagagggaacaaaagcagccagactggtttgggaacatctttcagctaacttcagacccctaaaatcagagaacttcctgtttccctaagtggaaggtcttgcaaaatgtagaacatttacaaggccaaagaaacatagctgaattgaaaaaatgttcaattttttcaataaatcttatggccgggcgtggtggctcacacctgtaatcccagcactttgggaggccgaggcaggcggatcacctgagatcgggagttccagaccagcctgacgaacatagacaaacactgtctctactaaaaatacaaaaattagctgggcatggtggtgggcgcctgtaatcccagctactggggaggctgaggtgggagaatcgcgtgaacccgggaggtggagcttgcagtgagccgagatcgcgccactgcactccagcctcggtgaccgtgtgagactccgtctcaaaatcagtcagtcaatcaatcaatcaatcaatctatctgctgctgttgctgctgactgcacaggcatccatatcggtgggtctttcttaccttttagtcggttcagggtcacccagtagtgttgctctgggctgcggatgtctttggaccactgaagcatgtcttttgcatggatgtcagtcagtatgaactctacaaacttccttgtaagtacatagtaagcacttccaaaataaatggttaagttatggggtggtttgtctttgaatctgttatttggaggtgcatagatacttcctttaggaacgaattcgagatgactttgacttgtcttggatttaatgtgcaatggttggattactccaggagtaatatttttatcactccatttgcttctgatgtagtgtatgatttctctgttggttttgatgggaaaatcctgtccacaaagattgatgacatagttccattgaaatttagaatgcactagaactttcatacaattaatatctgcctgtagtcttgtaaagccagcataagccaccttctctgtcttggaggaaataaaaacgttttcaaaacagttaaccaaggtttgcacagcagtcttatacttcattggggccttttcatcaacatgaatacaataaacattttgaggtacataaatagctctgagaagctgcacaaacatggccagctccttatgaatagttataatatatgccaaagagaaatcgccctcttctgcagacaggggtctggttatgaaatgcagcccccgagaaatcctggagcagtttcctggtgtgtgtaaatgagcatgtatttcagatttatgaggggttttgcaaaattttgcaatttggggggccgcccctttcccttcaaataaagcggaacacagttcatctgggtaaaagccacattctactacttctggttgggcaggttcttcttctgattctgcaggagttggattccttaagtaaagaaaaatgaagatgcaaatgactgccctcacgacaagtccagactttgtggctcgaagctggctcatatcttgagctccaggtgcattcttattaccataatttaagtattttttcctttaagcttcctaaaagaacaacagatacaatttagggtgttgtaattctcccccccaactttattgaaatacactaaactacatatacacacccatgaaactgtcattgcaatcaagataacaagcatttccctcactcttcaaagtgttcttatgctcctttttatcctctttctttccatccacatctctggcaattgccgatacgccttctgtcactctagtttgtcagtgtgtaactctttaagaaactgccaaactgttttccacagtggttgtaccagcaatgtatgatagccatttattatatagcctctggcatacttgctgtggtcagatgttttaatttttaccttttaatgagtgtgtaatgttagttccctgtagttttactttgcatttccctaatgactaatgatgttgagcatattttcatgttattgcccttatttagggagatgaaaaatctcaaatacttactttggacatagacaccgtcctgttctgccttattcaaagttcattgtgtgccattattctgcatataagactaatctttccaacagaagaagtgacaaattaagaggaatttgatgattatacacttaaacctgttgaagtgagtttctgggccaggcatagtggctcatgcctgtgatctcagcactttgggaggccaaggcagaggatcacttgagcccaggtgttcaagactagcctgggcaacatagtaagactgtatctctataaaaaacttaaaaattagccacatgtggtggtgccctgattatcccgttgcactccagcctgggtgacagagtgagaccgtgtctcccaaaaaaaaaaaaaagtttctgaattatttttaggaaagatgtcatagattaaaaacaaggtatctttatctaataacattatttgataatcatgtagttgtttgtcttgagtctacagaggtacatgaataggtgtagcaatagcaaaaagtgaccaaaaggtttcagttaattaattattacacgcaaggatcattctctggaatttagggaagaagattgataggtaacatgtcaagctttatattgttagaaagtatttgtttttcttgtttaagaatcttgacttggtttccattaaaagttgcatgttattcctacttcctgtttttcagaagaccatgtacgtgtgactggtatttgagctcaggttggacactggtcccttgcctttccacatcatttttacaaatgctgtttggataatgcctcaaacaggcagcatttttagttatccttgtgttcttaaactctgagccaacaaaaactgttaacattgactgtggattttaaagatgttgtatttattttcatcgtacagtttatttctacccatcatgcttccaaaataaatagcagccactgccgaggtatgtcaggccgcagtgtgttccactggttcagtaaatggtttctgccccaaacatggaaccttacagcctaatttaaagacattcttataaattatgtaatacttatcttttttttttttttttttttgagacggagtcttgctctgtaactcaggctggagtgcaatggtgcgatctcggctcaccacaatctccgcctcccgggttcaagcgattctcctgcctcagcctcccaggtgcatgccaccatgcccggctaatttttgtatttttttagtagagacagggtttcaccataatggccaggctggtctcaaactcctgacctcgtgatccacccgcctaggcctcccaaagtgctgggattacaggcgtgagccaccacgcctggcaatacttatgtttataaacatgaaaccatcataatttatacattttatatgagatttctaaattaaattaaacctgaccatagaaattgaataggaaagaaaaatgttcttgaaatgaaagtaaagctttttactacttctcctataagaattttgattaaagataaaccagataccatagtttgtcatatcttcccctgtattatgactttagtataggaagaagggtttgggttttgtttttttttttctgttgtccttttattttgttttttgagacagggtctcactctgtcacccaggctggagtgaagtggcgcagtctcagctcactgcaacctctgcctccccggttgaagcgattctcctgcctcagcctcctgagtagctgggattacaggcatgtgccaccacgctagctaatttctgtatttttagtagagatgggatttcaccatgttggccaggctggtcttgaactcctgacctcatgtgatccaccctccttggcctctcaaagtgctgggaatttttaggtgtgaaccactgcgcccggcctatttgtttttttggttttctgttgttttttttttaggaggagtttcgctcttgttgtcaaggctggagtgcaatggcgtgatcttggctcactgcaacctccacctcctgggttcgagcgattctctggcctcagcctcccaagtagctgggattacaggcatgcaccaccacactcagctaattttgtatttttggtagagatggggtttcaccatgttggtcagcctggtctcgaactcctgacctcaggtgatccacctgcctcagcctcccaaagtgttgggattacaggcgtgagccacctcgcccagctagtttgttgtttttaagataacttgtgaaagcgttctgttcctcctgtcacagaagtgagttagcccctcatcactgccaaatgataccccatgtaaatttggctgtgcgccgagcccaggagattgggtattttcagtagtttataataattaaatgaagagaggccccaagggtagccattgtcctttgggaaaatacccaggctaagagtttttccctcccctgtatagagacagggacatggccagttcagtgttaacctgctgtggccttctaccttggttccatcagcaccagctttcactgtggcccagttaaatcttccctctggcttagattcactgtgaaacttcagaatggatgcctgctggactgccctgctgagtgggaaccaaggtccccagcagtttagtttgtcattgtttcaacataaacttttttttgagacaaggcctcactcttatcactcaggctggagtgcagtggtgtgatcatggctcactgctgcctcaacctcctgggatttggtgatcctcccacttcagcctccccagcagctgggactacaggcatctggctaattttttgtagagacaaggttttgccacacaagctttttttttaaaaaaaaatcttttaaaaattgatacataataattatatatgtttatggatcacagagtaatgtttcaatacacacaatgtatcagcacaagctttttaaggcagtcaggccctctattgtaaatgtagcctttggagatctcactgctgttgctgtcacttgaacataacatctagtgggtaatatgaaaattcctggaggaataaacttttcatggcctgactttttttttttccttttaagataatggtgaacattattttcagttttgcaaacatttcctagcaattcttagtttttgttgtggctgttttatttctatattgtgaagtcagctattttaatgaaaaaataatgaaggtttagttactaaacatgagattttctgtcactaaattaatttccagtaaatgtaggtgctattttgtaagtgcggggaatatgcctctcataaaaaagtgttcttactgagtttttgaaccattttttcctccatagaaagatgtttaagatacttcttgtaaaggctgtagaaagagtggctgttaccctgtgtattatgtatggagtaggtatgcaagttctttgtctggaacagacctatttttaacattccagtgtcctattttccttgtgtattactagatcacaaacagtttctaaaatttgggggttagcctgggcgatgtagtgagaccccttctctaccaaaaaataaaaaaataattagccaagtattaggggtcccaaaattagccaaacctgtggtctcagctactcaggaggctgaggtgggaggatcatttgagccagggaggttgaggctgtagtgagccgtgatcatgcccactgcactccagcctgggcaacagagtgagtgagaccctatctccaaaataaaataaatttgggggtttgtgtgtgagagcatttcaaggcttttttcgtgcactgtctttccttaaattgtctttcctagacctggtatattttaataatcttttagccctccatatctgcagcctttgaaaggtagcattgttaaatatgtatatagtgtacagtggaacaaaacagcttccaagccatgaataatgttaaaagttaaccgttcagttgactgaagccatctagcatccaagagatacagtagagtatctttcagtggaaatcattgtcaaacttatggtcaaggatggtggttaacttttttcccgtttatgtagtgccagaatctgcacaagaacaggaatgatttccagttataattctcagagtggaattattttacattttatgtttttgtccagggttaaagtacttccagggagttgtttcaaaacacattgctcttctaattagagccagtgcctgtgttctttttttcttgtaattcttctacagtcttcctctcccgactcccaacaagccttcacagccagtagcaaaagtcagcaatatgggtttgatatcgcattacctccagaacagttcgttgaaggatatagtctttgagaatttgttaggatgggatttcatttgtggtaaagactttttagggtgagttggcagcatcccatatatactctttcgttgcattttttatatgtatatattttaaaggaaattcctatgagtaaatagataatggatgggaacctttaaaggtgaacccgaagtattttgccatatattctagcatattaccattttaaagcattaacattaatttaaccagcataagcagttgatttagcacccaaagtttctgagagctttacttttcaaaaagggtgggggttgagggaggctcaatattgcatttaccttattaggaacctcatatttagcttcaggaaatgggctttgaatcagggccccagtgttaggctcacagccctagcacttacgagtctgttgggcaagtgacagaagctcctgagtgtccattttcttgactgcggatgtggtgtatggtagtgtctgcctcacagggacactgggaggaggtgtgggagtgaaggatgtgagtttcacactgagcctggccctaggaggtgccctgtgctcactggcactcaccctcggggtaatgcggccccaaaactgtaactgcaggtgctgtcttcacttgtcctaaagtctctgtagccacacattgaaaatgtggtgtctctttctctctgagctcagaatgctgtccaaagcagcctcaatgttagcacaatgttttcttgagttacttgagatgagttggacaaattttgaattcaaaagctgtctaactgtccagtgaaatggatgcctttcacaaaatgcctattcctaaaacatgtataaattattttagccattttgatggaaagaagaaaactttattttaggatatccactcaaaacaacgacaagaaataaaacattctagtttacaaaatgagagctgaggatttgcacgtggccttgaatctgcctctcatgtgaggggttaacaaatggtagcattttatatttaaaaatctagttgatgccatactgggaaaatattctacttttattttctttggcttaaacaaaaagtgggggctatttttgagagaaaaagacacctgcaacaccgacatttcaaatattactcatattctaatattttaaaaccacagagcaaagaaaaacataatttacttcaaaaagtatacctgtggccaggtgtggtggctcacacctgtaatcctagcactttgagaggctgaggtgggtggatcacttgaggtcaggagtttgagaccagtctggcccaacccaacatggtgaaacactgtctctaccaacaataaaaaattagctgggcatagtgatgtgtgcctgtaatcccagctactctggagcctgaggcaggagaatcgcttgaaatcaggaggcagaggttgcagtgagctgagattgcactgccacactccagcctgggtgacaaagtgagaccctgacacacacacacacgcacacacacgcacatgcacatatacctgcttaacctttgccattggtgggtcctgcatagctattgagacgcttaccaggagaagccccctggttcctggagggggagtcctggcggtgtcagggcccagcctggcctttctctcccatcggttcctccccggcagcggcgcctgcttcagtcacttgagtagagttgcttggcaggttttgttgccatctgtccctggagagttttattcctgttggttctgacctgcagattgaaaagttgctgcttttgcttctctgagtatttccttgggaccagatccttcctgaaaaacaaaatgagacaacagaagacgcctgacccagatgaagggcgcacagtcactcacattgagaaaactgcaggatgaaatcgtggcattcatgggtcagcgtcttgaaattattttaaatacaggaggcatgatttagttatcagaccctctctcattaaggagataaataaaagtcacttaaaaatcctgtttctccataaatagcattcaaaaaaatccagacattttacaaggcaggggctgagccttctctgtgctctgtatcgcccccaagggtgagtctgcgccatagcatgtggtgaaggtggggtctgactgcaccccttcgctaggctttcctcttcccttctttctccacctctgggtacttttcttaacatcctttccttttctggttttaaaggttctctgcttgctggtactctctgcaggcttgccacagacagctctattaagaatatcggcaccaagagacatagatcacacaccgtagagatttcttatcttctatgtgccttgacgcctaagcgggatgtgtggtcagatgaatacagattctcttcacctgctcatggggtgcctctgagacacatgctgcttttttgcagaacagatgttgctgttgccaaagcacagagtattagaaaaacactgagcagacagaatgtagtccccataatcttcaggggttgcggcattcatgtggccttccagtggggagaccccatacattttgtttgtgtgatgttcagagtccgtgagttaaggttctgatttgatctagcaagaatcagaaaaggttaggtccttttatgtgtgggagagtcacattgccagcttgtgaggtcttgctgtgcctctcttcccctgcatcttgaatgcttgttttgaaacatgtccttgctgggtgcagtggctcatatctgtaatcccagcactttgagaggctgaggtgggaagattgcttgaggcttggagtttgagaccagcctggaaacatagcaagaccccgtctctacaaaaaattcttaaaaattagccggatatggtggtgcgcacctgtagtcctagctacttaggaggctaaggtgggaggattgctcgagtccaggaatttgaggttacagtgagctaggatcatgccactgcactgcagtctgggcaacagagtgagatgccatctcataataataataataataataataataataataataatatttgccctgtgggtgcacctggactagacggcagatctgctcacactggcccattcctgggggtcgagggttggtgctgggtttcacttcttgtctcacattctacatctggaaggaggaagccattctaagccaaatagcagtggaagaagcaactgaggaaatgctggggagtgttgcccacattaaacgttacacttccacattgctgcgggaaatgccaacacaagaagcaaacatactagacgagctgagccacccatttctattggtaataaatggacaaagggtaaatcggctttatgtataaacctcttatacagattgactaaaacatttaaaaaatgaaatccctaataaataaaaggacatacgatataatttacaaaacaggtgtcgtgaatacagtggggtttttttatgtttcttaatccaagccaaaaaggagctatctcccttgccattcagattagcataagttttccttcaaaacatacgacgtgatgggcaccgtcacgtatggggatgtatattttcatgcaagcttttgggagaactgcttggctttaaaatctcatctccttttatcctactttgaaatatttccttaggctctgttcttattcattcattcagcagttattcactgtgtccaatgtgggcagaaccctaggctcctcccaccatggaacatgaagacaaaatgcttcctgcttggggctaacagtgtagtggaggaaacacactgtttcaaaagtcagtacaaacatgcagacatatactcatttactctaagccatggggtactgcacaggaaacaaaaacaggattccgtgataagagaatgaccatgtctcggaagtggaattcctaggtcagagatgcatgcagtcagctgttcattgctaatattattggtaagcacaaagattgggaagccactgttccatttgttaaagtgatataaatatctagatacattagcatattgctcctaatttgaccactgttcccctcttggcacttcccctactggcctttttaaaaatactttaaaaaagcatccagagggcatatgaatataaatatacaattactagtttgctttttcgtttaacttatgataagcattttctacattgccccaaactctaaccatataatcttcctttttgggaatgtattataatttttttttttgagagagagagtctcgctctgtcgcccaggctggagtgcagtggcacgatctcggctcactgcaagctccgcctcccagcttcacgccattctcctgcctcagcctcccgatcagctgagactacaggcgcccaccaccatgcccgactaattttttgtatttttagtagagacggggtttcaccatgttagccaggatggtctcgatctcttgacctcgtgatccgcccgcctcggccttccaaagtactgggattacaggcgtgagccaccgcgcctggccgtattatgatttttttaaccatttcacccattctttggacatctgagtttcaagcgataaaaaggatgaagatacagttttaaatggatgtataatttctaccgtacaatagcagtactcaagaaaaatgcattagcaggaagatatgggtgattttctgttggtataatacatattatttactaaagaggtggggagcaggtccctgtggaccagctgtgactttgcggcagccccactccccatctccgcagtagcccctacccttgttttccctcatccttcagggatgaaccactgcactcaggtctctcgggtcaagcacctacccagaacgagtgatggggcccctagcagttgggaggactctgcccagtctccaggggcaattcctaccaaggttcaagccattgaggcccttgagggtgtgggtttggtgttaatggatcttttgaattttcgagagaaagagcaagattactcaatttctaatgtgaggggttcctgacttcttattgtcagtggccaattcaactttaaaagtacaataagtctgggcacaacacaacacaactgtatgcagaataaggtccatgtcctctgaacagtctgatctagaggaaggagaccgcttaccccaacactgtcggaaggaggggcagcaaggagtgatagaaagaagcagcagcagaaacccaggaggagagaaaaagaaaggtgggggcagcacccacagggagcagacgctgggttcctccccacccctgggccctttacgtcatagccacagctccaggccccactgggccttaactaccacctggttctgttcctgcagattctttttcattccaaggaagagaccatcttccagagccaagggaaagctctactcagacctcccatagcgtgagacttcccagggaacctcctctagcagagcaggctgtccctcctcctgtaggcccagctctctacagtgatggctaaaaacaagctccttttcttcaagggttgtaccagttaaatgctagattgggcacgtgcttcagtcattcatataacttctctatggcaccaccctcagggatttgtgggtcaaaaaggtatcttcagtcacgaaaatttaccagacccaccctagaaaaaaagctgatcttaacctgaaaatcactgttggagacaagaaccacattaaataacccagctaaggcaggggctgaggagagtcagcaaatgcttgttggtatcttctgtgcatttgggagattctggaaaatctttggcaacttcaggaaaaaaaaagtacttttatggcttttcttgtgctgataatgttttctacaaaagagattccgggcatagtatgtctgttattgctctgggcacagtaggtctgttaaaattactgttccagttgttgaaagaattttgttattatttggttgcctgcctttatgtttttcaaaggcagtgtcttatggagtaactaaatattttagttaataacagaccttatctggcatacttttaaacatctatgactataacatttaatagagtttttcatagatattagaaagataaattttggttgatccactcaatatgtgactctttgaagtcatgttacctacactaatcaagatagtgtggtgctggcatgagaacgggcatatacatcaatggaataaaatagggagtccggaaataaaccctcacatgtatggtcattgatttttgacaaaagggccaagtcaattcgatgggggaaagaatagttttttcaacaaatagtgtggggtaactggatatccacatgcagaagaatgaatttggacccttaccttacattgaatgtaaaaataaactcaaagtgatcacagacctaaatctgtaagttttagttacaaaccacttaggagaaacgcaggagtaaatcacaatcttgggttaggcgatgacttactaaatatgacaccaaaaacgtagcagtaagagagaaaattgctaagtccaatttcatcaaaataaaaaacttttgtaattatccagtgtaagatattttgtcataacagtcttggactaagacagaacttatatccagaatatgctgtataaagacctcttagaacgcaacatcaaagagacaaataatacaattaagaaatggaccggggatttaagcagacatttctccagagaaggtatacagatggtcagttagcacgtgaaaagatgcttaacatctctggtcatttgggaaatgcaaattaaaaccacaatgagacagcacttcactcccattaggatggttataactaaaaggaaaaatgggctggttgcagtggctcacacctgtaatcccagcactttgggaggcaggtggatcacctgaggtcgggagttcaagaccagcctggccaacatggttgaaatgccatctctactaaaaatacaaaaattagctgggcatgatggcgggggcctgtaatcccagctacccaggaggctgaagcaggagaatcgcttgaacccaggaggtggaggttgcagtgagccgagatcatgccactggactgcagcctggcgacaaagcgagatcccatctcaaaaaaaaaaaaaaaagaaaaacgatgacaggtgttgggaaggatgtggagaaatgagaatcctcaggcattgctggtggcaatgtaaaatggtgcagcctctttggaagttcatcatttgaggagaggcagttcctccaaaggttaaacataaagttaacttatggccagtcatcccaatcctaggtatctacccaacagaaatgaaaacaactgtccacaaaagacttccatgtgaatttcttagtctgaaagtggaaacaactctgtcagctgattcatagatgaaactttatttggcaataagaagaaatgtagttctgatccatactataacatggataaatctttaaaacattatgctaaaatccagtcacaaaaaaaaaaaacatgtgtattgtatgatttcatttatagaaatgtccagaagaggcaaatttgtaggatggaaagtagattaatggttgcctaagactgaggaaaggggaatggagtgagcgccagtgggtatgggatttctgttggaagtgataaaaatatgctaaaattagattatggtgatggttgcacaactctaaatatactaaaagccattgaactctatacttcattatgttatgtaaatgagatttcagaaaacctgttttttaaaaaggcgagttaggtagcaaatgcacgtggtgctgaagctgttccttttagagccggctcttagcattctgtgtcctgagcattgtgctgtgagctaagagatagaacatgatttctgcttcccccacccctaaaaaaaggtttgggagatcagaagatgtaaaacagaaacccagaatgctcttctaagagttagctacagagtaaataaaagtttgaagagacttcctcaggcaggggaagacagaagtttcatagacaagatgataatagtaagctcactgctccattttttatttttaaaaacttgccacccaactcatagggggcagagactatgtcttaacacagggcctaccagcttcagggtaaaatcaatgaaatctttaaactgaggctaggcatggtggctcacgcctgtaatcccaacactttgggaggttgaggcgggtggattacctgagcccagaagttcaagaccagcctgaacaacatggcaaaaccctgtctctacaaaaaatacaaaaattagccaggcatggtggcgcacacctatagccctagctactcaggaggatgaggtaggaggatgaggtgggaggatggcttgagcctgggaggtggaggctgcactgagccatgatggcaccactgcactccagcctgggtgactgagtgagaccctgtctcaaagaaaaaaagtttacatgactatgagtatgttccataaatgaatcctttgaatgttatatatgctatgaatatttcacttagcctttggcttattgttttttgttgttgttgtgacattgtcatgtaaaagtttgtaatttttacatagtaaaacttatttttttaaaataagtttttaaagtttaaataaaaattatttaaaataagttttaaagctttagatcacaggtccccaacccccataccggtgacagtccgtggcctcttaggaaccgggccacacagcaggaggtgagccacaggcgagagaacattagtgccagagctccatcagcggcattagattctcttaggagcacaaaccctgttgtgaactgcgcacgtgagggatctaggttgcgtgctgcttatgagactctaatgcctgatgatctgaggtggaacagtttcatcccaaaaccttcccccaaccatctatggaaagattgtcttccatgagactggccccaggtgcaaaaaaggttgggaactactgttttagatgacatttcctaccctagttataaaacacattttcctataaattattcttctttccttttttacatttaggtgtttataaccctagtccagggcttctcaacctcagcacaggggcatcttggctgggtaactctctgtgggggggccatcctgtgtactgtatgatgcttgctgcatccctggcctctacccacaagatgccaatagcacctgcaccccagatgtgacagctaaaaatgtctccagacatcgccgaatgtccactagggagcaggatcaaccactgcacttgcgttagaccccaagtggttagagagccactgcacttgggttagacccctcttttttttttgagacggagtctcgctctgtcgcccaggctggagtgcagtggcacgatctcggctcaccataacccctgcctctcgggttcaagcgattctctcacctcagcctcccgagtagctgggactacaggcatgtaccaccacacccagcaccaccatacacagtttttgtatttttagcagagacggggtttcaccatattggtcaggctggtctcgaactcctgacctcaaatggtgatccgcccacctcgacctcccaaagtgctgggatcataggcataagccaccgcgcccagtcttagacccctcatttttgcagctgaggaaactgaggcccagagaagtggtgtggcctgagccaggtggcctagacagatggtggcagaaatctcaattcaaaatgcaggactgggaacctccactcctcgttctctttttttccctgtttttcctgtccccagccgtgagcacctctgctgtgctaggcactgggtagctgctggggccacagcagggaagaaaacaacatagacaaagtgatgaagacaagactccaggtcatgattagtgccatggagccaacacagaaagagtgctgggatcccaccagtgacagcatggtcacagggagcctctgcagaggtggctcactcactgacagctctgtgagtgtgggcatgcctttggtgtgtatgtgtgcgtttctaccaccacaacactgtcaggatggtctagaccctgctcgcagtcttgttctgccggggtgtgttgggcgcccccaaggctgccgtcatgcttgggggttttctgaaagacttgagacttagcatatggttgtattcaactaacattcactgcagcagcgtggtatggatgcacagctgggtgttaagggaaaaggcgcatgtagcagagtctggaggaatccacgtggggcttccttacgcgcactccctccctcaaggggttgcacgaagtgaatacttccccccgcaacgaaactgcaacacgtgtgatgtttttgcccagggaagcaaatgagagactcagtacccagagttttggctgagggctggctttataccctcggcctagcatgttccagaattccacactcccataagcaggtaggtgtcagcatagaccacgttgttcatacaaaagggtctaggcacggtgagccaagctactcttgtcagttaaaaaatggcgggaaccctcccaaaatccaagttcccagacaccatccaggcaccagccttgcaagtgatagcactcttaacctgctacgctgacactttgctgtgtgcgggaactttccaaaccaaggctttgaccagaaagccggtaataggaatttactcggagcctgggggccactgcttggggctgagagtgggggactgaagcgtggcctccccattgactggtgatggaatctgccctctcttgtttgccctctccagtgtggggctgccttccaggaggatgatgtcatcgtgctcaatggcaccaaggaggatgtggacgtgctgaagacaaggatggaggagagaaggctgagagcgaagctggaaaaggtaatgggagtcttcaggttccgcccagcccccatctctgctccagagccgactgcaaatcactgaactgagctggcagctgcttaggggtttgcatgatcaaggcgatttttataacctagaagggcctggactgtagaagcagattccagctgaggcccaggcactgccttgctgtggtgagcacggcggctctgctcttccccgccgagctttctcatcagtgaagtggggtagtgacagcatgcgagggcacggagctgtcagcaggctccagagaccatggccataaagcactgacactgacacggcctcagcaagcccttggggaagggcagccaccaccgttgctgctgctgtcacttactgttgctgttgatttaaggcagtacatactcaggtctcatagcttgtaaaacaaaggaaaaatgaaaagtcaccatcatcccagcaaaatgtaaggctcccctgctgcccagattggaatgtgctcgggagggccctggcagtctgggctccagcaggcctgggtgggcctgggtgcctgtgcgtctcacccactcccagggcgtgtggatgcaactcctcagggtcacactttgaataacaaggagctaatgagtagccttcccaaaaatgggggccaaatccctcaccttcctgagccctcccacggggagagggagggtcttttatggagcgtggtgcttcatgcttcatcgttcagaagggagcgtggtatccagaaacagggaaagcattgctgagtaacgtggcggagtgagcaggctccagacaacgcatccaccaagagttcttccatgcgctggtgattccccatccagcagtaaatgttgttcatgtttacagatgatagctatggaatacaggcctttcgtgagtggcaaatttcttattctttaaaaaaaaaaaaagttgggttcaggataagctagggagaaaactttatgtgatcagaactaaggcaaaagaatgcttgaagtactagaaaattagctccagtaggctgaggacataaaattatgaaacaaatcgcctgccctcgcgtgggtgtgcattttaccagtgccagtccgaggcgagagtgatggagtacctgaagatttttcagaggtttggggtttttaaaaaatcataacaagacaggaccgtatcaccctggaataatgtgtaattcgtggttgtgaggctttaaaaagccgaggcttgagcacatggtagcagtattaccattatgcatggatccagaatgatcagaaagagccaaaggcatttgtattttctcccttcatcgttttacttaggtagaaaataatgtctgaaaatggctctgtagttcaaggaacggtgcccaaactctgaattcagatgcgagtagaaatactccgtggagcaatattataagatgttaatacaacattcctaacaactgtttaaagagtcacttggtaggcgggcgtggtggcgtgtgcctgtaatgccagctactggggagactgaggcaggggaatcacttgaacccggaaggcggaggttgcagtgagccgagatcgcacctctgcactccagcctgacagactccctctaaaaaaaaaaaaaaagccgcttggccattgaaatgctgtgttcaggttgaaaagtaaatacatgtgtatcttatataaagtgtgttaattctaagttggttttctaaattactatgatttcattattgtaagagagaaaaaaagagggaaactaagtttgaggtctttttaactaaggacagttgccaaaagccatctccctgttcttaattgctaccattgatcaagctcagttttaaaaaacacaaaagggcagccgggtgccgtggctcacacctttcatcccagcactttgggaggccgaggcaagcagatcacttgaggtcaggagttcgagaccagcctggccaacatggtgaaaccccatctctactaaaaatacaaaaattagctggatgtggtggcgtgcgccagtaatcccatgtactccagaggctgaggcggaagaattggttgaacttgggaggcggaggttgcagtgagccaagatcgtaccactgcacttcagcctgggcaacagagtgagattctgtctcagacagagagagagagagagagagacacacacacacacacacacacacacagtgagattctgtctcagacagagacacacacacacacacacacacacacacacacacggaaaaaatgcatttcaaaggaaactactagaaatgttcatattccctttgaccattttgctttcgtgagttttctctgtcacaggtttcctgccaagttaattcaaagcccagtgggactaacatgctcctctctgcaaaatattctccagagcttctgggaatacctcatagctactgctaccaggataccaaaatatttcccaaatacacttgcagctggaagcaagatataacatttcctctctaactccttcttgcctgtgcttttcaaataacctcagctgtgaatggagggcttagaagtaaacagttgtctcttatttgtttgaaggaccgagtatcagttttcacagatgtgaatgcttgcattgcatgtgtgaaatgcacagaaggtctttatgttctgttataaatcacactgcatgtatatgttagaaattcaaggcctgagaggtctttctttaatgctcagtgctgggagatggctgaagtaatcaggctgcctatttttagtgccaccttttggatgcttaggaaattgacattttaaagtaaattaaatgaacatagtcctacttgtcatttctgcgattaaatcaattccaacgcagctgtgtgaccgtagaatggtttgttttattattgctgatcaaaataactattatgagtagcagaattctagtgcctggaaatctaacaagagtagttttgagtttagaagaattagctcaactgtctttaatataaacttcaaggccttacacttgaataacaaataccaaagcagtttgacagctttgaaaaaaagttagtggaatgtgcaagatttagttggtgtttatgctggctggacttcacatacccatatatactctgtgttactcatttaagtgcgcttttgtatacagttgtcaccatcaacattggcccttattactgaaatctgtcagcctcatttaaatttttgcaaatgtgatttgggagatgtaaatataaaagtgagcagctctgtgcagatacatttttgtgtgaggcagaagtgcatgactggtgtcacatgcagagggtgaaggctttaggagttacggaacatcaaaagccttcttcagagtgactgtctgtctcatgtgactagcatcggtcagtcagacagggcacccgggacaatgggcagccacactgacgctgaagtggagtgaatctgagcacagcctccaacattctctatctttttgtagaaaacaaagaaacccaaggcagcagagtctgtttcaaaaccagatgtcagtgaaggtaagatccttcaagagatccttattttagcaaaatgcgactctagggcagtctgctaatatgttcatgctttgttttgcattgtttttgctttgcctactttgtttcttttacagaagccccagggccatcaaaagttaagacagggaagcctgaagaagccagccttgattctagagagaagaaaaccaacttggctcccaaaagcacaggtgggtcctgttgtagctacagggagctgtttcgagaaggctggaaacccaggtggccgagtccaggtttcactggagtgggtggatgggaagcccaagcctgtcctatgtcatgtctctagagagtgcactgaactctctttaggggggtaactaagaaatattgaacacaccctcatcaggagccgtggcaggagtgatggggtctgggcacaaatgctggttgtttagattcctgtcgagtaagtgcttggtgccaagcaaaagaggttgcgctgagaactggctcagatgttgcacagagactgtcagatggactgtggctcagggcctgcggggaatgcccccagtttctttactcttggggctttcatgggctccacgtgtggctctcagagtcccctctctgctgcctcttgaccaaggatcagtttctcctaaaactcactctctgtaactcaaagaaaataccatttatttcacaaaaagaaaaatacagattcattgttaagagtgtgtgatcttgtgctctaagtagcatccagggtggctgacaggctcccatcccggctctacatgggacagccactcaggttcctgtgcccatttcctcccctggaacgcaggccctgcctcatcaggacaatctaagtcattcacggggctgggaccagtgtctgcgacagagcaagacagtaaatgatagatgtgttgtgctgtgtctgctttgctggagttggcaattaagatgacgtccgccagcactcacacagccagcaagagaacgtctgggacagagtgactgatgggcttcccttctgaggatgcgaagtttagaatcatctttatcccaaccctgacagttttggctcttcatttttctagcaatgaatgagagctcttctggaaaagctgggaagcctccgtgtggagccacaaagaggtccatcgctgacagtgaagaatcggaggcctacaagtccctctttaccactcacagctccgccaagcgctccaaggaggagtctgcccactgggtcacccacacgtcctactgcttctgaagcccgcactgccaccgctcctgccccagaaggttgtttagtttccacgtaggcaggtcgctttgtgcctctgagtgcgctgctgtgtgttctctctatagttctgtgtcataaagctgtcctggccagccttcaagctggtgtggccactcttgatgtgaggcgtgtcggttccaggggggacatgggaggggctgcacagtggcccgaggtcatgcttgcttccacctgcaggtgcatttggtcctttccatggccaggaagccctgtgggctgcactttttatgcttgcagtaacaagagactccagagtcctcaccggtgcagagttggcacatattaattaactaaaattctaatgatcttgctaccagcaataaatcaagtaggccaagtgaaactgggctttaaaaaggatggatttcaaatacactgtgcccactagaagcttcgaagggcctcgtccctctgctacagccctgggaggagccaggatccttgttggtctagctaaatactgttaggggagtgtgccccatctcatcatttcgaagatagcagagtcatagttgggcacccagtgattgggttcaaaaataaagctggtctgcctcttctctcctctgtgtttttatcttttctaccttctgctcatgcttgggtaagaacattgcagccgttgcattggtgattacaggagtcattccatgaagtcagaagaacccacccttctctcctccagcagatggtaaagggagaatcgtacccaaaaagaggtgcattttatctgcctataagttgtgttgacgtcaatagctagtgaaacttctcatgagactcctaatgaagaaccaagagccacaggcctctgcgtggctttctgcacacggtggtatgactgagatagtgactggttctctatacagaccccggggccctgggtttccttcagaagcagaaggagctgtgggaggtgaatggtgggaggtgaacaggcaggttctgtgggagacacagacacgtgggcagaactccagggagaggccagcaagggagaaccatgtgtggccctgctttttctcaaaccctgtgtggttcccggcttcacagttgatgggaaggtttggccccaaggatattttgacattgtgagtatagagcattttaataaaaattaagtgatgcgtttttgtcatggacttttccagaacaaacctggattagccatttaatttccccaattttctatacagccaaactcaaccattttctcattgtttttatttcccccttttttttttttttttttttttaaattttgaaacagggtctcactctgtcatccaggctggagtgcagtggcatgatcatggctcaccatagccttgacctcctgggctcaggtgatccacccccctcagcctcccgagtagctgggattataggtgcgcactaccgcacccggctaattttgctattttttgtagagatgaggtttcgccatgttgcacaggctggtcttaaacttctgggaccaagcaatctgcccgcctcggccttccaaagtgctgggattacaggcgtgagccacgctgcctgggcccccttttcttttaatgaccattatttttaccaggttcggttttctgaatgttagcctgaatcagttttattttgcattgaatgtattgactgtgtccagttttttctggtaactgagtcacagcatcctcaacacaaaaattacagcatctcaaagtcctctgctttgggcctctctgaaataaacaggctgtgggcctccctccagctgccctcaggaccatccatgcaggagggatcagggtttccttggagatttctagccagcctttaatattttgctaaggcaccactcttcaaggctcctggccagcttgagggaagaaggtatccatgatctgtgctcctgctgggcatgaggcctcaatacaccaacggctggggagggctgatcattcgcattatttttagggctcactgagcagccaagcacttgacaggcttcttcccctgggactccccagccacccagtgcaatgggaagatggccatcccccactttataggtgaggtgcctgaggcccaaagcagcaaggcgaatgacagttctgcctggccacaccgcaccttctccccattcagtccgtaccaaatgaaggaatcagtggcggctggggcaggctcccacccaggcgccgagaccacgggttcaggtgctgtgcccaagaggaaagtggggcatctcctagctctccctcctcctccgtccacctccaggacccaagctgctttccaccaaggagggagctgggaggagaaaattgaaaagatgttgaaattctccaaaatagcatctattcaatttcccacagtatcggaggaaccagcccccaatatttcaatgtaggttcttttctcttttccctaagcatcggccggtctgagaaagagtacaaaagagagaaattttacagctgggtctctgggggtgacatcacgtcagcaggttctgtgttgctcccgagccgcaaaaccagcaagcttttattagcaattttcaaaggggagggagtgtacgaataggttgtgggtcacagagatcacatgcttcaaaggcaataaaatatcacaaggcaaatgggggcagagcgagatcaaagtccagggcaaaattagaattgctgatgaggtttcatgtcccactgtgcacgcattgtcattgataaacatcttaacaggaaacagggttcaagaacagacaaccgatctgactagaatttcaccaggctggaatttcccaatcctagcaagcctgggagagctgcaggagaccagggcgtatttcatcccttatctacaactgcataagacagacactcccagagcggccattttagagacctccccctgagaatgcattcttttcccagggctgttccttgctgagaaaaagaattcagcgatatttctcctattcgcttttgcaagaagagaaatatgactctgttctgcccggccccgcaggcagtcagaccttaaggttatctcccttgttccctgaaaattgctgttatcctgttcttctaggatgcccagatttcatattgttcaaacacgttttacaaacaatttgtacagataacgcaatcatcacagggtcctgaggcgacatacatcctcagcttacgaagacgacggaattaagagattcaagtaaagacgggcataggaaattataagagtattgattggggaaggaataaatgtccatgaaatcttcacaatttatgttcttctgccgtggcttcatccagtccctccatttggggtccctgacttcctgcaacaccacagcacttcatttccaacaaatgaaatgaaagctgtgccaaaatgaatgaaagaagtgccgccccaccccacagcccagacaagtttggctcaaagatctggtctgcttacccactggtcctgctctattggagagtgctgtagacttttgaatacatataggaaaaagtgattcccattattaaagactgaacatttccaaataacaaaatcacatgtggcaaaacttgtgagcatttctgttgtttggggccattcctgtaaaccacgtctgtttgccccttactgctccatcgcaccacagccaccaaacttcccagccgacttaagacacgggctgactgagcactgtggctcccgtctgcagtcccagcactttgggaggctgaggcaggaggactgcttgagcccaggagttttgagactagcctgggcaacacagggagaccctgtctctaccaaaaatgaaataaaaattatccagaccctgtctctaccaaaaacaaaacaaaaaaaaacacaaaaattatcgaggctgcagtgagccaagatcattccactgcactccagtctggatgacacagcaagaccctatctcaaagaaaagacacaggctgtgtatggacatgggggcctctgaaaataattagccatccctcaaagctgctggaatggggaacactggggacagggagccgcatgatgccaaggacaggcctccaaactgaggtcacagggtggcccaaggccctggaaatcagggcagctgcctctacagtgggtgtaattccaggcagtagctgccaagctgagtgggcccctgcaagaagagaagtgcccgtcttctggtcaacctggagatttgcatctctccatcgtgcccagtctctggcaggaagccccactccccagccgacactgcaccatgctcatggaggaagaagctgtgcagcacagcccaacagcgttttcccctttcggttttctagagtagtcttgcagaactattttttggttttttttttttttgagagagtctcactctgttgcccaggctggagtgcagtggcaccacctcagctcactgcaaccaccgcctcctggattcaagcgattctcctgcctcagctccagagtagctgagattacaggtgtgcaccaaaacacctggctaatttgtttttattttcagtggagacaaggtttcaccatgttggtcaggctggcctcaaactctttgacctcaggtgatctgcatgccttggcctcccaaagtgctgggattacaggcatgagccactgcccctggccatagtcttgcagaactactttgtcactccacagagatcagtagtttaaggcacagcgaaggtgcccagctgaactttgattatttcctgtgcagcataaagttctgctcctcgggagtaaatctgcaaatcagagccttcctcaggaagatagctctacagatgacccaggggaacaagtacaagccgtgcgttccagcacccaggatttcttgtttcatgtcattttaaagaacacatggtttcgagtatactatggagtcctaggtttattcccagccttggcctcagttgtcaagctagctgttcctttttacttgggggattcagccccttcccattttacccaccaactcttaatcatctcccctgctctactcaaccatctttttctggacactcttcctgcttcctgcataacctagtttagagcagtccccttatgctagtctctaaagcttcctgttcttatcacaattttaatcaaagtatactctctctctttttttttttcttcctgagatggagtctcactctgttgcccaggctagagtgcagtggtgcgatctcagctcactgcaacctctgcctcccaggtccaagtgattctcctgcctcagcttcccaactagctgggcctacaggcctatgccaccatgccgggctaatttttgtttagtagacatggggtttcaccatgttggccaggctattctccagctcctgacctcaggtgacccacctgccttggcctcccaaagtgctgggactacaggtgtgagccaccacacccagcccaaagtatactcttaacccagggtgggcacacactgctacgatcaatgatggtgtgaggtaatagtgagtggtggggactgtggagggaatatggccaccgaaaggacggtttcacttggctgcagcagagagactggttccatgagggtgtgcactcattgtttctggacctcccatattttcaaaggaagccagaatgtggagttttaaagtgaaatgccccccaatatttaagtactgacaatttttaaaaacaatgtaggccaaacaaaacacataggtgggccgggcgcagtggctcatgcccgtaatcccaacactttaggaggccgaggcaggtggatcacctgaggtcggaagttagagaccagcctgaccaacatggagataccctgtctctactaaaaatacaaaattagccaagcgtgatggtggatgcctgtaatcgcagctactcaggaggctgaggcaggagaatggcttgaactgggaggcggaggttgcggtgagctaagatcattgcactccagtctgggcaacaagagcaaaattccgtccccaaaaaaaaacaaaaacaaattttttgtttgtttagtttgagccacataggtggctccaaatttgtaggtagcctgtggtttaatatctttctctcccgtttaactcagctccacggggcacatggcatctccctctgctcatcacaatgtctggatcaaacaaatgaaaaacaaaaacatgatggcctctcccagcaaagctccagggttggaaagagtcccctggcagggaattggcaccccgtcgtgcccatcctctctctctgactgcctgctggaaatgcccccatctccctttgagtcctcctcccgggcaacccctgtgacctgtaacctctgtcctgaaatcatcacaatggccagagtggcctcagctcagggcctctgtgacatcaccaagggcctggcaccaggtgcccagtctcccagttgcgagggcaagcaaacccgtcatgagcaactcccttccccatctctgctcaccatgtggacgctgaaatcgtccctggtcctgcttctgtgcctcacctgcagctatgcctttatgttctcttctctgagacagaaaactagcgaaccccaggggaaggtgcaatacggagagcactttcggattcggcagaatctaccagagcacacccaaggctggcttgggagcaaatggctctggcttctttttgttgttgtgccgtttgtgatactgcagtgtcaaagagacagtgagaagaataaggtaaggatggctccattttttttacaccatattgattcaatctcaggagtctcagggaaacggatgttctagtgagtctagacggcaccgttgggtataatgaaccgacctcatggtcctgggcaaagctggcaaattcacttcctgatgtatccttagtgaagacaattgtccccagatccacagatactgggacaaagagtggaaagtgacctctgcttactggctcacagattttctggttagatggattttttcaaatgtaggatagattcaagaacttatggtgtgtttcagaaagtcaaaattattcacagggccagattcactagcccctgttttttaaattcttgctagtgtttgacttactacaaaatcctgagctaaatggaaatgatatcattatcccaacaaaatatgagacttgtgctgaagagataaagatgtaaggtagtttgagctggtcctcaaagtgaccacaaacaactctttcaggtagaaaaggaaggggagagaaagtgcgttctcccctagaaagacccagcacttcataatcctgtgcccaaactgatgagagcagggatcggcaaacccttcccgtaaagggccagggagggtgcgaatatcttcagctttgtgggcagtatggtcttcttgcaactactcaagtctgctgttgtaacacgaactgtgtcaaaaccaacaaagttcacaatattactgaccttgagtatctttcctgacaggagcagagtcctcctggccttcgaggcggccaacttcactctccattaaagaaaaaaagaaatgcttcccccaacaaagactgtgcattcaataccttaatggaactcgaggtggagcttatgaaatttgtgtccaaagtgcggaatcttaaacgtgccatggcaacaggtagtggcagtaacctcaggcttcgaaagtcagagatgcctgcagatccataccatgtcacgatctgtgaaatatggggagaagaaagctctagctgaatggatttgtgtgtcaggagagaaaaaagttgagtgttgacaaactgtatgcaaactaataaaactattctgaagaaaagaacttccatgtttgagagcttgcttcttttctttttttcactagaagaaaaagtgaatgggagaccagtagccatagcagtgatggttttgtttttgcctctctcacgtcatctagagctgtgggtggtgagaagaacaccgaaagctacataatagtacgtgatgagctcgtgcttctgttcaatggccgcgggtggacgatggagctagggaaatctgggataagatgctgacgtcacttccatacaaactcttgctctctatagcatctatttgtgcaagatgcagaactgctttttatctttgatttattacaaaagacagcattaatgatagttttaaaatggtaaaatgattcaattaggaggggtgtattctagagttatctgattctctcaccacaagagtcctttcactcattccctgtcaaaggttccgtgtatattgacttttccttctaccacactagcagttacatttgtcaataattggatttaaaaaaaaaaaaaaggggatgaggcaggagaatcgctcaaacccgggaggcagaggttgcattgagatcgcaccgctgcactccagcctgggtgacagagcgagactccatctcaaaagaaaaaaacaaaaaggagaggcccggcatggtggctcacacctgtaatcttagcccattgggaggccgaggcaggaggactgattgagcctaggagtttgaaaccaccctgggctacatagtgagaccccatctctattattttaaattaacaagaaaacggagaaaaattcattcatcctatgccattggagttttggatacaagtgtgctaaccaggggctcccagattaattgacatgttctttatcctacttattcaaaatgtggatattttacatgttactgtggctgatggcatctctgtacatacttaggtgcttgcctaatggtgatttctattttcctctctcctacagtgtttattgattggaattctgctgtaagaagagctgttccttcgccgatgattgatggatgggtttctgtatggacttacaggtgtgtttttttttttggattattttctggctccacctttcccacctttggcgttaggagctgcttcgggttggcacttgtgttctgtgagcaagccccttcctcttttgagcaattccttactttctggcaacccaagatgctccatgctcatctggttcattgcctgccttcatcctggaatcagccacttccccaaggggccaggttccctttcttggagaatggtgacctgccctcctgcagccaggatcatgacttatcttaaaatccttcatttaattcatctgcaaaatgtctcttgccacatgaactgcaggcccacaggtcccaggaatgagtgcataggcatctctggggccggtacccagttgaccagtgctgtcaccctcacaagcatcaaagtcacccagggcgcaaggaagaccaagaccatgaggcaggaggccatggcttctgcggctgcagcagaagcaggagagggaggcagggcagacagcagcccagatgcctggggcctcaggggaaggaggccctgcctcgaaggcataggcgtccctcaagggtcccaaccccgggccctgaagggtgggcagcatcttcccgggaagaatatggtggctgggcatggtggcttatgtctgtaatcccagcactttgggaggccaaggtggacagatcacctgaggtcaggagttcaagaccagcctggccaacatggtgaaaacccgtctctatcaaaaatacaaaaattagctgggcatggtggaagacacctgtaatcccagctactcaggaggctgaggcaggagaatcacttgaacccaggaggtggaggtggcagtgagctgagattgcaccactgcactccagcctgggcaacagagctagactctgtctcaaaaaaataaataaataaaaagaatggttacccaggtgcggtgctgtgcacctgtggtcccagctacttgggaggctaaggtaggagcatcttttgggtctgggaggtcgaggctgcagtgagccatgattgcaccgtagtgctacagcctgggtggtggcgtgagaccctgtcttcaaaataaaaataaaaataatgtttgggggctgggcaaaatgattctcacttgtaatcttagcactatgggaaattggggaaggcagatcacttgagcccagaggttcaagaccaccctgcacaacatggcaaaaccctctctacaaaaaaaaaaaaaaaaaaaaaaaattagccgggcatggttgcatgcacctgtagtcccagctactcaggaggttgaggtgggaggatcccctgagcccaggaggtggaggttgcagtgagctatgattgcaccactgcattccagcctgggtgacagagccagaccttgtgtccaaaaaaaaaagttggggtgctttagtccttaggagtagtcctagggaaacagaatctctctctctgactttctgtcctcctttccctgcccaaggtaggactctaatcagattgggagcccaaagacctcattcgagagggtcatgccgcataccctagagcaaggaaagctgcacagagagaccaagaggaatctggacaggccctgatgggttccccaatcagtctgttaatatgagagcatattaatttttggcccaatcacatttcttcatgatt

SEQ ID NO: 1295 - DNA, 1596 bp, Homo sapiens
cggaaatcccggaagtgacagctttgggggtttgctgctggctctgactcccgtcctgcgatgggttgcgacgggggaacaatccccaagaggcatgaactggtgaaggggccgaagaaggttgagaaggtcgacaaagatgctgaattagtggcccaatggaactattgtactctaagtcaggaaatattaagacgaccaatagttgcctgtgaacttggcagactttataacaaagatgccgtcattgaatttctcttggacaaatctgcagaaaaggctcttgggaaggcagcatctcacattaaaagcattaagaatgtgacagagctgaagctttctgataatcctgcctgggaaggggataaaggaaacactaaaggtgacaagcacgatgacctccagcgggcgcgtttcatctgccccgttgtgggcctggagatgaacggccgacacaggttctgcttccttcggtgctgcggctgtgtgttttctgagcgagccttgaaagagataaaagcggaagtttgccacacgtgtggggctgccttccaggaggatgatgtcatcgtgctcaatggcaccaaggaggatgtggacgtgctgaagacaaggatggaggagagaaggctgagagcgaagctggaaaagaaaacaaagaaacccaaggcagcagagtctgtttcaaaaccagatgtcagtgaagaagccccagggccatcaaaagttaagacagggaagcctgaagaagccagccttgattctagagagaagaaaaccaacttggctcccaaaagcacagcaatgaatgagagctcttctggaaaagctgggaagcctccgtgtggagccacaaagaggtccatcgctgacagtgaagaatcggaggcctacaagtccctctttaccactcacagctccgccaagcgctccaaggaggagtctgcccactgggtcacccacacgtcctactgcttctgaagcccgcactgccaccgctcctgccccagaaggttgtttagtttccacgtaggcaggtcgctttgtgcctctgagtgcgctgctgtgtgttctctctatagttctgtgtcataaagctgtcctggccagccttcaagctggtgtggccactcttgatgtgaggcgtgtcggttccaggggggacatgggaggggctgcacagtggcccgaggtcatgcttgcttccacctgcaggtgcatttggtcctttccatggccaggaagccctgtgggctgcactttttatgcttgcagtaacaagagactccagagtcctcaccggtgcagagttggcacatattaattaactaaaattctaatgatcttgctaccagcaataaatcaagtaggccaagtgaaactgggctttaaaaaggatggatttcaaatacactgtgcccactagaagcttcgaagggcctcgtccctctgctacagccctgggaggagccaggatccttgttggtctagctaaatactgttaggggagtgtgccccatctcatcatttcgaagatagcagagtcatagttgggcacccagtgattgggttcaaaaataaagctggtctgcctct

SEQ ID NO: 1296 - protein, 306 aa, Homo sapiens [sequence omitted]

SEQ ID NO: 1297 - DNA, 28796 bp, Mus musculus
  misc_feature (1)...(28796): n = A,T,C or G
gctaccatggggctctgaagggcgctgaacttgacctcctctgtttctgatgtttgttgtgaagacggtactgttcttttagaatttacagaaaaccccggataaggttgcagaattcagattttcaagacataattttatgtatatggtgttttgcctgcgtgtatgtctgtgtgggattatcaaatcttctgaaactggagttgtagtcaggtgttagctgccgtgcaggggctgggaattgaacccgggtccgctggaagagcagccagtgctcttaaccaatgagccatctctccagctcccctgtccccctttttaaagatttatttattttatatgagtacactgtagctgccttcagacacaccagaagagggcatcagatcccattacagatggttgcaagtcaccatgtggctgctgggaactgaacttaggtcctctggaagaggagtcagtgctcttaacccatgagccatctctccagccctgattaggtgtgttttgaggacgcagtgtgatgttgtgttacacatatatgtcaaataacgatcgagtctgggtattagcattgctttgcagtgggaacgctttgcagagtcttagtccactctagtctccgtcctgtgcgcaacagcaggatttacctgtctcaatccaactctgtcccattggttctcctttctcctgtcatccccctgtctcagtccccaacacccaccatcctattttccctttggtaagagcagcttcctgtttgcctctgtgtctaccttactccaccgaccataagcacatccatttgcacagacggcaagatttcctccttaacagtcgaatagcaatcccagttttaaaatccattcctgggtcctgggcattcggctgttgtatttcctagatgaagagagtaatggtgcggtggagtggctctgcagacagatttccctcccttcgggtatgtacaccccacaacgagattgctgggtcacagatttggggagtcttttgggtgagcaggagaggaagaagagagctttgagtggaagcagaggttgtgggtggtgggggctggacctgccctgctcctgctggtgctcctgctcctcctcctcctgcccctgcccctcctcctcctgttcctgctcctcctgctcctgctcctcctcctcctcctgctcctcctcctgctcctgctcctcctcctgctcctgctcctcctcctgctcctgctcctgctcctcctcctgctcctcctcctcctcctgctcctcctgctcctgctcctgctcctcctgctcctcctcctgctcctcctgctcctgctcctgctnnnnnnnnnnnnnnnnnnnncctcctcctcctcctgctcctgctcctcctgccccagtgcttgcccctgctcccgatcatatactccctgcttctctacgaaacggcacttgagttgagagcttgggaatggggaagattgaggaaggccctgtcagcccagatggagagtcttttctgcctaccagacccagaaccgacagaggagaaggcactatgtcctatctctttaccaggaaacacattctccttgaaaattacaggcaggccctaaccgactaccccctcccgtgcctctccccaaagacaaagctattagattctatgtgtgcagaggtccctgagtcccaagaagccagagggtgcagagtggacacaggagggttgatgtactaaccacatggagggccagcacctgccctttgagcttctggtataatctgcctgtagtgacaggaatcctgggagaggcccccggacagtgccagccccatcccatggccccggagactgccagatgcatttgtttcttctcactgctcaccctccttaggatgcttctacgtgtgacttcctgtgagaatttctgctggccaggaagttgtcccttccaccccaccctccctcccgtcctcgctgcaactgatgcagatgaggagggctagggcataatggagcccttgagcagcctttgcatgttcacaggtggctctggacagaccatggtcatggagaaatgctcgggtagacccagcccttgtctgagcacaggcaaacaaggaacgaagaagcagacagctactgagcagggtcaagtgttctgccagcacgtcacagtgctatgtccggggacactacagtcccaggctggagatgtcaggggcactgtggggagaagtcacactcgacctctggaagatgagtagctaggtctcctttggtacctggtctgcctgtcactgcaatccaggcccctcttaagccaaagagagtagagaaagagagtccagtgttggggattgggggaagctgtacagcttgtactagggtacccaaggagagagcagggcccgatcctcctcctgtgctcactgaagctggcctggccaaggagaaggtaaaggtagaaataggtctccagctgcctgaaagagataggaagggcactagcagccgggcggtggtggcgcatgcctttaatcccagtacttgggaggcagaggcaggctgatttctgagttcgaggccagcttggtctacaaagtgagttccaggacagccagggctatacagagaaaccctgtcttgaaaaacaaaacaaaaaaaaacaaaaacaaaagaggaagggcactagcccttgactccccatggtgaaagatcctggagctcacagttggccatggtacagtctaaaagttgtgtatatctaagaagaaaagcttcgagccgtgagtcggtggctcagtgggcttctcagccacccgtttattcctcctgcggagctgccaagtctgggcgctgtggtgtgtgaggcagtaggagaaacaataactaaggccccgttcctatcctgaaggacagcatgcctggttctgagtgtctgcaggctgctctgacggcgacaggagagcgcctctcactctacctgggggacagaggtgtgtgcttgtgtatcccttccccaggtgggggaccgaggggggacatgaggaaggacattccagaagggtggtgtgtgcagagcaatggagcatgggtatggaaagcatagtcaaccgaataggacccttccagaaggcctgagagctgactctcaaaggacaagagggccgggcgggcatggtagcacacacctttgatcccagcacgcaagaggcagaggcaggactctgagttcaaagccagcctagtctacatagtgagccccacaatgacatagagagaccctgtctcaaaaacaccactgaaagaaaaaggggaagaggaggagacgggaggcagacaccagtggcctgtggactggcccctggagtttgtgcttcctgtgagggccatgctcacttgagggattgctagcatgtcagggcgtcgtgttggaagcaggctgaggttgggcataggtgcccatcacagttggattagaggctaggcgttacctctgcttccaggcaagactaagacatgggtgccttccaggctgccctgccagtgtgctctttgacatggatggagaactttggtgagtaaggctcacagcatgtgactcttaccatagatctttctggctagaatgaaatgttgtacacccttgaccactaacctacatcccagcaccaaaaccaaacaaaagatgctgcaagggcccagagcccaacacgtagcctcctgacctggcttcctgtaggttttgcccagtttggccccagaaggccttctcccgcttcctgcattccagaatctgtaggaatgttctctgagttcagtcactgtccacagcatctgttctttggcagcgtgacttcgggcctgtctgtcctcctcggttctggccaccctgaaggccccaggcctacagcctttctgacatccagctgggacagggtgtcagtgaggagagttctggcggctgctgttgccccaggcagcaagggaagccaacatccctgtgtctcatcctccagcagggtcaggtggcagggcggaggctatgggatctgcccactcccagaagtacagctttccctgatggtgaatgcgtttgaggccctgtttatgacgtctgcaaacttagtcaaccgttgcctctagttcttgaaaattcccccaaggcacacagtggctaaatgcctaagataggggcgggatgggaaagcagagggtagcaggaagtccccagttgttggtctgccttgggactgagggtcaaaccttggacttcagaaagtgggcagcccccgaattagacctttcagcctctggctgtagaccaagactcatgccagaacagccctcctccccaatgctgtgaatggagtaggtgttcacacatgctgctgtatggcgcctgcacagtacaggaaccacagtgccttggtgcgggaacaagtactaaattaggccccgcctgaggcagggcatccagctgtcctgggcctgaagttgacaaacctgaagactcaagagacccaaagtacatgcacgaagcccactggaggggtcatggctcagtgggacgggaggtcagtcaggaaggtccaaatcctgacagtgcctggtgcaggctgggtaaccgcagccatgttcaggtaggaagccatagggtgcctggaaggagtttgctgagaggattctcagggctggcctctgaagttatgaagtgacatttgcctctgcctttggctccttctagtgccctgtgtgttttgacaatcacctcagcctccatgttcttcaggatagggttcaggacactgatagatggtatctgaggtggtcctgggctgcaggacaacaggccagtggggagaggcagtgagcagagctgtgttgacgccgtagcaggagccatccaccatgggctatgctgatgctacatgtgtgatgtcaactcgggctcagaggtcatctgatgctgaaactgaacagctccctccaacccctggtcttcccaccctaacccaagttaccaggactcctacacccaccagggactgctccgtgcttctgactgctaggccgcatgtccttgactgcttttctacctctatataaagcctcccctctcagccacgacttccctcctctactgctgccatgttgggcccagtcctctgcctctcacttgggtctctacaggagctgcctgctcctgcttgcccacgtacagtctgttattgacacggaagtcagagagagttcattcagtcatcagtgggatcttgccactcatctgctcccatcctcctggatgccgagattctccacacagcttgctccgcattccctctaccctactctgaccccagactctctctctctagcactcaggtccgcctcaggtcctttgcatctgctcttctcccactgacctgccccctccacattctaccctgagcgtctgcagtcttaccttcttagggagctctttttaataagtttattttttattttatatgcattggtgttttggcctgcatgtatgtctgtgtggggttatcagaatccctagaactggagttgtgagctgttatgttggtaccgggaattgaacccatgtcctctggaagggcggccattgctctaaccactggaccatctctccagcctcatttctaatcaccctgtttaaactcatacctcttccgctctctgtccttcctactggattctcctctactgtacctgttggcatctacaatcctgcccattttactggctgtacatccatcaaaaggtacaaggcgaggctggagtgaggctcagtggcagaatgcctgcctacctgttgattgagggaggaaaaatcatttgcaacctaggtctcagggaggggacaggactggggaggacctcagctagaagtggggagcgatgtcactgtgatgggcacgacaccccagaaattgctacctcaatttgagcaggtccctttttgtagtctgtgggtgctaactatagctctccataaacaccattttcctcctcgctggctccccgatggcctcagagtctggcctttcttgtgttctcatggtgcacagtggcctagcaaggcctctctttccctcaggcctggctcctcctcccttcccctgtgacacccttgtccccggcaccaacaggaagtgctggcagctgccgtgtgcctaggagataaggaggttgtacctgggccagaggtaggaggcaggttggctagggtctgcctacccagtctaccgctctcttgaggggcctccgctgtgacctcccccatgacaccctgctgggtggcacccctacaccacacttctctttccctggcaccagttgcacgggacagacccagatggctctttggcctggggacaaaggccacactgtgcctggccctgggcgggcctcaggctgggtcacactgagcctttctgtccctttctgttggggatgaggggcagacagcaccaaggtgacaggcctttttcctgtctcccttccccctcagcccccaaatctgaggagttgattctcccaaggcaacagtgacagagcatcttgtatcagagcatcttgtgtcttgagctggggaaacaacaaaccattcactgccctgggtgccctgtcacacccaagaccccactatgttcaatgccctaattgtccccagcagagagaagtaggcactctctgctctggtcaccattcctgctgcctgtgttcatgtcaccatcaggaagtctatccttacatctaacctccattcctcatgctgtagtgacagccatttcctcttggccgcttctccagcagagagaacagctggttgctattgctgtgcagtagccctgctctctgctcaggtcaagccttaagcctaagagcctgggtcccgttctgcatttccagcttttcctctttgttccatcccccactccgtcctaggccagctattggctctttgctcctaactgaaccctagagcagatgggattttggcttggtccttgtcttgaagaagtcatccacccggaacaaaagcctgggtgtaaatcatggcagctactgggagatccctgagccagaaatccatcacacaatcccataagcccacactataggatgactgtagggagaactttttaaagacggctctggttgtagagctgaagccatgagcagccaagggcatgtgtctcctgcctccactagaatggccttagccatgtgccccatgtcccttcagctatggtcacacacacacacacacacacacacacacacacacacacacacacacacacagttccctttggcttactcctagagtataaatatgttctccagtcagagcaggtcctcttttatgggactcctgccacagtatctgtctccttcttgtatcctctgcaggtctgggggttcccctcctaacccagatgacagtttggaagaatgagctgacagttagccctcacctgaaccccagatcctgccaaccatgtctctacatgccggctattggagacactgtcttaaaaatatatcttctgcctgtcttggagggataagcctgtaatcgtagccctggagagattgaggcaggaagactggaaattcaaagctagccagggctacatcaaaatacccattgccaaaggagaacgggctggcaccatggatctgtggccgagggtgtctgctgtgcttccagaggacctgagtcccctgcctagagtccataccagacatctcactgatgcctgtaactccagttccagaggatccacctcccctttctggcccccaggggtgcttgcatgcatgtgacacacacacacacacacacacacacacacacacacacacacatatatatatatatatacatacatacacaggtatacttacaaacacatatacatatattttttaaaaatcttaatagtgaggagaaggtggcattttcctcgcaaggccctaggttcagtcccaagcgttaatcccaggccccagttccagaagctggtggtttggatttttttttctgatgtttctggtcatcctgccattcagcacacctggacaacaatggacatgtacccagagtgatcgccgtcctccggtcttgctgggaatgagagttaccaggcagggtgtgacaagtcttcttgtcactgagaccatctgtccccgttgcctccttagagcctctgtgggtcctttcagctagatgccacacatagggcaggtagcaatgtggctgtcttctgggagctttctcccagagttctgcagagagcaggctggggctattagaagaaatgaaaagagtaggactccagggggaacccaggtaggcaaggcaaggaagctggggagagcccgcagcagagtgccatcgttaaccggagttccttgggaacaggggtcttggttagttactgtaacctcgtgtctggcaccgtgctgtaatcaggagatgctccatcagccgtgtgctgaactgacttggactgcaggctgttcagcagaggagggctcagctggcagggcagatcagagccttctgcttggaaaggcccaggcctgggtcaggagagcctgagggcccagctcagtggtggtaggggcagcctggagcgtggagtgccagggagcggaccttttcaaggctcatagaggatggaggatatgatcgttaggcaaagcaaacatgttactgacccataatcctttaaaccaggaggattcaggaggggcctggttgccttggcaactgggtgctagccagccgcaggcctgagcatcctccagaagtggcttataagtaggcccagggaggagtgcaggtggcccctcctaaacagggttagccttcctagtgccttcctggctaggatggggaggtcaaagggttatgtagcctctggtttctgaagccccactgtaggtgaaggctttgtggggcccagcaggatggagatatggttgtgagagagcctatgaagcagatggagggatgagcctataggaaaagcacggtggttcatgcctttaatcccagcattcaggaggctgaggcaagtggatctctctaagttctaagccagcctggtctaaataatgagttccaaaccaggcagagatacgcagtgagacaatctcagaatagagctagaggaggaggagtggagggagggacggagggagagagagagagaaagagagagagagagggagagagagagagagagagagagagagagagagagagagagagagagagaagaacaaagggtctacctgtggaaaacagcatgcagagggccatagaacagggcagctcctgccccactgtgtcctcagcccagggaatccaggcctgctcaaaggactgaggcaacagagggcccagcagcgcaggtttcccctttcctgggctggctgagtttcccacgctgtccctgacttgcacattgcatctggagcagaggtagagctgggccatgcatttactgtcctttgatcttcttcctaaggatccaggatgagccagagaggggatgtgttctggtatcagtaaaagggatcatggagtttgcaacctgctgacaggtggccagcagccaccagccagttaggctccttcagaaagagcagagatggcccgagggccatgcagttcagataacctgccccagagatgtctagacctcctgcccctggaggttgaatgtctgaagtggccccttgcaaacctgtagctatagccattgatgctgtgatgcaggggagggaatgttcatagtcagaagatagccgagactcactggagaaaggaacagggttagagcctgcaatcacggagctgtggctctggtctgagtgacctaagcatgccccgtgcagagcctggctcccatgggtccagactgtccacattgccctcttctctcctctctgtcccaggacccatcttggacccctgctgatcatgaacaagatgaagaacttcaagcgaaggctttccctgtccgtgccccgcccagagaccattgaggagtcgttggctgagttcactgagcagttcaaccaactccacactcagacgaatgagggtgagggtcaggccacctagctcttttccacccaggctccctgtgaccctgatgactagctgacattgggaagaaggggtgggggtgctctgggctgttcacatactctgggtgggaggtagggcctgacacttgtcccactcagacatgccactcagtcttgtgggctgtcatcaggcgctttctcccccacagatggcacagatgagcctgagcagctgtctcctggcatgcagtatcaacaacggcagaaccagcgccgattctccatggaggtgagggtgcccctcccgggctccatgggtcacacatgtccacagcagtaaacttagcagggtggttgctgtagagcctgccactggggggctcaaactggtgcagcttatggtgggggttcagtgagaatatatgtcaagtgctaaaacattcttggttagacaattgactgtttttatagcccacatacccgtgccaagaatagaaaaaaaaaaaaaaaaactgtgcttacaaaattacattgtgatggcatgagatttatttatgttctactgtggcccagagaggggaagaaaccttctaaaggtcacacagtaatccttgcaggttcataaatgtacgcccctcaggtaactgtgagcctgaggcttagccttccttatatggacagatagatccagaatgagaggcaaggaccttctggggccaacatgatgttcccatcccatctctgccacctcaggacctcaacaagaggctctctctgcccatggacatccgcctaccccaggaattcctgcagaagctacagctggagaacccagggctgcccaagcctctcacccgcatgtcccgccgtgcctccctggtgagtctaagggtgtgagacaccagtatggccttctttgtgccagctgaagcctacagtggtttccagaaagattcctatgcctctggcgccacctgctggccccctgagggttttaataagcggtctctctaagtcaatgcatgaagccaagtagcccccaaatcccctgggaaccccagggtctccctagttaaggccactaaatcagtgctgggactcatgtctgtactcccaggattccttgggaggctgttgcaggagtgttaagaattcaaggcttgagctggagagatggctcagcggttaggggcactgactgcacttctagaggtactgagttcaaatcccagcaaccacatggtggctcacaaccatctgttaagaattcaaggtttacctgggctatgtaattcctggctagcctagggtacgctgtaagacagcctcaaacaaataaaacaaacaaaacaaaaccaggagtatctggatagggttcaggttgtgtttcactatgcagagatgtggttcaaggttctccctggcctcaccatcatggacataagcatggtcacccccaaaatagccactgtgtgcgtccacaagttcactggtgggaacaaggtctagagagcagctagacttccttaccagtgatctttgatggagagagataggaagtcgatactctgtgtccagcgccttggagaaaattgatgagggaaacattttcctgactaatgagaaaaaacaaacaaacaaacccacacctccccaaaggagggaaaccccccagctatggtcatctcttcctgctagaaggccacacagtatattatatagcacatatatgttatataatgcttaataaaaatgaaagacctcccaaataagacaaaacaacaaacaaaaagccaaccacaaagaaacaaaagactcaccgacaccccccacctcacccccagactttaggtcccagctgcctgttaggagcgtctagctctggcaagtgggtctcagctctatcttgttacgacgacgcgtcttatcctgagctagacaagatgaactgatgactagggaactgggctctgaagtggacccccacatagtagagagtgacagaggagctagcaacctgagcaagagagcccggcaggcaggcaggtgggcggcggacaggccgggcagctcagtgtactcatatccgactctcggaagaggggccccccatttccagaggatcttcagcattcacaaggatgaagggagaggagaaaaaggagggtttgaagctgtccttgcttgagatgttagccttggttcctctctgtacaatgggggtgtctcacttccttcactttgactaggaaggtctgctggggctttgaatctcaccgtcccctgtgtctccttcccagtcagatatcggctttgggaaactggaaacatatgtgaaactggacaaactgggggaggtaagagaccaacattgctctctctggcagcaggtaggatggttttgactctgttctgccccccccccccccatgcctcctggttcatggagtcacactacttgcccaagcagcctgcctagcttccagagctggtgttagatgccctatgccctgctcttgaagacagaggtctctgcacaggatctagtctttctcccccctttcaaatagctatggtttggatttgaatcctatgtcttccacttgcttgctccatgaccttagcgtgtcctgtgctcgctctctctctcttcatgcctcagtttcattctctgtcaaaggatgaaaataactactgttgggggtatggaagggtaccaggagaagcttatgtacggttcttagtgcctggcacacagcaaggacactgttattaaactgctttggtgtcctgtgtcagggttggtggcctggagggggtataggtttatgagacagaaaagtggctacatcaccataatctaagagcaaggcagagttatgctaagagagaggccgcaacatgggaacagagggacaaacgcagtccgttccagccggggactcgatagggacactttaagagaaagcagactttggagcaaacagaatctgaacagagggcacccagcttgcttgaatcctagcccaagctaggatgtaagaggtggggctgggagggagagtgtgagcaggatgatctggggctgaccagggattcccctgtcgcagggtacctatgccaccgtcttcaagggacgcagcaagctgacagagaacctcgtggccctgaaggagatccggctggagcatgaggaaggggcgccctgcactgctattcgagagggtacaatgtccgggtctgcaccccaggcctctgggacaaggggctcagcagcctgcacctggtgggagcctgggtggagggccattgctggccccaggaagggatagtgggaggtactggtgggcctggggacccaagtggtcctgtctccccagtgtctctgctgaaggacctgaaacacgccaatattgtgaccctgcatgacctcattcacacagatcggtccctcaccctggtgtttgagtacctggtgagctggactggggctcacccctgagggtgggtgaagtggggtggggaggagagggagtgagggagtgggaggaatgggctgagggaaggacccaagcctttgtttgccaattaagttctcatgcggaagtgggccaaggattcagggccagggtactgtgccaccagcaggcatgggcccagacaggacagggcttcctttcagcctgagcctggaccaccagccaggcagaggacaggcctgaacctgtctgtctgttccaggacagtgacctgaaacagtacctagaccactgtgggaacctcatgaacatgcacaatgtcaaggtgaggggcctgcctgcagagaccttcccatgacagccatctgccatagaacccagtttaggacgcttcctttgtcaccgactgctgaggtcactcgggagcctcaaatgcagggaagaggaaagggtcagtgtagaggccatctgagcaccccagccaagaacacagacttaccatcctcttctgtctagctgtggatacagagccctctctaactgaataccaagcctgagtttacctgccagagggaagagaggcttctgagaagctgtgtgtgtgtgtgtgtgtgtgtgtgtgtgtgtgtgtgtgtgtgtggccagttctggtacctaaagaccaagcacatacatccccacctatgggacccttactctgctctcccacctcacgtcttagggactgctccagcctcttctcactcacggcctcctctccatccctgaactctgcccccatatgcgattctctggtgtctacaggtcctcgggtggcctacagggtgggccttcagggtgggcgacagaattggggagccttcctagagacttgttctggtccccgttcctctccagcctgagacagaggcgtagggtctcccacatgggacctagtcccactaagctgctcattcttgctctctcggccagatattcatgttccagctgctccggggtctggcctactgccaccaccgcaagatcctgcaccgggacctgaagccccagaacctactcatcaatgagaggggcgagctgaagctggccgactttggtgaggctgatgccagggtcaggttggcaggagggtctgacccctgggttacacggcctcttcagtgtgcaggaatgctgggggatgtctgagtataggaccctttaggaccctttagcggaggtctagtaacatgtctgttcctaggcctggcccgggccaaatcagtgcctacaaagacctattccaatgaggtggtgaccctctggtacaggcccccagatgtgctgctgggatccacagagtactccacccccattgacatgtggtgagtgagctgcagacaggagtgaaccaggccatccgtacccttaggcttcatgtctccctgatgtactgctgttagcaaatgaagtctgaaatatatcaggttctccaagcttatagagcctctaacgctataattctgaggtggttcccaggggggtggaggtgggaattaccagagggtagatggatgaggcctcccctggaacatcttggaaggggacatactattttattgttaaaatgtacgatttggtgtaaaatgaaaaccaactcaactttaaagtcagcacaggtgtctggccgagcccagggctcctcggagactgagagtattgaatcttttcctgcctagcagttaaggggacgcaggcctcacaaagggggtccgtagtgggggttggttttacaagcctttcaagccccattggacccctcacatagcagccttaggaggcgtgcctgctcttcctggcctcagtgttgcccttacttccgcaggggcgtgggctgcatcctctatgagatggccaccggcaagcccctcttcccgggctctactgtcaaggaggagttgcacctcatcttccgtctcctaggttagtttctttctgtacgctccacctcgtcaccagggggcgctagaactctgtctacccagaagcaccgaggtggggggcctgctagctttgactactctgctttcttcttcaatgttgctccctctccatatcggcctcggcccttcacttatacttcttacccggtcccacgtctctagggacacctacagaagagtcgtggccgggtgtgacgtccatctctgagtttcgagcctacaacttcccccgatacctaccacagccactgctcagccacgcccccaggtagtcccttgccaggccccttgctccccactgtgatctccctcccagaggctcgggtccccagcctgcccctggctgtgcctgtgccagcacctcctccttgcaggttggatactgaaggcatcaacctcctgagcagcctcctcctggtgagtttcctcccatcctaccctgggagcgataacgaatgaaagccatgtagttcagacaccgcctgtgactccaaagcactaggttctgtgtttggtacccaaggcctagttgggcatttccaggggacaaaaggctcagttttctcaacttcctatcgaatatcagttcatcctttagaagatgctggggatggtgcagtgcctacctgggagcaagcacaggataaagggcagttagtggtgccatatacaaatagagttgatacttggagggtgatagccatgacctttcatgtatgttcatcccaagatgcagtcacattcctgggaagctctggtgtctgaaccgtggtatcataaggcctgagactgcatggtttgggttagacaggagcttcttcctcctcagccttctaccttagcacaggagtcccattttctagaaggttctccaccagagcccaagagcctacctaccctgtgcctttcagtatgaatccaagagtcgcatgtcagcagaggcagccctcaatcacccctacttccagtctctcggagaccgagttcatcagctccatgacagtgagtgtccaagggaccagccagaagcagggatgggggcagccagcatgggtgggagaagggaccagccagaagcagggacggaggcagccagcatgagtgggagctataacagagcctggagccttgggtccagctgagtgtcttgggcacatgtcttcccccttcagttcccatttggggctaagggggtggatcccacctgagatagtagatcttccaggcgggtcttgactggagagtgcctgggctctgtggggatgctaagtgtgggaatgtggttccacccaagcctctcccgccctcttctcttgcctagctgcctccatcttctccctgaaggagatccagctccagaaggacccaggctatcgtggcctggccttccagcacccaggtagggccacatgcccccaccccatatcctttcctagaggcagccaagtagaccacctttccccggtggagactcttctttgaggaagacatgagggcagcctagagtctgcccttgggatgggaagtcaacacatagggaggttcctccctcacccagtcccacccagatggaacacagcctttcacagtagtcctggcaagggcaggccctgactctggtgtgctctccgtgaagaccctgagctcctggccggtccagactttgtccctagcacaacgcttccaatgcattgtctcgtgtagtctttaaaacaccctgtggggttggcaccgcacatgttctccactgcattgaacctgagacccctagagagtaagtcacacttccaggaagctcacaagccacagagatgcgacctgagctcactggatcagagcacgtgaaggataggtgtcccttcaatcccttccctattcctccattgtctccagggcgagggaagagccggcggcagagcatcttctgaaccacacccaccctgctgcaccttgagggatgagaggccacacaaaacatgaactcaggaagtatatggggcctgtgtggccatcagagggctgaacaatgaatgcctgtggccagcctgaagggccactcggcagccctgttggtagcatttgcttccttcccttgcttgccacacagctctgtggtggcctctacccggacaccattccccttgtcacccactgtgggatggggcgtgagcctcttccccgaggggaagtgaggtcacggaggtccctgggaccctttcccaatggaattgcaggagaatgtgggggccctggccctgccgactcatcggcttgacaaacccccttcttattccttggaccctgacttcatcttcttcccctctgagaacgaggaatatggcacctgacctgggaccctggaattgttcccatgggtgtgctgaccccacccaaaggcagacattcctggaacatcagaaaaaagtagtacctcctcttgtcacctcccccaccatgctattgtcccctccttgccagaagccctgtaccctctggcttgacccaaggctaaaaagcaccagcatgctgcccatgtccagctgcatccggaagtgttctggtactccaagatgtactcctacagcctcagccagcccctgcccgtccccccagtctggaaagggttgccttaaactggcaggtggtagagtgcactctgtccttggaactctgacctagcacctatgtccttcttccctaagccactcctatgagtgttatcattcctgagggctgataagacaaccctgtctcagggtcctgaggctggcacccagataggcaaggtcaccttgacactggtaccatggtaaccttggctctttagggctggtgcagcctcctctccacaccccaccactttcccagccctgtctacctgaccctggcactggcctccacagaaagggtgggaagggagtccgcactgcagcctaagctggagagaggtgagattgcagcaggtttgatcctgagagcctcatcctacatccctagagaaggcacccttcctctgtactcctctcatggtgtagggtctctccaacatttggctgaacttgaagggcaaagaccaaggggaggtcaagccccaatgcctgtcctaacccctgggagcctgggttctccctaaccccctttcccactgactgtgaatgtcgtgactcagagcaaagacagagaatatatttaattcatgttgtacaaaaagcagtgagcagtctcattcagaaaaggagactgataggacaatgccagagacagaggactctgggtgtctgggtttgctgacacatacatacgacccattaaagagagtctggtctctgcacatctctgcaccggccctgggctggggctaagaggatcctggtaccctccatgctatacctgaggtcatatcaactctggtaaagggtacccagggtcatgggtaaaacagaaaatgcctgggcatctgtgtcctgcccttggaccagggtgtgtctttggtgaccaatgaggataacccagagagaatcctgaggaggggcgtgggttctggtctccatgaatcactctgctttgctgccaaaaccacgtggctccttggctccttggggtgggaggggcacagagatacagagagggctgggccaggtttagtgatgtacacctttaatctcagcacaaaggaagcagacaccggtggggttctctctctctctctgtctgtctctttctctctctctccctctatcctgcctatctgtctctatgtgtgtttgtgtgtgtctgtgtctgtctctgtctctgtctctgtctctgcctctctctgcgtgtttgtatgtgtgcatgtatgtgtgtctgtctctgtctttctctctgggtgtttgtgtctctgcatgtttgtgtgtatgtatgtgtgtctgtctgtcttctatctttctgtctctgtgtctgtctctgtatgtgtttctctgtctctctctgtttccctctctggggtgggggcaagggtggggataagttgtaagttggtattgaggtggccatggctggcacagtggcgatcgagcgcagacctaactggttctcgatcacctcctgctgctcacagaacacctccctcgtacctggctgtgcctccagccacagctcttagagtgctgagaatccagctgtctcccagtgccctgctcacatttgttccgagaccacacagactgccaagccctcaggcatgcctcctggacttacctgttctgtgaccctggtacttgagggcgctcctgcttcctcgacaaagcagtggaagctggagtgagccagggcttggtccttggcctcatagcatttcctcatcaaagcatcaaagtgtggagcctctcaggcaacaactagtgatttctataagggaaaggaaacgcacaggctgggatccaatgagaagatgactgcatgcagcctggacactaagtgcctcccctctgccctctgcccctgccccctgccccttgccccctcccctctgcccagtgccccctgccccttgccctctgcctacctgcaaggtctgtacccatcgcatcaaatctccaccacaacctctttctccccgatctcatgtataaacactggcatccccaagggctgaagtgactggtcacataacaaattagaatcccatgtctgttaagacctggggacatgacttggtggcataggccttgcctaccatctacaagtcccctgagttctgtgagccccaagttccattcttagcaccaggaaaaaaacaaatcaacaacgacaaaaannnnnnnnnnnnnnnnnnnnattagactgcgggcccactatgtgcggacgctgctgcatcttcagaaccttgccgtgctgctgtccttgtgctttgaccttggttgtagggatacagggtagaggtgcctgggtcaccactccacttagaatgccggtggcctgcagggggtgggtggggcaggggtttagaccctgaaggacaggcttactctggacttgcctggacccaggagacatgatggctctggagaggagagctggatgtgggagtgaggcagggctgagcaaccagctatgagctgccagggctgatgagctgcaggagcctctgctagtgccctagggaccaagctgagccaaaacccctgcctgagccctggagccctgtttcctgggtacccagaagtcatttcctgatagtgtgccactctcctaaacagaagcctttctgctggagtccctggtgagccattgtcccctctggcataacatttactgtccttggtgctgggtcaggagtgcccagggccccatctgaccttcctccatgtccacttacagctactgaccagaaggccctgtttgttgattgctgcagagcagggcccacgcttccaggtacctaggggttggttggcgctccctgtcccactctttcaggtatggtaggcttctcctacagaatccatccccaggccctgtcagccttcaaagctagaagttccttggacctgatggctcctcacagactcagacacccttcatatctccacggccacagccccgggaaggttctggaaggtgcagggccttctatactttgccctgaagtatggagctggggtcagagctgatgcctgacaaactcctttctccctccctcagagcagtttggctgcttgtggtccatttttcttcacctttgtttggacacttgcttccaatttgggactccagaaccccccctctgaactccctctgtatagaccaaatcatcaacttagacattggtcacagcctttgtgcctggccctgtgcagggagccaggacaggtcaggtacaagacactccttcttgcttctgaaagctcaggccttcaggtcaaggtggccttcttcaaacagatttttgtcaggtactgtgtgcttggctctctatactgcagaaagctagaagggaaacaaatgagctttgcccagctgaacacagggccagaagttcaagaagatgagctaaggctgcaccaggagatgtgagggcaggggtgggcatgctggtttggtcagaggtctctgatagagtcagggtaagtaggtaggtaaggggagagctggatggaagccaggagtagaatattccagcagaagtcctgaagaccatgggcctgaaactgcgcatgacacagaggctggagccgaacaagcccaacagtgccagaaggccactgtcccctgctccaacaagtggctccatccatccctcccttctcttcccaaccctaccacccctcaccagcctaaaggggcagcaggacctgctcctgctccacctgttatgacagtagctggtgacattgctggtgctcctcgctggctagctctagatgagtgcgccaactttcctcatcagacagacaggccagggtgcactggtacagtgacgagatgtgacaccactggccacttccctccatattagatctgttcttgccttctctttggccttcttcccctgccactctgtggcatcgcacaccctgttttagctccttttcctgtcgctataataaaatatcctgacagaagtaactcaggggagacacagcaacagctcacagaggtacagtccctcacagcaggaaaaccgaggtggtgggaggttgaggtgactggtcatgtcacatccccaagcaggaagcagagcttgatgagtgcttgcacccctcccaaactcgctttcttatccggttcagcacccacttttaggatggctcccccctccttaattagttaacccatcagtcactctcaggccggcccagaggctaagcaggcattgcaggtgtgcctggaggtttgtctcccaggtcatgccaggctcaccataccaccacaagcctgccctttgtcaagttggcactcagacacatcacttatgtcataaccttccataatctcaggaccattttataatataacgtctcccccaccacttaatccaacttcaaaagaccctagtctttaataattttaacattttttaaatatatgtgccctatctgcatgtacacttaaatgccagaagagggcatcatatttctttcttttaaaaaaatttttattcaacctttttttttttttaaatccccttcctggttcaccctctggttccacatcccatacctcctccccacccgactagacctccccactccctggggcctccagtctcttgagagttaggtgcatcttctctgactgaacccagacaaggcagtcctctactgtatatgtgttgggggcctcatatcagttggtgtttgctgcctggttggtggtccagtgtctgagagatctagggggtacaggttaattgagactgctggtcttcctacagggtcgcccccctcctcagcttcttccagcctttccctaattcaaccacaggggtcaccagcttctgtccattggttgggtgtaaatatctgcatctgacaggtttctttatagatggtcttgggccaccatgtggttgctggaaattaaacttaggacctctggaagagcagtcagtgttcctaacctatgagtcgtctctccttttaaaagttcaaacttcactgagacccaagcaatctcttatatatgagttcttataaaataaaagtttcatgccagggaccaggctcagcttagagaggggttctgagaaaagggatgtctgggagcagcagaaacaaatcatgggtctgagctggaggtctatgttctgctccagacagctttccaggccgctttttctctgatctgcgttctctctggtggtctccagatggctctccctctctgttttcttcttgagacagttctgcaagcaattctctcttgctattctaaaaaataaataaataaataaatgttctggataactcatcttttgcagaccataaccctagtcctttattttacatatcaatccagtcatttactccaggtcccctttttgatcatcctatgaatcagcatcccatgacccagccccttcattcttaggagacagcaagcatttttttttaagatttatttattagtacactgtatctgtcttcagatgcaccagaagagggcgtcagatctcattacagatggttgtaagccaccatgtggttgttgggatttgaactcaagaactttgttcaaagatcagtcggtgctcttaaccactgagccatctctccaacccacttttttttttttttaaacattgcaaaagaattcagagctctgcctgcctcagttaagcacagaggataaactggctgagtgggaccctgccctgaaattaccatttctaccttgcctgtgcctacccttgctctgtcctgggtcaaccttgaactcaagaatctgcctgcctttgtaagcataaaaaacttagctaggtgggatctcctgggaccatcactccctaaatctctttatctccttcctcggtatctttctgacaacatggttcacagtgcagctgcctctgttcctttagctccatgaaactcctcatacaatttatattacagccttatgttttacatagttaagaaattatatatttttgaactcatgtttttagagctcttttccacagccttaagggctgtcctaaaggtctcagtgtttaccattttgctaaaacattatccacactcatgctgtctctgattatcatggagtccttaacgttaacagggaggacattccttgaaggaagaatgtaaaatatgtacactattatacaagcaagccttatgcccacagcaagccttatacccacagcagccatcgacgctcgtggaggcccatgccctgtcccagggttgggagccatgttatactacccctaccaagtctatgccagaccctgcagttacatacttctaatacatgatggcacagaattaatattcctattccaaaagagaagacccagggaaaatcaaggaatgatcagaacaaagaaagacccaaacaataaactctcattctatgggtttgtgtctgggacttggggctcctaatcaaatcagctgagctcctaaggggctgggtagccctccatccctccatatctgatgcctgtagcatagaattctctcttgagtcagcccaactctgcatctagctttcctcagtggaaagtccacagttctggcatctccaatattctgtgatctccatagcaacttaggcatcaccttcacaatttcacagctgactagcagggacctggactctgctacacgtctcctggccacagctgctctctgtaatgatggagcaagattccatggcttccctgatcttgtaccttttgtattcaagttgggcacagacccctccatgattaaggttaaggtttttactgtagataaaagaagggaaatagccaaaggcaactggagaatccagagcagagaatgacttaacacagccagcagactggacatggccagggctagggaaacaagaaacaatagtgaagagagcaagagagaacggggcatagcaagagagaataaggggagagcgagcgggagactatagtaagaatagcctggctataagaatgagtagctgagcgtagagaagcctatgagcgggagggagtttaggggacaggagggggcatgagaagggctgggaagatacactacacaatgctacatcatagctagtgtagactttgaaacatgttaacctgtacttgtgagactgagggagcctggggccagcatggactttgatgtgatcagcaccacaggtagccagccatgtgtccgaagtaagggcaatggctcctagtggccggtgggaactggtcccacaagttcctgaggaattctggcttttatctaaatgccagaagctctgtagtccagcctgagctcattgctggatatacccgctgccttttggagtttggggaactgccctcaggacaccttccatattgtcccatgcagtaccgagaaggttgctcttcagtagttctgacctctagcgattatagctgctatctctgcaccagcctgagaactctcctgccttgagtttctctgtcaaacatattggtccatctttaaattcaattttattcaagttctcgggaaacaggtaaactgacaccagattctgggccaaatataactggatcctcagcccagcacctgttagtctttgaccctcaaaacctcatgagccaggcctcaatggccaggatttctgttgtcattctagtcttccaagatcccacaagaatcacccagaagttctgcttcctctgtgcgaggtctttattagcctgaactttcagatggttccacattccctccacaaacaattccagaggcttaagatccacacaggctcaggctggctcatcacagcgtgagctcacctctctggatcaattttctgtcttagtttctatttccattgcagtaataagatacacacaagtgcacatcccacacacctctctcacacaacaacaacaacaataataataacaaataataacaaataataatgataacaataataacaatgatgataataagtactaatacttatttgaagtaccctgacaaaggaaaatcaatgaagaaaggatttaattcagaccacagttcaatatacaattcacaatagttaatagtaatcaatcagtgcttgtttaaagtaccacgacaaaggaaaatcaacaaagaaagaatttacatgagctcacagttcagggactggtctgacagagcagaagccagaatcaggtaggcacaccacagccacatgatgagggatgcagctgatgagggatgcagctgatgagggatgcagctgatgagggatgcagctgatgatgagggatgcagctgatgagggatgtttatgttcagcacgttttctcccttactcaatccaagctcactttcaggctgggtctccacacctcggtctaatgacaggctaaataatcccttgcacatgcacctggaggcgtgtctccctggtgattctagaacagtggttgtcaaccttcctaatgacgcgaccctttaatgcagttgtggtgacccccaaccataaaagtcatttttgttgctacttcaaaactgtaattttgctaatattgtgaatcataactgtttggtttcagacccgggacaagaaactgaggtgcatattttaacattaaagcagacctggcctccaggatctctcagaatcccttggtccctacctagcacactctgcccccataccctgaatttgcagcccagaggctgggctgctcttctcccagaggctcttcaatatataagccagaaatcattttggtctccttctcccttcaaatcctcacttcttttctttttcttctcccccctctccctctttctctccctctttccatttttctctttctctccctttctccctctctcctccctctctgtctctgtttctctctctaccttcccatggtgaccctggcttccttccttggggccagtgaactcacccacccgagagcagcttcccaataaacctgcatttaatatattctaatctgtcttgagttggttcatttttaccggcgaagaaatagtttagcagtaatgtaaatatttgtgttttcagacagtcttaggtgacccagtgaaagggttgttagtcccccctggaaggggtcatgacccacaggtggtgaactgctgttctagagggtgtcaagatgacaacaccaaccttcccagtggcaatgtggcagctggtgcagtggcacctgttacggtgccaactacttgacaattgcagaggcaaaattcagagccagcctggacaacataggccttgtcgctaaaataaataaataaatagcccaactcagggtcttccccaaggaaggagccaatagccgtacctctattcatcctgcctcaaatccccaaacctcaaatgtcaagtatttcagcaccgtgtccacttcctggtgacgtcagcagatgacctagtaggcgcgggctgcacggccagagccaagcagaacacctgcccctgctccccgctggactggagatttagcatccagtgcctcctcctcccgcagtgtctccctagttccctcctggttacctgccatgctgtcctctgtgccacgtgtaatgtaaatgtgactgacttagcccggcctgctctcgagctcctcagtctgtggctttaggatgcaccccgcctgctctcgggagcgtctccattcagtggctttaggatgcaccccgcctgttctcaggagcttctccgttcagtggctccattctctgttcagtggctttaggatgctttggcctctcctgaggtttcggttcttaggcgatgaggcgctgcccattagttttttttttccgagtccctggcccggatgtagatcacggatggagcagttgctgagcatgtgtaaagccctgggctctaccccgatcccacatcctctcagatgcagtagtaatttttggtgacacctgtatgttcccttgaggaggacttatgggacacggaattgcaaatctagggggggtacaacagattcaaatccccatccctgtctgcagctgagtcaccgtgggcatgtcacgtgacctctccaggccttcctttctctctctgtggaacacctagtgatggtggcgctcttcacagggtgtccccaaggggcctgacacatccaggactccatgaagtagcggcttgctatggtctctatgtatgttgctgcccctctctacactaggaactccagcttgctcccttgccggggatcccagcctaggaattaaaattagaaaccatgtttagttttctttcattcttcacctgtatgatctcagcaaaaaggtattaagtagaatcgattgaaaatatctagcgaggctttaaaagactatgagctgagaggctttctttcatttaaattttacttgatgtgtatgaatgagtgttttgcctgcatgtatgtcaagtgcatgtgaaagtcagaagagggtaccaggtcccctggaactagagctgccatgtaggtatcaggaatggaacttggatcctatagaaggacagccatggt

SEQ ID NO: 1298 - DNA, 2653 bp, Mus musculus
aggacccatcttggacccctgctgatcatgaacaagatgaagaacttcaagcgaaggctttccctgtccgtgccccgcccagagaccattgaggagtcgttggctgagttcactgagcagttcaaccaactccacactcagacgaatgaggatggcacagatgagcctgagcagctgtctcctggcatgcagtatcaacaacggcagaaccagcgccgattctccatggaggacctcaacaagaggctctctctgcccatggacatccgcctaccccaggaattcctgcagaagctacagctggagaacccagggctgcccaagcctctcacccgcatgtcccgccgtgcctccctgtcagatatcggctttgggaaactggaaacatatgtgaaactggacaaactgggggagggtacctatgccaccgtcttcaagggacgcagcaagctgacagagaacctcgtggccctgaaggagatccggctggagcatgaggaaggggcgccctgcactgctattcgagaggtgtctctgctgaaggacctgaaacacgccaatattgtgaccctgcatgacctcattcacacagatcggtccctcaccctggtgtttgagtacctggacagtgacctgaaacagtacctagaccactgtgggaacctcatgaacatgcacaatgtcaagatattcatgttccagctgctccggggtctggcctactgccaccaccgcaagatcctgcaccgggacctgaagccccagaacctactcatcaatgagaggggcgagctgaagctggccgactttggcctggcccgggccaaatcagtgcctacaaagacctattccaatgaggtggtgaccctctggtacaggcccccagatgtgctgctgggatccacagagtactccacccccattgacatgtggggcgtgggctgcatcctctatgagatggccaccggcaagcccctcttcccgggctctactgtcaaggaggagttgcacctcatcttccgtctcctagggacacctacagaagagtcgtggccgggtgtgacgtccatctctgagtttcgagcctacaacttcccccgatacctaccacagccactgctcagccacgcccccaggttggatactgaaggcatcaacctcctgagcagcctcctcctgtatgaatccaagagtcgcatgtcagcagaggcagccctcaatcacccctacttccagtctctcggagaccgagttcatcagctccatgacactgcctccatcttctccctgaaggagatccagctccagaaggacccaggctatcgtggcctggccttccagcacccagggcgagggaagagccggcggcagagcatcttctgaaccacacccaccctgctgcaccttgagggatgagaggccacacaaaacatgaactcaggaagtatatggggcctgtgtggccatcagagggctgaacaatgaatgcctgtggccagcctgaagggccactcggcagccctgttggtagcatttgcttccttcccttgcttgccacacagctctgtggtggcctctacccggacaccattccccttgtcacccactgtgggatggggcgtgagcctcttccccgaggggaagtgaggtcacggaggtccctgggaccctttcccaatggaattgcaggagaatgtgggggccctggccctgccgactcatcggcttgacaaacccccttcttattccttggaccctgacttcatcttcttcccctctgagaacgaggaatatggcacctgacctgggaccctggaattgttcccatgggtgtgctgaccccacccaaaggcagacattcctggaacatcagaaaaaagtagtacctcctcttgtcacctcccccaccatgctattgtcccctccttgccagaagccctgtaccctctggcttgacccaaggctaaaaagcaccagcatgctgcccatgtccagctgcatccggaagtgttctggtactccaagatgtactcctacagcctcagccagcccctgcccgtccccccagtctggaaagggttgccttaaactggcaggtggtagagtgcactctgtccttggaactctgacctagcacctatgtccttcttccctaagccactcctatgagtgttatcattcctgagggctgataagacaaccctgtctcagggtcctgaggctggcacccagataggcaaggtcaccttgacactggtaccatggtaaccttggctctttagggctggtgcagcctcctctccacaccccaccactttcccagccctgtctacctgaccctggcactggcctccacagaaagggtgggaagggagtccgcactgcagcctaagctggagagaggtgagattgcagcaggtttgatcctgagagcctcatcctacatccctagagaaggcacccttcctctgtactcctctcatggtgtagggtctctccaacatttggctgaacttgaagggcaaagaccaaggggaggtcaagccccaatgcctgtcctaacccctgggagcctgggttctccctaaccccctttcccactgactgtgaatgtcgtgactcagagcaaagacagagaatatatttaattcat

SEQ ID NO: 1299 - protein, 460 aa, Mus musculus
RTHLGPLLIMNKMKNFKRRLSLSVPRPETIEESLAEFTEQFNQLHTQTNEDGTDEPEQLSPGMQYQQRQNQRRFSMEDLNKRLSLPMDIRLPQEFLQKLQLENPGLPKPLTRMSRRASLSDIGFGKLETYVKLDKLGEGTYATVFKGRSKLTENLVALKEIRLEHEEGAPCTAIREVSLLKDLKHANIVTLHDLIHTDRSLTLVFEYLDSDLKQYLDHCGNLMNMHNVKIFMFQLLRGLAYCHHRKILHRDLKPQNLLINERGELKLADFGLARAKSVPTKTYSNEVVTLWYRPPDVLLGSTEYSTPIDMWGVGCILYEMATGKPLFPGSTVKEELHLIFRLLGTPTEESWPGVTSISEFRAYNFPRYLPQPLLSHAPRLDTEGINLLSSLLLYESKSRMSAEAALNHPYFQSLGDRVHQLHDTASIFSLKEIQLQKDPGYRGLAFQHPGRGKSRRQSIF

SEQ ID NO: 1300 - DNA, 30030 bp, Homo sapiens
  misc_feature (1)...(30030): n = A,T,C or G
ggaaaggttccagactttgggatctcaaaaacacaggacagttggggaaggaccttccttgagtgtctttaaagagggctgataaaaggagcagagagggctcctctggctgggagagtaaggcgggctttctctggaggcaggaggatgggggagatggaggccaggcctatcctggcccttgccccttgctctggtctctgatctgggatgttctgtacgcccaggaccagaactgacagaagggctccttgtcccatcttatcacttggacatcctgagcctcctcagagagtgcagaccagctttagctgggcccccaaaaaaggtcaaaaggaaaataccagaagatgcaatatgcacctctattccttaagcctcaggaagccagagagcagcagggtggacatcagtaggactgaagtggagccacacagaggggctagataggaggtcgtgtggggtcagaaagggtcatctgtaggggtcaaggccaacatctgagcctgagtagtgcacctgccctacaaggctctgagaatcttccctgagtgatagagccaggaagagggccacaagcccctccgaaccccttccccacagccctggaggccctagctcaatgcatgttgcaggaggaacttctcattcgggttcttctcattccagtccgcccctcactgtaggatggtgcctccagcccaaaaacctccacagacctcactgggggagtaattgctgggcaggacactgcccccactgcctcagcccatctcccgctgctgttgggccacatgctggctagaggaagagggtcaggtttcagctgaggcctcgagtccagctttcatatttcatttgctggtcatttgagggctcactttgtctcaggctttgggtcaggctctgggggtgcaatgacgagtcacgccacagtgcttgcccttaaaaagcccacaggcaaactagggaaatgacaagtaaacagttacaggacagggagccaagtgccctgccttgggatgtcagaaagctgtgggagcacagaagagggaccatcacctggctggggacagtggagtttcgggctagaggagatgcagaggtccccatggcaggatgagtagcacgttgttggtttctccctagtcccccatccatctgcttgggtaccaatccctgtattcctgttccctctgaaacccaagaaaactgaggaggaagcatgccccggggagtctggggctgggtgactggacagtctaggcttactctagtgtgcccagaaagaggacagggccaggcccaccccaatcatgctgaagtctaactaggacaggagatggcctaatgagaagatacacctagaaacaggtccctggcctgcctgaaagtggaaggaaaggcaccaacatttattgcacgtggcagtgtgtcctggatcttaaaggtgactaagatacagtctttgtccttgagggatctaatgtttccatatctgtagaggaaagaggtttaaacaagtcatcatgaagcagtggctcgatggcctcattcagtcacttgttcattcgttccacaaatgctgagtacctggtgggctccttactctgtgtaaggcatcagggaaacaaaaatgttaaggccccattcttgtcctgaaggatctcacagtctagttatgagtgtgtgctggctgctctggaagggacaaggaggaagcatctcattctacctagaggaagaaggtgtggtcatgcacagtctcccaggggaagtgacccatgagttgagtttgggagtggttttaccgagggaaaaattgaggaagggcatcccaggccaaatgattgcaaagctgtggggtgtgagtggagtttgctctgggaatgccaggtacatttgataaaaccagaccttctggggaggggtgagagctgaggctcaagaagacagggatccaaaagcctggtctgccaggccctggaatttgaactttttcctgaaggcagtgttagctttgaaggatttttttttttttttttttttgagatggagtctcgctgcaacacccaggctggagtgcagtggcgccatttcggctcaccgcaaactctgcctcctgggttcaagcgatactcctgcctcagcctcccaagtagctgagattacaggcgtgtgccaccatgcccagctgatttttgtatttttagtagagacagggtttcaccatattggccagtctggtcttgaactcccgacctcaggtggtccacccaccttgacctcccaaagtgctgggattacagacatgagccaccgcgcctagccactttgaaagattttaaatgggcaagcgacatcatcagaaagcagctgagaaagttaagtctaggacgctgatggcagttggattggaggccaagtattattctcaattagcagcaaggaaactgaggcatggggtgttttttcaggtcacagctactaagtggggtttcttccatgacaccaaactgcagagaattttggagagcaaggctagacaccgtgtgttcctcactgcaggacatttctgattggagtgagactctaggagacaatggcgtatttgtctggagcaagggcgaccctgatccccactttgcctcctgagcagacatccaacaggtttgcccaaattgctcccggaaggccttccccgcctacttcctgcattccaaacagaggctgtgggaatcctcttggagctctgggactgtccagagcatctgtttgttggcagggtgactgcaggcctggctatcctcatttctggccactctgaaggtttcaggcctgcagcctctctcatccaggctggggcagggcaaggttgtgaggaggccccaaggcttctgctgctgacgccgccacagctccaggcagctaaggggtgactggcttcccctgaggtttgtcccaggctcctggaaactaaggcctccagctgtgcagaacagggtcagctggaggatgaaggaagagatggtatctgcaggctcccagcaggcacagttctccctgggaggagggagtgtctctgaggtcctagctcatgacgtctgcaaacttggtcagccatggcctctagttctttgaaattcacccaagggccaaagtggctgagtgaccgaggcaggggcagggactgggagatagggtgtcatagggatcctggctggtggtcagccttcgtgactgaagggaagaccctctgggcttcagaaagtgggcagccacaagttacgtcccccaacccctgcccctgggcccacagagaccaagattgaaaagaaaagcaaacaaaacaaaaagagggacttggggatgcatctaacatgtgcctggaacacagcaggtgctccacatgtgcctgtaaagcagacacatgcctgctgtatgccaccagcaccaggcatagagaccaacgtgctccagatgagggagacaggtgaaaagtcacgccccattgaaggaggggcacctggtggtcctgggggtggggtggagtgagttccaggaagctcctgaaggccccagagacttgtacagcatgcaggggcaatgaagaggggcaaagccagagacgaaggggccccagatcttgaagggcctttgggtgcaggctggggaatcggggctttgttcaagaggaaggcaaagaggcttcttgaaggggtttgctgagagaagactccagtcctggccccaggagcttgagaagtgaagctgactttcccgccctccagtctacagcatcccagattcctgggatgctctgtcaacctccttctccacctccatggtctccaggtcaaggtctctcaggggtccagccccaaggcaggtattaggtctgtggcctggcacaggttgtcccagcagtcagtgggctgggaatctgccctgtctggacactggggccctggggctggcctggcctgctctgtggagctttctttcctcctaagagagaagatggggcttgtctgccagtagccggggttccctgccttgcacgggccccaccctgcgtggccctgcagttgtctaagtaggggggaccctgcctccctggcccttctccccctcacatctgccaagagatgatcctgctccctgtctcctggccctcttccatcctgggatccaaaagcaccttgcaataaggaagtctgcagggatgtttgatgaagtttatatgaggactctttttgtctgggcagtagcttgagagaggagagccaagctttgctggacatcttccctgtgccagtggtgtgttgtgttggctcacccagcatgtttgctcagataccactgtacgttgaaaatgtcacctgcccaacatccaactcctggtcttcccactgaaaccactactcccagaatgccttgtctcctccagtgactgttctatctctccactccggctgcttggcgaaaaccctgctgcagagtcatgcttgactcttttctcacccacaacatacaatccatctgcagagctctttgcctccaccttcaaaatatagcccaaatccagccacttctcaccatctccactgccccccgctggtcccagccaccatcaagctctctcccctgggcctcagcagcagcctcctgcccgggctccctgctctccccttgctccccttgtctgttctcaacacagcagcgtgttaaagcctcagtgtgatcatgtcactcatccgttcaaaccctccttacccctcgaggcccaacacagctgctccgcactcccatccagcatcttctccagccacatcattgtcctgcagtgaaccagacttacttctgcctcaggacctttgcccctgctgttcccttgttgacctgcttctcccagaccctgcatgactgaccccctcaccttacacctactctggatttctcctgagatgtcacctgcttcttggggaggccttcttgaccaccctacttaaacttgcaactgcacttcccacaccttccctcttccctgcatgaattcccatcattgcacttgtcaccatccatcatactgtgtattcattctgtctattgtccgcacccccctacccctgttagaaagtattaggaaaggaattaatgtctgtttcattcatctgtggattctcagggtctacaacagtgcctggcatgcagcaggtgttcaataattgttgaatgaatgaatggagccaggggtgagaggggttttatcacgtcattgcgattccatagcctgctagtggtagcaccaaagtttgaaactgagtttgtttggcacgcagttcagagtaggagaaaacagtcaagcctgggccacagggaaggggcaagggcggggagggctccaggtaggagaagaaaggagcaatatggtcacgtttgtgcacttggcaacaaccaggaaattgctgcgtgattctgggcaagccatttcccctcttggatgttcagcatcttcactgggcaagggatggggatggaggctgtgtgagcgtcttcccctgctaacattctgggaggccagccctgctcactgggggcacagtggcctctggcaagtgctggctttcttcccagcctggctcctccttcctccttctgtgccacccatggctctggcaccagcaggaggttctgggccggctgctgtgtccctgggaagaagcaactggagctggctgagctttatgacttacctgggcagggaggtgggaggggaggttggctggggtctgcctgcccaccctgcagctcctcagtgggactctgctccttcaacttcctccaccccccactgccgggccagtatccctggacactcatcgccctcttcccctggcaccaattgcacggggacagccccagatggctccttggtctggggacaaaggctgtgctgtgcctggccccgggctggcctcaggctggtcatactgagcccttctgtccccacttgggggtgaggggtagatagcactaaggtgacaggcctttttcctgtctcccttccccctcgacccccaaatctgaggagctgactctcccaagggaaaaatgacagaggcatcttgtgtcttgacctagggaacaacagactattcactgcccagtctgccctgtcacacccaagaccctgctgggttcaatgccctgattgtccccagcagagagagacatccactctgctgtggtcaccacccccaccgcctgctcccctgtcaccatcaggaagtccaccctacatctgacctccatccttccatcaggaagtccatcctacatctgacctccatccttccatcaggaaatccatcctacatctgacccccatcccttctgctgctgtgacagccacttcctctcaggctcctgtcctgcgggtggagaacagctggtccccatcgcctgcactgcttggccccacattcctgctccagtcagctgcctctggcctcacccttcctccagctcccagccccactgtcctccccaccccaggcacaggctggtggctccttgctcctcactgaaccttagggagagcaggtgtgactcagggctgaatctcttttgtcttgcagaaatggggggcctccttcccggaggcttttaatgagctcccctcccctcaccctacaagcaagagcaagggtgtgagatttatggttgctacttgtagattcctgagccgcaaatccaacatgccatcccataaatcccagactgcaggacggttttatggggaagccctgtttttagaaaggggtgtggctggtctccctcctggcagagctcagacctcagggagccaagtgcctgcctctccccacccccagagaacaaccatgacaaagcacggggacattggggacatcagttggtgtggtggagatgcactggcttccaggacagagagacttcctctcctgtggggggcctcctgcttcccttccctgctctgaggatcccccgtctcagcacaggagggtggcctggaagcctgggcagataattgtccctgacctggaccttagatgttttcctggtcaccgctccaggtgtacatcattggagatgttttttcaaatgcattttcccaggcaccattctcagaacctcagttccagaatctcagggtgagacctaggaatctgaatttttttacaatgctccctggtgattctgatgttcagctatctttgaaaataattggctgagtgctgtggctcatgcctgtaatcccagcactttgggaggccgaggaggggcagatcacttgaggtcaggagttcgagaccagcctggccaacatggcgaaatcctgtctctactgaaaacacaaaaattagccgggtgtggtggcgcgggcctgtaatcccagctactcaggaggctgaggcatgagaatcgcttgagcccggaaggtggaggttgcagtgagccaagatcacgccactgcactccagcttgggtgatagagcacgactctatctcaaaaaaaaaaaaaagaaaaaaggaaaaaagaaaataattgatctttacaaggagccatctccactctcctatcttgctcggaaatgggagtcaccaggtaggtgtgtctgggtcctcttgtcactgggacccacaccccctgccaccatcatgaagcctccagattagatctctgtggcctgaatgctatacacaagtgtgaggcatggtggctgccctctggaagcttcctgtctgcaagagtcctgcagacagcaggcctgagacattgcacagagccacggaggagcggctgaagatgactgacaggaaggagtttagggatggggagtcaggaaagtccaaggctggtgggctctgccaaggaagccagaggaagcgctttcagctaccttctcatcaaaggaggcatcaccagcccctgagtttcttgagaatggggaccaccctttacttgcctctgaaaccctcatgcctggcacaatgctggcgcatagtaggtgctcagttttttggtttgtttgttttttaagacagagtcttgctctgtcgcccaggcaggagtgcaatggcgcaatctccactcactgcaacctccgcctccagggttcaagcaatcctcctgcttcagcctcccaagtaactgggatcacaggtgcacaccaccatgcccagctaatttttttgtatttttagtagagacagggtttcgccatgttggccaggctggtctcaaactcctgacctcaagtaatgcacctgcctcagcctcccaaagtgctgggattacaggcatgagccaccatgcccggccagttcatttgttcagtggaactgagtgagacttcagggcccactgacagagatgggcctgcctagcactgcagacccgaggcctccactctgaaaggtgccagcccgctaaaggaatgaaggagagcctgttcatacccagccatgaggatcagggcagctggagggccaccactgagctgtgtttgggggcagccaggagcatgcgctgccagacagaggaccctttccaggctggctgaggacagaaggatgtgatcattaagcaaagccaacatgttactgacccataatcccttaaaccaggaggattcgggaagggcctggtcgccttggcaactaggtgctggccagtcgcagggctgagagcatcctccaggagtgggctgtgcctggtgctggtgcatgggtaacagctgggagcgggtgcagggcggcccatcatagggctcaccccctggtgccttcttgccagcatgggtggaagcccttgtgaggcctcaagggcagtgtgtgcagagcaggatgagaggggggctgcactgagcgtgtaggaaaccatgaagggaagtggaggggaggtgagacagcgctgctctgggttttcagggcaggagggagaagggagggtctgcaggaagaagcagttgcatgggtctcattgggtggccagcagggcatcctctaattcagagggcacgaggagctgggtagcctgaagaagaaagctttcatggttggggacaggaccgtgggggtgggcagagcagcttaccccgctcctccatggtgttctcggtaggggatacctgcctgcttggagggctctggcatgggaagaggcctgcagggatcaagcctcatcttccctagggctcgactctattaatggcaagcttccgtgtttcccctgagaccttccactgctcctgacctcctgtatttcagctggagagaaggtgcagctggccagctctgatgcactcttcccttcctcctctttttcccctcttgcctcctggggcatgccagagcagagaccttcaggtgtcagtatcagaggtgaaatgaggtttggacccaatcatgtcccaagggtgttggccaagctgacattcagtttacgggccttggtcagtaagatttattggctgttgacacattcaggcccttggacacaagttggtaaatttctgctggtccaaggactgcctggttctggcaccctccctgccaccccagcccttcccccagaactctctagacctccagcagctaaagggcttaggtctggggggccttcaggatcctctttgcacatcatgcctgctattatgaccaatactttgctggactaggtggtccatagagaactgcacagggcgtggcggggcgggcggtgggcagtggaggcagtgctgagggtcactgggaggaagaaggtgactgggaagaagagggtgaacacccaccctcagaggggtcaaactttgcagaagacacaaccctggctcccagtgatggtggcatacagggcgacagagcttgatgagagagctgaattcccagtgggtggagacctggactggttgccttgttcttttcaactgctcttctcacacttcccatctcaggacccggctgcccagtccctcatgatcatgaacaagatgaagaactttaagcgccgtttctccctgtcagtgccccgcactgagaccattgaagaatccttggctgaattcacggagcaattcaaccagctccacaaccggcggaatgagagtgaggggtctgggcccacccagcacctctcccacctaccagacactccccagtcaccttcccctccccgcccaccccctccccactggccttaggggaggagcacagcgctgggggaggggggctacccttctctccctcaggacagagaggcagggaggggagctgacgcctgtccctcttagacttgcagctcggtcctcttggcagagaccccccgcaggagtgcagcaccttctccccaacagacagcggggaggagccggggcagctctcccctggcgtgcagttccagcggcggcagaaccagcgccgcttctccatggaggtgagggcctctggagctctgccccggcaggtggcaggatgcacgcacaagggtgtgcacaggagggcagctgccttacagccagactttgtgagttcaaattccacctctgccattcattagctctgtgactttgagcaagttactcaacctctgtgcaccatggtctccttgtctttaaaatggtcatcatggattaaatgggtttatctatgccaagtgcttagaacattcctgaatttagcaagggctagacaatttgactatttgatccacacacatatgcccaagtatatgaaaaaatatacttacagaatcggtgcctgtaagggcatgagactgatgttgcacagatggtgatactgtggcccagagaggcagagagtgacctggctgtgctaaggtcacacagcagccccgggtgttcacgtgtatgtcttgagcacacactgggagcagctgtgagcctggggtcacagcctgtgattgggctctgaatggttgttctgcagggaacgctaggtccagagtgaaagtctggagccccacagccctagctaccctgaaaccaacagtggtgtccccatctcatccctgtcaccacaggacgtcagcaagaggctctctctgcccatggatatccgcctgccccaggaattcctacagaagctacagatggagagcccagatctgcccaagccgctcagccgcatgtcccgccgggcctccctggtgagtcccaagagggtcagaggacacaaggtggggtgatatgccctccccagcatgggcatatcagtcccagctgaggcctagatgggatttcgaggaagattcctgggcctctggtgccacctgctggcttgagtgcattcaactagctcgtcctcctacatcaacatccatttcctagatgggtctcacttgggctggaatgggactctaagcccacagtgggtcccacggtctccacatggttaagatcaataggccagctggcatgtgccttccagtcctaactgcctatcagagctgtttgggacatcttacaaaacacagactctacctccagacacctatagaatcagcctctccggctagggggtccaggaatccgtcttgttaagggttggatacacctgagctagaagtgcgctgatgagagacacagtcagagaggtggattctgaactggacactcaaggtacaatgggaaaaaaggcagcactcactctggaggagctcgtggtctcagtcggagacacaggtagtcaagatgtgcaacaatcccaggtgccacagctctgggctctacactcttggctgtcctgggaggaagaaactcacactttcacgagctctgtcctttatcacagggataaagggaaaaggagccccttccaccatggagtctcatcccttccctcccagaggctggagttgggggaggcgtcatgtctgtggagctgctaagggcttcaagctcacggcattctatgtctctccctctcagtcagacattggctttgggaaactggaaacatacgtgaaactggacaaactgggagaggtaagacgctgggtttggtcttctccgaatagccaggcaggatggcttggaggaggggcagacctccctagtcggccctctctggtcggccctctctggttggccctctcctggcccctgccccatagaggtgcacagtcttggctgtgcgctctggcccaggctttggcagggattgaagtgagctcagatcctgaaggagggcgtgaggatagagtagccatggccctgggcagaatccagtcttttttttttctgcaagtccttcttgcctgggttcaaaacctagctccaccatttactagctctgtgacctttggcaagttacatgacctctctgtgtgcctcagtttcttcctctgtccaatgagacagtaattgtcctatcacatagggttattgtgaggattgggcaggttactgtaatcagcttatgtacggcacacagacaatgcctggcacataggaagtgctgtgtcacttagctatttttgttgtcactgtgcagaggcctggggtgggtgaaggtttatagagagagggaacacacagccctttccctccaggagcccaaagaggtgacctctgtgtaaacatcagcatcgtataaggaagaaaaaacctggtgttatcatagacgggcacgcggcgtgctggggcttagaggaaggacggattcactccgactggggagtcattagggatgcttcctggaggaagtaggctttggaggaaacagcatgtcagtaaagggaggaagggcactcaggccccagtcgtagcccaggcagaggcacaaatggggaggcactggacagaggccagcagcacctgaatgcgcctggggccgctgtggccctccatcccagggcacctatgccacagtcttcaaagggcgcagcaaactgacggagaaccttgtggccctgaaagagatccggctggagcacgaggagggagcgccctgcactgccatccgagagggtacagcatcctaggctcccacgctcccctgggggcttcaggaggaggggttcaccagcctgcacccttgtgggagctgggggtagaggatcattgctggaatgggactcctggcgctgaccccaagaaaagagggtatggggacacatggggtcctagggacccaggtggatctgtctcctcacagtgtctctgctgaagaacctgaagcacgccaatattgtgaccctgcatgacctcatccacacagatcggtccctcaccctggtgtttgagtacctggtgagagtccggctggggctggccgcctctccctcttgtggtggaaacggggtgtgggtaggggagtgggaagctgagggagtgggagtagtgggatgagggcgacccaggccttgttctggaatcagattttcagatgctcccgtgcaggagtgggccaagagctcaggcttacgggtggctcgagccagggacctgtcccactagtgggcgtgggcccttcccagggaggggcttcctctcctcagcctgtgtctgggcttctggccaggggtcagcgtggggcaggactgagccacgctctgtgttccaggacagtgacctgaagcagtatctggaccactgtgggaacctcatgagcatgcacaacgtcaaggtgaggcctcgggggcagggtccccccatcttggcagccacctgtccagaagcccagtgtggggacccactctcaccaccagggatccggctgctgaggtggctcagaccttcccacgtaggaaagagggagagggcaatgccatcaacgagtccaggaactgggttgagcgctttaccccaagaacagacacacactgtctgccactgtctagctgttggtataaaacccactctcaactctgaacatcagtttcccagtctgtcaaatgggagtgtgagctacctgccaaaatgcagggaggcttctggggaagctcggggttatgaatgacctctcctggtgtttgttaaagaatcaaggctgggcatggtggcccacgcctgtaatcccagcactgggaggccaaggcaggaagatggcttgagcccaggagtttgagaccagcctgggcaacatggcaagacctcatctctactaaaaattgaaaaattagccgggcacagtagcgtgcacccatagtcccagctgcttgagaggctgaggcaggagggccacttgagcccgggaggttgaggctgcagtgagccatgatcacaccactgcactccagcctgggtgacagagtaaaaccctgactctaaaagaaaaaaaaaaaaaaaagggatcaagcacatatgtctccacataggcgggcatcctgacccccgtgctcctgactgagacttcgctggcctcccccacactcactgcgtcctctgcacccctgctgtcctcccctctggatgggattccctggtgtgggtggggtccaggatgggggctgcagggtgtgcaggagaatgaggggcttgtgctgacctcactgccaagcccctgcccccatcctggtcccagccttggagcagaggctcagggccaccttccaccccacatttctcttccccctcccccagattttcatgttccagctgctccggggcctcgcctactgtcaccaccgcaagatcctgcaccgggacctgaagccccagaacctgctcatcaacgagaggggggagctgaagctggccgactttggtgaggctggggctagggtgggggtctgacgctactggggtgcctcagggtgtgggtgcagtgggggagggcatagcagtcaaccccacagcacctgtggacagaggtccagtgacatgtctgcccccaggactggccagggccaagtcagtgcccacaaagacttactccaatgaggtggtgaccctgtggtacaggccccccgatgtgctgctgggatccacagagtactccacccccattgatatgtggtgagtgagcactgtggggaccgaggaggggaggacaggcctggccacacctccagactctcctttgcttccccaagggcctcggggaagaactgcctaacttcctttgcctaaaagccttgtgacatcctgctgaaatggatgttaaaaaattaggtctgaaatataataggttagggtttccctggcttaaatagacccccaagcctgtgcatttgaaatcctcccccagaggcctgtggggggttaccagagacccagagggtccaggagggcccctatagtaaatacgatgaatcttccccaagcatcagtcccagtgaaaattttgaaagagaagtactatttttatgttaaaatgaacaagtgtatgatttggtgtaaaatgaaaaatcagcccaaattgcaagccaagccgccggtggttatgaatggctgctgtgactccgccccaaggttccccaggacttctggatttatgtacttctcttccagtggggcacacagtggcgagagtttgagacaacactgctgagagaattgccacatgggcgctggctgcacagacccaaacctcacagagtgaaaggggactttcctcacagagtgaaagtcgcagctttcccgagcccagggaagccccccagagaggggctgtagtgggggctgggcagttctaggagcctccactgccctgggccacccctccgccgccagagccacgacccctgcagccgcctgtggcaggtcgtcattggtgccctggtggagcagccctaggaagggcggccgcccctgcctgatgccgaccctaccccttgctcctcgcaggggcgtgggctgcatccactacgagatggccacagggaggcccctcttcccgggctccacagtcaaggaggagctgcacctcatctttcgcctcctcggtcagtctcccgctgctccgtccctctcaccaccagggggcgccggaactcctccagcccaggcgcggagcgggacggggaggagcggctcggccgcctctctcccgggcggggacccgctgtggcctcggccatctttgctcccacctcatacattgcatccctttcaagtcggccttggccctgggcctcacgcaggccctccccaccctctctcgtctccccagggacccccacagaagagacgtggcccggcgtgaccgccttctctgagttccgcacctacagcttcccctgctacctcccgcagccgctcatcaaccacgcgcccaggtagcccctgcgcccgccgcccctcctgctgcggccctggctctcccatccccaatcaggcacagcctgtgtccgcgccttctccttgcaggttggatacggatggcatccacctcctgagcagcctgctcctggtgagtgtcctcccggcggggcccagggagaggcagccaaagagccaggtccctgtgccccatgccgggcctacgccccaacttctgtggctcgtgtgcttacacgtctttgaaacatctcccctgtactctccacccccaaggccaaggggtggcctccatacacatcctctggagtctgtgcactgcgagcccaaacccgttacttagctgtgtagctctgggcaagttacagagctcctccatgcctcagtttcctcagctgcaaagtgggattaatacctattttataagatggccgtgaggatacattgagatgacgggacacacttagtgtggtgcctgtcttgtaaggcacacgatgaagggttgttatcggcactacgcttcctgttacggatgttctccatctgatcatggttggtttgcatctgtatttctatcccaagagaaggtcactctcctgaagtttcatttctggtttttcctggtggctggagaccgaggagccttcccctgagtcttgagatggcctgaggttgggtttgtggtaggggctggaggctgacctggggcttctcctgttagcctcaagcctcacccaccttggtgctctaaccagcactggagtcctgctgcccagagggtttgcagccccccagccgggcccaatagccccaccctgtgcctttcagtatgaatccaagagtcgcatgtcagcagaggctgccctgagtcactcctacttccggtctctgggagagcgtgtgcaccagcttgaagacagtgagtactgggggtccaggagcagggccacccagaaccaaggaaaggggttggtgagtgtgggcagaagaaccagaacaaagaggccagaggccccaggcccagcagagcagccccgggcaccttgcctcccctgctggggttctcattccaaattgagggggcaaacagtggaaatgagacgctgcctcgagggctcagttggtccttctgggccagtcctcactggaggccagctccacgcagccctctccagactatgcacttctctcccccagctgcctccatcttctccctgaaggagatccagctccagaaggacccaggctaccgaggcttggccttccagcagccaggtaggggcttgtgctctcctggacccctccccttgttagtggaagccagagcaggcgacccctccccagtggggactcccatggtccgcccaccactggcttccctttggactctttggggagcagagaaggggttggtttctcctgcctagacttcctcgtccagctcttccctcctcaaccctccaccccagacaggacattgcatttgacagtagccctggcaaagaggcatgctgtctctggtgcattctctctgcaaaccctgagctctctaatcagattccatcctgggagaacggtactttgttcctagaacagtcaatggccttggacattgacaaatgctttccatgcatcgtcttctttaatccttaaaataccccttgaagctagtactattaatattccccatttcatagtcaatgaaactgaggctctgggaggttaagtcacaagttcatgcagctagtaagtagcagagatgggatttgacaccaggtcagaccggctcctgtttgcatgcccttgcttgctctgtcagagcagctctgggggacagcgactgtccctgctgacctggggtacccgtcagcccagcctcctccctgcagccccacctcttctccattctccaggacgagggaagaacaggcggcagagcatcttctgagccacgcccaccttgctgtggccaagggacaagagatcacatggagcacaaattcgggtaggatggagcctgtgtggccctcggaggactgaagaacgagggctgacagccagcctggaagaccgcttggcagcccttctggccacggctgtttcttctttgtgcttcccgtgtgcctccccagtagccctcacctgcataccaacccctcctttacccacgttggggctggcataagctgcttccctgagaggacatgaggggggggcggtcctcgtaccctctcccaccctggtgtttgggcacctgcgtgggatgcacacggatgacagaatcaaggcgccaggatgggcactctgccctggatacaggctctaccctcctcccccaggacctgcctagtgccagtttggtagtccccctttctggccccttggagcccacacacgtttcatctttttcccctctgagagcaagaagagacatggcatgttctctgggaccctggaatcctaggtacccacatgtgtgccaaagcctaccccacctggcaggtgtcccacagcaacagaaggaatagtagtccccactctttccatcagccctaccctaccctcattccccgacaccctctggcttgaaccatggctgagcagtgccggcatacgctttgccggcatgcttggatgcccagctgtgtccagaggtggcctgggaccgccagttgcacgcctgccacctcagccagcccccgcccagctcatcagtctgaatggagttgccttaaattggcaggtggtaccgtactcactgcccttggagctgtgaccggctcctgcctgtccaccccttcccgaggtggctcctgcttaccttatcatcccagggctctgattagccaggcctggtcagggtcctggggacggcacccagatatgcagagtcaccctgacactggtgccgggctgacctcagctcccgaaggctcgcacagcctccccatccttccttcccagcccttgtggctctgtccacctgatcccaataccagcttcccccagcccctgccaccccagagggcggccacgacagggagaggtgtagatgccaccatctgagggagaggaacgtggaacaggagcaggctctgatgctgagaggcttgcctccgggggctggaagcctgggtggccggggcccctgaagaaggctcccctctgtatcccccaggtctcctcaacactgggctgatcctgaatggcacaggccaaggggaggccagcctcgcctttctacccaggccccctgccctgcccacctcaggcccccaccctccgctcctccccacggtactgtgaacgtcgtgtgactcagtgcagagacagataatatatttaattcatgtacagaaaggagcgagcagtctcgtacagaaaagctgactttgatagattgatgccaaagatggagaactgaaggcccccctccaggcctaatgagtgtgggtggggtgtgcttgtgtgtatgtgtgtatgtgtgtgtgtgtgtatgtgtatgtgtatatatatatatatagtgaggagagagtttgatttgtgtgtatctctgacctcccccacaccccaggctgtgggacgagtgcctagcattcaccttgctgtatcctgggtgctgctgcgttcagagccagaagttggctcttgctgaggagcatcagtggttgttgtgggtgggcagaggagtcccaggcctgggagtctgacctgtggcctggcattggcccaagttggtgcctgtggggtggggctggccaggagagcaaagagggacccctgggcgggggtctggggtctggccgtgcagctaatccctgtgttcctgatgccaaatggccccctggcttctggggagggaggtaggcaagatcaagatgaggttgacatgggagatggccaaggccagggcagcaggacgagggtgtgggcctcactgtaattcaggctctgcaagaattgctgcagacctcgaatacacctcctgctgctgcctagaccgcctccccacctttgatctggacacaacccacccccgcaacacatcatacacagctcccaaagtgctcagagtcctgctgttgtccagttcggtgtccaggtttgttcttcccgagaccactctgagaatgccaggcccgaaaccctgcctcctgacctgtcctcatgcctggccttaagcactttgcagtttgccggcatggtttgcagttacttaagagggtggctgctttccagaggaggaagctgatgctgaggttgatgatgtctcccaaggctctggaagtaaggggcgggccagggctccattctcagctcagcaccagttctaccgaaggagacctcctcactttgcttgtaggcagccagacaccaaagtagggtcgtaactcagacaattagtgcttgaggggaggagaagggctgggaaatgcattggtgggaattggaaaccagacatttattaagttccctgctgggtgccaggcagccctgtgcccaggcattgtctcactgaatcctcatagaaacccccctttctccccactttgcagatgaggacaggagcctcccaggggtagcctggggtcacacaccaaattagaatcccaggtgtctgccccccagccctgtggtctttaaggagtgggaggcgtggggagggtgaggtggagacagtgcagaggccctggagggaggaaaacacacaaggaaggatatgggcagatgctgccttgaggagcactttgcaaggcaactcttgtggcaggcagaggtggcccagagtcgctgggggcagccgttcttgctgctgcagctgtggccctgctgaggaggcacacacctaggggcttctgacatcaggcatgctgagcttctgccctagaaagctgccagggctgggagtgccggccagcctgggggtgtggaactcagctggacaggcctacaccaggccttggatatgattggtgctcaaaaagtgatggctccggagaaggaagctgggttcgggtgtgaagaggggctgagtgattttggccatgagctgccactgggctcccagggaccaggctgagctacaacccaacccagtgtcctggagccctcggtttcctgggcacccctgcaatcatttccttatgccggtgactctcaaaaacaggagcctgccccattctgctggaatccccggcccaaagcagccttttacaagtcattccccctcaggcctcacttgtcacctgcctgcttctgggacaggtcaggaatatccagggtgcagatgccgtcccctccaccatggccacttggcaggggcatttgaggcatgtagcagccctgcagcttcagacaaaatgtcctatttgctgaactctacagggtgggggtgatatcagctcctgtgcttggcactgcccacatcatcttgcaccccggtgggacctggagctcgctctcccctgccccaccctcctgtgggctcccattcaccctgcccctactctctgggtccagtggtcagggctgatgtctaataggccaccactcctctaccctgctaggccccctgggtcagccaagtgtcagacactgttgcaggcctgctcctttcctcccttcttgaagcatcccagcctcctttgggccatctccccacctctatcactgctcagacccttgcttttggccgtgacactctacagcaccccagtgagcccctctatctccagagcaaatcatcagcaccatgaattagccacagcctcctccatgcctggccctgtgctagatgccagggacaccaagatgcatgacattccacccctaccttccagaagctcagacctgccggcagagatggccttgattacaacaggttttctcaagaacccactgtgcacccggtgctgtgctaggcactgaggatacagccgtgaacaagatggccaagccctactctcatagagcttatgttccagtggggggtataagacgttatccaaaccaacaggcatatcaaggggtcataagtgtgatgagacaaaataaggcaggggcaggtttgagggggaagaatgtgatggcatagggaggggaactgcctggtcagggagggacctctccatcaaaaatgagctatgggctgggcgtggtggctcacacctgtaattctggcactttgggatgccaaggcaggcagatcgcttgagcccaagggtttgagatcagcctgggcaacatagcgagaccccgtctctatttaaaaaaaaattagctgggtgtgacggctcatgcctgtagtctcagctactcaggaggctgaggtaggaggatcacttgaacccaggtcgagccgcagtgagcagtgatcatgccactaccatccagcctgggcaatggagtgagaccctgtaccaaaaaaaaaaaaaaaaaaaaaaaaagtgagctatgttgtgtaagggggccaggtggacagccagggacagagtattccaacaaaggccctgaggtgaacgtacttgagaatgagtgagaggcagtgaggccagggcacagtgagccaggcagcatggcaggagggatgtatcatgtggggcagtggctctgcccattagatccacctgggaagtgcttaagatccactgccatccggccccagctcagattgattcagatgaccctaacatgtatccagggttgagaaccgctcactcgtgcggggtcttgcgggctgtggtacgggttctggattttattctgagatgggaagccactggcctctgtttttaaaggctcagagggtcaaataggagatgtcagcccctataaggagggtgatggggcagggagaggaaggatcccccaggtggtggtagagcagcagcaggtgtggtgggaaaggagaagggaagcacctgctctcctgtgttgctgcgagagggactgtcatcctaatcccagggagggccacagaggctctagggttaggtgacctgcatggccacacagggagtaaggtggactgtcaattacaacccaggtcagcctacctgagcagctgcctccgggcaggtgtgggcactggcacggacactccacctcacttgtttgcatggaggatgggcatctggtttccagggactgggaaatccttgccttctggtcacctaaaagcattgtctgacaggcagccagttgacacctgggggttgggcaaaagtcactatcccccaccccaccaagtgccccctgagtgatgactcagcccctcttccggaccctcagaacctcccaccatctgccaactaaaagcatcattgggcaccagggccctgctcccgccctagctgtggaggcccggtggctggcatcattgctgatggtcagtgcccagactccagggagtgtgtgccaattctcctagacaggacgggtggggccaagggcagctctgatgagattgcaggtgccacgtggccactcccgcttcctcccttgttttctcctcttccttcttcctgcttctttttacttctctcagtgccccttgggggcactaggtattactcagtgggcggccctgagtaatactgaaacccagagatcaataatttgacccagcctcttgtctaaggaaggagattttgcagcctctcccttgaatcaacccaagcctccagtccctgagatgtgttctcaatgccaagcatcaacccttgctcctgcatccctgggcccttcctggtgatgtgacgcaaacatggagagctgaagcatggacagggcgtggcagggaggatccccgctgccctcctgcatgtggtcagcactcctgcttgcccctttctgggctagaaacttctagcccagttcctcatcttcctgtctcctccagagctcctccctccctaatttactcattatccatcagatggttccagactctgtgccaggctctgttttcagtacccaggatacaaacttgaccctgacttagaccccactcccaggagctcagcgtctcagaggcggctaggataatcttttcttcctctcagcttcttaaggtctcagctacttgggggaaagacagttgtccattagtcattctattaaaatttcctaaggtttttttttttttcaagaacaataaaatgttttaatgtcctcatgttttccctggaggagagattggctaagtcctaggttcctgggaagaaggaatcttgaacaaccagggaaataacacacaggctccaaaatcacagacttggattcaaatcccagctctacggcttgcaagctgtgtcaccttgggaatgttccttaactgctctgtgcctcagtttccctctctgtaaaacggagatagtgataacacctatttcacaaggttgtgaggatttaagaatgaatattcaggccgggcgcagtgtctcatgcctgtaatcccagcccttttggaggccgaggcgggtgaatcacttgaggccaggagttcgagaccagcctggccaacatggtgaagccccatctctattaaaaatacaaaaattagccgggcgtggtggtggacccctgtaatcccagctacttgggaggctgagacaggagaattgtttgaacccaggaggtggaggatgcagtgagctgagatcgtgccactgcactccagcctgggtgacagagtgagaccctgtctcaaaaaaaaaaaaaaaaaaaaaaagacaaaaagagaatgaatattcaggaggggcatgacccagagtgctaggtgagtgagcttcacatcctcactctgcacactcccacccacttctccacaagcaggaattccagcttcctccctcctggaagtaaagtggaagatcatatgcttttatttcttgcattcttcactcttgataagatctcaatcagcaagaatgtattaagaacatcctacttaaaagattttgcaagacttttaaaatgacctcagcccagagttttttctccacggaagctttaaacgtagctggggaagtaaacatggaaagagaatttatgataaaaggcactgggtcaggcgtcactcaaagtggatccgctgcctcttgaggtagtaagtgctttgtcccccagactgggaaaccacttgggaattccaggggcatcactgcctctggtatgtcttgccaggttcctgaggagccagcagccagatctgcacctggcctgaccctattccttggatctttcttttttgctgtgcggagtagcaaggtgtaactggcagatgagataccttcctcagagaagccagaggaatgtggcaaagcatgatcctgggcttgcaaacacccttctccttggattccaggatgccaggggtatcctctcaggcctgtcactggctttgaggccagacttggcttttcaggacctgagactgattctggggtgtgggaatgaactaatctgggatttttttttcttttttttgagacagtctcactctgttgcctaggctggagtgcagtggcatgaatcttggctcactacaacctctgccttctgggttcaagcgattctcatgcttcagcctcccaagtaactgggattacaggcatgtgccaccatgcccagttaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttccccacctacaaaatggggtgatcataggcatgagtgtggattaaatgaattagtacatgaaaagcacgcagtagcccaggcacggtggctcacacctgtaatcccagcactttgggaggccgaggcgagcagatcacaaggtcaggaattcgagaccagcctggccaacatagagaaaccctgtctctactaaaaatacaaaaattagccaggcatggtgatgcacacctgtaatcccagctacccaggaggctgaggcaggagaatcgcttgaactgggaggcggaggttgtggtgagccaagattgcgccacggcaccccagcttaggcaatagagcaagactccgtctcaaaaaaaaaaaagaagaagaagaaggagaaggagaaggaggaggaggaggaggaggaagaggaagaagaagaagaagaagaagaagaagaagaagaagaagaagaagagcacgcagaatttactggtcatgtagaaagcattacacagtgtaagctgttgttatgtcatctttccctgagggtagaagcaggcatcacccaccttctctgtttcactgtgagggctgtgaccaggagccaaaggcttcttactaaaaggaggaatggttccgtggggcacacaagtgaataaaaccctttctgtctatggagaactacctgtcctcccaaaatgccattagagtttgggaattctggtgtcccttactctaacagataccgatgttaggcaaaaggctatgaacttaacaaacattacctaaattttaaaactttttaaaagttaagagacaaatcttttgggggccaggcacggtggctcacgcctgtaatcccagcactttgagaggccgaggcaggtggatcacctgaggtcaggagttcaagaccagtctggccaacatggtaaaatcccgtttctattaaaaatacaaaaattagccgggcatggtggcatgcacctgtaatcccagctactcaggaggctgaggcacaagaattgcttgaacccgggaagcggaggttgcagtgagctaagatggtgccactgccctctagcctgggcaacagagtgagagtgtctcaaaaaacaaagaaaaaaaaactccctgggtccaggtccagtactcacacctgtaatcccagtgcttcaggaggctaaagcgggaggattacttgaggcaaggagttcgagaccaggctgggcaatatagcaagaccttgtttctacaaatatttaaaaagtagccaggcatgggggtgcatgcctgtagtcccagctactctggaagctgaggcaggaagagcgcttgagcctaggagtttgggctgcagttagctctaattgcaccactgcactggagcctgggcgacagggcaagaccttgtctcaaaaaaaaaaaaaaaaaaaaaaaaagtctccttggcttagaccactctgtgaaacactagagattcagaaataaataaacagtgttctatcctcaaggaattcacagcctggtaaaggagagagatatcggttgcagaaatgtggtagggattatcccagagattgtaaacagctgcccagatgacttgctccttccacctccctccactccccttcctcagcccctgcagtacctacctggtttgcaagccttgtaaactgagttgggcctcactgctaggctcatagctgtgaatgaaaatatgaatgaatacaaacatgaaatgtctgctacattaggaacttgctggaacccactcttgcctggccagctctctcccttcccttccatgcagcagcaggcacctcgggctacccctgctgccttgagcttagactttagactcgagtccccatttacagtcacggggtacagccaatcttgtttctaaggtgtttccaaactctactccccaacctccactcctaggggttcctgggctgcagagggcctccagagaggcttcaggacattccactgactgtcccactgtcaccactaagggttgagcctcctcgctagcaaggtgcctaagccccttgtaccctggctccgacttctttgcatactctgcaatcttgctactagaccaaggacccattttccccaagggcacctcctaccttaagcccttgtgcctgagtctgtccacgttccctctgtttggacttccttccttccttccagctccctgcagcaccagttccagttcagtcactgtgccttgggcaaactccctcacctggctgagaccttggtgcttttgtccctacaatgaaggtgggtcctggatgccctcagggtctcattcttgctcctggatgttacataaacctgtctgctgtcactttcgtgttttataatcccccctcttcttctttcaaacatgcctcaaactcccttcctccaggaagccttccttaatcagccccgtgaatgctcccatatgtgctcagttctggtggtagcaagtgggcctatgccagtgctggtgccaaggggtccacaggggccttagctccctcataacctccattgcctgaaaggccacccaaatacctataacctaagtgaaaaacagagcttagcatagaaacagtgaccacttctcagtaaatcccccaagcattctcccaatccccaaccagacctaccccaagccagacagtctagaaattctagttgtctatagtctacactttttatttttttggagacggagtctcgctctgtcacccaggctggagtgcggtggcgttatcttggctcactgcaacctgcacctcctggattgaagcaattcttctgcctcagcctcccaagtagctgggacttacaggcacatgccaccatgctcggctaattttttgtattttagtagagatgggctttcatcatgttgcccaggctggtcttgaactccttagctcaggcaatccgcccaccttggcatgctgctctcagcgcacacaatgggcatgggagaacaatgacgaggagaaaaacatcccgcccgcgcgtccatgggctcacatcctcctttcccaaagtgaaaggattacaggcatgagccaccgcgcccagcttagtctacactcttgtatctaggttttcagtgtctaagtctctttcttgggtttaagttgtaagctgcctgggatgaaaagcgccatgccttctaattcctggctgtgacctccccgagtggctttgtcagaggaatgacaccacttggtgaccaagtatttttttaaataattatttgggtttttgtttgtttgtttttatttattttttgagatggagtttcactcttgttgcctaggctggaatgcaatggcacaatctcggctcactgtaacctccgcctcccaggttcaagcaattctcctgcctcagcctcccaagtagctgggattacaggtgcatgtcaccatgcctgactaattttgcatttttagtagaaacggggtttcaccatgttggt

SEQ ID NO: 1301 - DNA, 3243 bp, Homo sapiens
ggacccggctgcccagtccctcatgatcatgaacaagatgaagaactttaagcgccgtttctccctgtcagtgccccgcactgagaccattgaagaatccttggctgaattcacggagcaattcaaccagctccacaaccggcggaatgagaacttgcagctcggtcctcttggcagagaccccccgcaggagtgcagcaccttctccccaacagacagcggggaggagccggggcagctctcccctggcgtgcagttccagcggcggcagaaccagcgccgcttctccatggaggacgtcagcaagaggctctctctgcccatggatatccgcctgccccaggaattcctacagaagctacagatggagagcccagatctgcccaagccgctcagccgcatgtcccgccgggcctccctgtcagacattggctttgggaaactggaaacatacgtgaaactggacaaactgggagagggcacctatgccacagtcttcaaagggcgcagcaaactgacggagaaccttgtggccctgaaagagatccggctggagcacgaggagggagcgccctgcactgccatccgagaggtgtctctgctgaagaacctgaagcacgccaatattgtgaccctgcatgacctcatccacacagatcggtccctcaccctggtgtttgagtacctggacagtgacctgaagcagtatctggaccactgtgggaacctcatgagcatgcacaacgtcaagattttcatgttccagctgctccggggcctcgcctactgtcaccaccgcaagatcctgcaccgggacctgaagccccagaacctgctcatcaacgagaggggggagctgaagctggccgactttggactggccagggccaagtcagtgcccacaaagacttactccaatgaggtggtgaccctgtggtacaggccccccgatgtgctgctgggatccacagagtactccacccccattgatatgtggggcgtgggctgcatccactacgagatggccacagggaggcccctcttcccgggctccacagtcaaggaggagctgcacctcatctttcgcctcctcgggacccccacagaagagacgtggcccggcgtgaccgccttctctgagttccgcacctacagcttcccctgctacctcccgcagccgctcatcaaccacgcgcccaggttggatacggatggcatccacctcctgagcagcctgctcctgtatgaatccaagagtcgcatgtcagcagaggctgccctgagtcactcctacttccggtctctgggagagcgtgtgcaccagcttgaagacactgcctccatcttctccctgaaggagatccagctccagaaggacccaggctaccgaggcttggccttccagcagccaggacgagggaagaacaggcggcagagcatcttctgagccacgcccaccttgctgtggccaagggacaagagatcacatggagcacaaattcgggtaggatggagcctgtgtggccctcggaggactgaagaacgagggctgacagccagcctggaagaccgcttggcagcccttctggccacggctgtttcttctttgtgcttcccgtgtgcctccccagtagccctcacctgcataccaacccctcctttacccacgttggggctggcataagctgcttccctgagaggacatgaggggggggcggtcctcgtaccctctcccaccctggtgtttgggcacctgcgtgggatgcacacggatgacagaatcaaggcgccaggatgggcactctgccctggatacaggctctaccctcctcccccaggacctgcctagtgccagtttggtagtccccctttctggccccttggagcccacacacgtttcatctttttcccctctgagagcaagaagagacatggcatgttctctgggaccctggaatcctaggtacccacatgtgtgccaaagcctaccccacctggcaggtgtcccacagcaacagaaggaatagtagtccccactctttccatcagccctaccctaccctcattccccgacaccctctggcttgaaccatggctgagcagtgccggcatacgctttgccggcatgcttggatgcccagctgtgtccagaggtggcctgggaccgccagttgcacgcctgccacctcagccagcccccgcccagctcatcagtctgaatggagttgccttaaattggcaggtggtaccgtactcactgcccttggagctgtgaccggctcctgcctgtccaccccttcccgaggtggctcctgcttaccttatcatcccagggctctgattagccaggcctggtcagggtcctggggacggcacccagatatgcagagtcaccctgacactggtgccgggctgacctcagctcccgaaggctcgcacagcctccccatccttccttcccagcccttgtggctctgtccacctgatcccaataccagcttcccccagcccctgccaccccagagggcggccacgacagggagaggtgtagatgccaccatctgagggagaggaacgtggaacaggagcaggctctgatgctgagaggcttgcctccgggggctggaagcctgggtggccggggcccctgaagaaggctcccctctgtatcccccaggtctcctcaacactgggctgatcctgaatggcacaggccaaggggaggccagcctcgcctttctacccaggccccctgccctgcccacctcaggcccccaccctccgctcctccccacggtactgtgaacgtcgtgtgactcagtgcagagacagataatatatttaattcatgtacagaaaggagcgagcagtctcgtacagaaaagctgactttgatagattgatgccaaagatggagaactgaaggcccccctccaggcctaatgagtgtgggtggggtgtgcttgtgtgtatgtgtgtatgtgtgtgtgtgtgtatgtgtatgtgtatatatatatatatagtgaggagagagtttgatttgtgtgtatctctgacctcccccacaccccaggctgtgggacgagtgcctagcattcaccttgctgtatcctgggtgctgctgcgttcagagccagaagttggctcttgctgaggagcatcagtggttgttgtgggtgggcagaggagtcccaggcctgggagtctgacctgtggcctggcattggcccaagttggtgcctg

SEQ ID NO: 1302 - protein, 481 aa, Homo sapiens
DPAAQSLMIMNKMKNFKRRFSLSVPRTETIEESLAEFTEQFNQLHNRRNENLQLGPLGRDPPQECSTFSPTDSGEEPGQLSPGVQFQRRQNQRRFSMEDVSKRLSLPMDIRLPQEFLQKLQMESPDLPKPLSRMSRRASLSDIGFGKLETYVKLDKLGEGTYATVFKGRSKLTENLVALKEIRLEHEEGAPCTAIREVSLLKNLKHANIVTLHDLIHTDRSLTLVFEYLDSDLKQYLDHCGNLMSMHNVKIFMFQLLRGLAYCHHRKILHRDLKPQNLLINERGELKLADFGLARAKSVPTKTYSNEVVTLWYRPPDVLLGSTEYSTPIDMWGVGCIHYEMATGRPLFPGSTVKEELHLIFRLLGTPTEETWPGVTAFSEFRTYSFPCYLPQPLINHAPRLDTDGIHLLSSLLLYESKSRMSAEAALSHSYFRSLGERVHQLEDTASIFSLKEIQLQKDPGYRGLAFQQPGRGKNRRQSIF

SEQ ID NO: 1303 - DNA, 54552 bp, Mus musculus
  misc_feature (1)...(54552): n = A,T,C or G
caaactagcattactttgactgtcctcttgggaagcagctaggacagggactcctggccatcccaggcagtatctacagaagagaccatgcggctaccacagccttatcaagacaccaagactgttcttccttacccaggctctggaggtctggtcttggaaagaaaaggctcagccctctcacgctctgcacttcccaggaccagcaggcatctcctgtggcttctcctgcctctccagggtgctggatcagaatgcttattcttcgttgtttcctgtgctgtttcctgagtgtccccatccctggcctcaggcaacccacaaacggcccctctgtgcttggtctagatgcacctgcatttgagaaagtgggtggttgaggctaactgctggtgctttgaggattctccttgaccttttctccgaggaacgcttggttctaagaaacagctggtcagtatcaaccacagccatgctaactggacagatgttggaacccaaagtcctaaggagagagcaggcctgcaccttcagacatggaataaatacatcgccttttctgttttcctgcagctatggtacctgaccgggaaggggtgggaaagcccggaggtccgggagggacgtctccagagctttgggaaatggaacagtgaagctcatttcctggtccctgccttttccccagtgggtactgattttagggaagatggcctctccctaaaagatctccattttcctgctctgtcatttaggggccacataaggaacctggatctctgggagaaagtttccctttcaaaacaaaacaaaacaaacaaacaacctaccacctaatcgtctgctgctctccccaggccttatcactgttcacagtctaggctctgtctaatatgtgtgaggaccactggagaactttcctttattgagcctggaagctagaggggatacctgggtagaacactccaacttgtaccaactgcttgcaaatttagcctttcttctttagtctttagccaatacagtaaggtggcttccgtaggagaggactgtaaacagaaagcacagtgattggccccagtccaccctgtcttcaccaaagtctccccacatggaggatgctctccctaaatgaaccagcagggccaggaatggagaaggcagagccctaaaggggatgtctacagaaaaggcagctgaggggtgggggtggggtgggagtggggagcctagctgcttaggttaggcttgttccttcacgtatgttnnnnnnnnnnnnnnnnnnnnnnnnnnnnnnnnnnnnnnnnnnnnnnnnnnnnnnnnnnnnnnnnnncctatcaccaatccacttctagcccgctatctgggaatgaattcaggccagcttttgctcatcagtggcccaacagggaagtcccacagcggggtttccctggaagctcagaacctgcatgtttggtggcatgcagtgaaagagccaggggattccatggagccagatgcagatgttcgggagataacacaatccagaccaagccttgtctcctgagcatgcccacacgtccaggacccttctgaaaggcttcagttgaccaggatgaccgagctgctaatatgatttctagtttcatttcagaagagtttgagtggtcactgcccacacccagagttacctataagagcccagggtgttggaagatgctttaaatctcaccccttccctgcaccaattcattaaaatgaaaagaatccattcagtgcatcgggtggggaaggagaatgccaggctcctgccaggtattgaagctaccagagtgacaagaacactgtcaccgagggactggccctgaggaaagcaggtgtcttagtcagggtttctattcctgcacaaacgtcatgaccaagaagcaagttggggagaaaagggtttattcagctgacacttccatactgctgttcatcaccaaggaagtcaggactggaactcaagcaggtcaggaagcagaagctgatgcagaggccatggaggggtgttactggcttgcttcccctggcttgctcatcttgctttcttatagaacctaagacaaccagcccagggatggcaccacccacaatgggccctccccccttgatcaccaactgagaaaatgccccacagctggatctcatggaggcacttccccaactgaagctcctttctctgtgataactccagcctgggtcaagctgacacaaaactagccagtacagtaagcatatgacataactgctttgtccctcagtagatgttgtgattggaatgcacagctcaggtgtggcaggggtcaccctcctttctgggcagtgtggctagagcaggctggaagcatgtcactcgggagcaggtgaccccaaagcagaatctcagtgcgcatgtgagtggcctggaacgcgctgggcagaagcacaggcgtgcatttctgcgttcctaagcagaagtaggaagtttggaaagggaggagccagccccaaaggtcatggctgggatgtgggctttgtttcaaggaaccagactggttttaagtcaagtccaactggtatttaaagataccattcttgagtgccagtgtggagggtggaaagtcacagaagaaatagaccggagagttctgaagtgcatagtgggctcagtgctccttcttcaagttagacctcactggcgctgaggtctctgttctgggaagcagaggtgtagtcactgcaggtctctggttgagtgaggggcttggattcttacagacatctagaaagatgcccccattgcatttagatgtatctaggcatcctctgagaatagaccagctcaaggcagggtcttatctaggagagtggagggctgtccaagctccccaggctagagaataggcagctagctgggggctggggacgagactaaagcttccatccacgccttggtgctgtagagctgtgtagactccacagtttgctcttggagactggtatctggttagaaataaaattccagggccccacccagcatctgaatctaaacagcaagggaggtgtgtgggccaggaatctacattagtggtgtaagtccttggtgaggcagagtttaggataacccatgaatggcccctggacttggcagctccccctgcccctcccggacagctgaatctagggaagcccaagtaaggcaggatggacctcaatggcctggccatcctgcagtttctgcctttggcgtttgcatggcccatctctacagcactgattcttggaaagcccttcttacatacttcaacaatttcctgcctgattttaaagttaaggatttggttgtttgtttattttgagatggaatctgtatagcccagatcagactataactcaccatgtcaccaggcaggaaggattctgagtgggtgtcttagttgtcctactgttgtgaagagacaccataaccaaggcaacccttaaagggaagcatttagttgagggacttgcttgcagtttcagagggttagtccgttatcatcgtagtggggagcatggtgacaagcataatgctgaagaaggacagggatagaagaggagacagacagacagacagacatattgggtctggtatgggcttttgagacctccaagcccaccccatccccagtgatacacctcctccaactaggctacacctcccaatttttcccaacaaacataggagcctctggcggccattctcactcaaaccaccacagtgggcaaccctcgtgaaaggctaaggtttggatcagggtgacccaaaggtacttgatgctcctaggctgacaagtcagaacaactgccttttagagccttggtttttccatacctccctcaccagagggagggagggggaaggaaagaggaagaagggagggaaggagggtgagagatggagaggaacgagagtggccagagagaaagagagggagaaacactgagggggacagaaatgagggcatcagagatagaaaaagtggcagcggtgggcagagtggggctgaggtcgggtaaagacagcccatgatgtcatccaagcccctccatgcttgttaatctgccctaaccccaggctgaggctagctgccaccataccaggccccagagcctggaatataagtgcctgtggcttgcagtctcccctttggctgaaggataaaagctgctgacgagtatgtctggaatatctgactttttccagggcaggggaaaaagtgtgtgtgtgcacacaagccagcccatcacaagcctggctgctgcctggggtggaaagactgcctatctgacaatacgcagatggaggagtcaccatgaacctgctgccccagcctaacaacacttttcagagcacgcacacacacacacacacacacacacacacacacacacacacttttgtccctaagtactgtcaagggcagagaaaactccctggggagcagaagcatttggtgacagggttgatggaagaggagaacccatcctgcaccactacaaactgtcctgtgacctctgctcatacacaaaataagcagagaactttttaaagtcatgcctgagaatgcacaatggcgcttatccaggccccctctctggcccatccgaagcatctggatgcagcaaattcaccgcagtgctcagcgccgtgaaggatttgctcatactgctaagtcccctcctctttacccatagccctgaaggtctcagggtgccttccttccgatatccctagagcatcatttcgtggcttagaaaacatgccttggaccagacgttggttatgagcctacaactgtgctcattctattggacccagcacctcctatttgccctgcagagagaagagggtcagaaagagcaacaagacccaagggagggggcaaatcaaaggtcacctgcaactcccattaggagggtggagatagtagggatacagataagagtgatgggtgaccctgggatgaccctggggtgcaggacctgacacctggacctcaccaaggaaatagagtcatatgggaagaacactggatacggattctgactcttcactgtgcacttgtattcacaccagttttattcaccagcccttcccatcccagcaggcagtgcaaagaccaatacataggtttgaatggtctggaatccaggctaggagctctgtgtcagtcacatgatcccgtgcctctggtttctaatctataaagtagggacgctggccattttgcattttaccagagaccctcacagatttactgttctctagcaatgtgaggtgtcacccccccacacacacacacctgccactgaaagttgcaagagaccccccttctcgtggagactgagccttctgtgtagtgcgtagcctaagcaggaagaagaaggccttaggcatctccctcaaattttgtacaaggatcacacagtcttaccttccacggcttcagacccattttctgtgcttcatgtgtcatattaatcaaaatctcttataaaatataagccagtcgtcagacatcatgctggtagggtgtgagaatgtttgggcacatttgtattcatagatttggggaatgcttagagactggcgcatctgctgcctggaacattattgctcacagacacgggcttttctccatttaactctgtttagataaatctaggaaagagcctggctgtctaatccagtagttctcaacctgtgggtcgtgacccccaaagaccactgggaaaatgtaggtgtttacattatgatctatgacagtagcaaattacggttatgacatagcaacaaggataattttgtgtctggggatcaccacagcatgaagaactgtatgaaggggtctcagcattaggagggttgagacccagtgggctaatctgatacaaaaccgcctcaccgtctgtctcctaaaaatgctgcatttgttttcaaaaccactcaagtcctggtgtacaggcatcccacctatggcttattgtgtgcctctcccactagagagcaagcttgatgactgtgtgtctctgccagacctccagtgcctgaacaagcacctaatacgcagtggatcttagaggagtacctggcttaagaaattaataaccgctctgtgtccctgaggactgcagaggctatcagtgccgatggtcagctaccccaccccggctcttctccgactctgagctcacagtgaggagttgctgccggctctccctgtgtaggatggtctgtgacctgtgaatggaagcgaccaagatttttaagctccagtgaggatcagcagggatttctccatttcctcctggcacagtgactggccgtattagatatggtgtctgggatctgcaggagtcctgagagactcttgcgagtgcttgtcgtcctgtacatggggcataagtgagaaagaggtctctgttgtctgatgcactgagatatggggctgcatttgcaacatcacttatcctgactgacatagtaatcctatgtgtgactaccaatatccccagagcttccgaaaaccttcagagactttaagcagcttcaaatgcttcagagtcagataaaagcaaagcttgctttcccccttggaaaatcaggctatgtctgtcttctccttctctttcttgctaggggctggggttgggggagaggttaggggagaggttgggggacagtcttgaaataactcacccaacaggggaaataacatgttatcggaccacctctgaagcagccttgaccatactccttccccttggtcacaaataaaagcaacatgtcctctctcctggaatgagtcacagctgggaaaagtgacccaccccacactgagccaagatgatctgctaaggagcaaagcaaaacaagcaaaacaaaacctcccagtagatgttccagcagatgtggtgagacctcgaagcctggtgaccaaggacaaagtcaaagatgccgctggcccggcacccatcaccccaggtgatgtctctctacctgaactacaggggtttgagtgatttggtgatttttttccccacttcttccctggaggaggagtgtgtgtgtgtgtgtgtgtgtgtgtgtgtgtgtattggaaggagaaggagatgttctatcatgggacatgggaggggactggattggaaaagattaaagaggtgagtcccatacctactgaggttgggggatagttactcccccaccctgaacttttttttttgtctcagagagatggatcttaagataaagttgagaaagttttgggtgggtcacatgacatggcattatactatctccatccacatcatctgtgttcatcccaggagctctggctccatgtcatttccccatcagctctggaagcagccatcactgctccatcaaatcagagccacaggaaaaccaaaccagagtgtcttctatgtagccccatgctggggaggctgcacacctaactgtcccagccagcctcagtctatgacagttgacactggtgtcctcacaggagccttctcagccagggaatcgaagtcagccacaaacgacagacccttggaatgcttgggcgagggaaggacagagatgatggctgttggctattattcataaatagtgtctcagaactggcctcccagggctgtgtgttaccagaatcctgttacttacacaccaaaccatcaccccacactcaagctggtctctgtccccggtcgtacccaaaagatggcacccctgagaggtacaagtttccaaccttgtgaagatgaatagacacagggtagaaacaaagcaaacttttacatgcaatacaggtttctgcaagaagccagagagctgcttgcagataccctagagaggaggaggaaaagagtataaagccaggctgcacttcccccatcacactttgggagaaagtgccaaggaagagttcctgctgggctctctcagttacaaggaacccagctctggaacaggcaggtcctttccctccactctgctatggctctagagcaatagttctcacagtggaccatcagcacaaatgctactatgggaacatgctagaaatacaagtctagcatcctagcccagacttactgacacaggaacttgccagcaagctgtgattttaaaagccctctagggttggctggcctccaaagcttggagcacggatgtaaagagagcaagaggaagggtggaggggcagagtggtggcctctgtgcccaccgccttatcataactttatcagtttggagtccttctttccactccccagaaaccagtgaataaaacgaggcccagagaccaggaacttttcctctgccacccacttgaaaggagcaggattctgattaccaccacttgggggaggggtgcgggggtgggggtggggagagaggctgtggagcagggaaggctggggattccctggtcactggacttttagccattgcctaaatttaccttcgagaggaaaagtgaaagtgaggattccccagccagacactagggggagacccatcactagccgggaaagaaccctggagattaaaatgtaggcgaatttatagacaattccaggtctggtttcagaatccccacacattctatacatacattattgctcccaatactctaacctgagggttctcatcccttttataaggtagcttgtgtgcagagagaacctatgcattttaaccccgcctatattaaacaccggtactgtgaaagtgtatatgaatcattgctatccagtattatttaataagtaaggagaaagagtgtgtacatgttcactatagacatgcccctcccccaatatttctaccagtggtttgttgagacccaaaatacagaatttttgaatttggtgcagtgactctattcccatagttgcttgctggtggctgccactaaatcaatcaaacctgtaatttaaggggggcagggggaggcgggaatgtgagctaggcctaagtcagaaccgcagaactggaaagagcaaaggcgcctgcagctacaaaaccagcctgtagagggcccaggacccttgctagcctacgaccgaccgaccgggcacaggttcgaaaatccacagtcccacctgttctctatcccttgagacggcactgtggacaggcccactagttattaccattacataattttcaagacccagtgcaaaaagaataggccgggttaagaattaggattttcaagatggtggcgacataaccttaagccagacaggaacctatggcgcaccccttggtgctggtaggatgcggacttctccaccctgcgcccctgctcaggtgaaccttccataccaaaggaggtgtgtaagggattggcattcatttccgcagtgattactccagcaactaaggggggaggggcgtaattcgggaggaaagttcctgtccacccatggggcacagagaggtctctcatgatcaccggatcaccaaggatcaccagtcactctaatcccagtcttcggggaggggcagtctatgtagcagaggtgagaagggagagagctgatgtagccagcttcccacgggcagctcggagaatccgcgggccgccttactgacagcggcgggctagctcctgtcccggggccacaccaggttgccaaagccctgccttcccacctgctccccgccccgccggtgttagggcgccctgggagacgcccagaggggacggggcagagctgaagacaggcgcaggagccggcgcctaccgagctcgcgaagcctctcgggtgctcggaccttcaccaccgcctagtcgccgagtcactcctaaatccacgcggctccgacccgcagtcacgcgtgttgcccttccggcctctcggtgggctccgccccgccccgccccgcccgcgggctgcgggccctttaaaagcgcgctcgaccggagccgccccttctgttggccaggctcggtagctgccgccgcctgcgggccttggccatggcttccccggccatcgggcaacgtccctacccgctgctcctagatcccgagccgccgcggtatctgcagagtctgggtggcaccgagccgccacctcccgcccggccgcgccgctgcatccccacggccctgatccccgcggccggggcgtcagaggatcgcggtggcaggaggagtggccggagggaccccgaacccacgccccgagactgccgacacgctcgccctgtccggcccggtctgcagccgagactgcggctgcgacctgggtcacaccgaccccgcgacgtgaggagcatcttcgagcagccgcaggatccccgcgtcttggccgagagaggcgaggggcaccgtttcgtggaactggcgctgcggggcggtccgggctggtgtgacctgtgcggacgagaggtgctgcggcaggcgctgcgctgcgctagtgagtgagggcggggaaggtgcgcgaggtgaagggctctgagcccgggagaggaggccattgccttttgtggccagtccgaacttttaggcaggttacctttggagacagctgctgtcactgcctggcatcctttaatggctgcccactgaccagaggtagttgtatgtgtacagttacgtatcctcagacgggtttgagccttctcccccgtgcgcgtaaacaagcttgtttgtaggttgggactgatggctctccacaaggtcattgtgtcttacgcacaccctcttcttcctttagttgtgagttttaaaaatgaggtagtgatattgacaacgaagtgagtatttgacccttattagggttaatggggagatgactcggtggtcacctcaggttctctcaggctcttcctcctagggagctgttggcatgggaagcctggttaggctttgaatggaagcaggctgtgaggctgaaagatgccaaggtcacctgcacctgaggcctcctcagccctccacacctggctcaacgctctatactctgctccagtgtgtgactgtgcctcgtggcctcctcttcctcctcctgtccccctgcacccgccttccagccctaaaatcactaagctccccgccagttccttccttccacaaggcatccccactggcctgctggcttctcccaatcttactgtaacactgggcaccagtatagagagtttctgagcaagtctgcgctctttttagggcttatcattacctctcgccaatggtgagtttgtatccctgtaataagtctcctccccaccaacccagggatctgctgttgccagaggatactcatacccgtgtgtttacgtagctcctttgaacatatgaagcacacagtgcaatgacagcttccggcaatcatctgtggacatggattacagtcacatcttttggtaaagggccatcctctgttgcctccttcagactgcaacactggacagcagcagctagcactactaccctcactctagcccataacagctcccccctcagccgctccagaatatgtgaaaggaaaaagggggactattcttcctaccatgagcatcccccatacaggtgcctgttaaggagaaggctgggcatgtagagtcctgtgcacgggctgctgttccttgtaaatgctgctgacctgcagacgaatccagtgcaacttacctctgggcccgctgctagctttatctccctccgtgttcctgagtgctttgcagtacccactagccctggacacagaggatgaggcagtggattcactgttatggatctactaaggctcaaattccagaagctgcactgtctgtgagaatatgcttgttgcaattcccgcttgtttagactttgagggactgtcagctttactctgagtttgtgatattcttctggttagcaatgatgctgtgttggcaggattctgtgggtatctgtgcagtactccatgacgaaatgagcatcctcataccacatgagagttgtttatttcccttgctccatccctaaatagtttccagcacttgggaaatagtgtcctccctgccatttccttccacaaggcatccccactggcctgcgacttgctgaggtcctttcactttcttgggttcctgtggcccctgagtagtcgatttcctaccagccagagatgcctgaacaccaaagaggcagcagaactgaagtcaggaaggccacagaaaggaatctctgtttgtttggttttttttaatatttaactaaccgtgagtgttcggctgaccaagagaaagttgagacagttttggtgtgcaggacagactcaccagacatctggtgctaagctgaggtctggctctctgagagggtttatttgttttattttcatttttgaaaagcatgggtcagaaaaggatgttttaaaaggtaatcctggagctgggaagaggggggcaactcagttggcaaagcaagcatgaggacctgaactggatccttagaacccacatttaaaataaataaataaataaaagcaggcatggtagcacatgcttgtaacctcagtgctggacggtgagtggagaccggcagagtcctgtctggccctcactggccaaccctagctactcgtacacatagacacaggcacacacgcacacctcaaactagaaccaaagtcccggctttgaatccgaaatgtcacttagtctctgtgtgaccccatgaatctctgtgttgccctcacttgtctttaagaagcgtggataatgatcttatctacagcatcgtgttaatgtggggattcagtgtagtaatcatatacgtgtacgttgattagaaaagtgcctggcagggtacacaatgaacgtccaattagatataagtgtgaccattgtctcctcccatttaagaccattaatggctacctggggctcactctgccacatagcataagcatggggtacggttttcaagctttgtttggtggtggagttggaagcaggaagcggatagtatatcttgggagtttaggtatgaagtgtcctctagacatggcatccctgcctagcgcctcaggtggaagccagctgtgatgaaacccacagtcccgtgtccgagactcctctgcacctggcttagagagagaagcctttccgagcagcacttgcgaccggcagagcgccatgctggtttccttgagcagtggctggaaactgatgcttgcttacgccactcacactcaaaggccagtggggctgtgaatgacatctgtctgtttaggaggctgacactgggtgggagctgggtggacaaatgggctttcagtaggggaagttttagagaattgccttgccttgcttacgcttggtcgcacttcaggaggtctgtagctagttaacgctgttaagttcagagccagagctcaggactaagtctgagcgctggcaagatggcgcagatgataaagtgcttgccgagcaggtataagattcatgtaaaaagcctagccctatatagtgctcacctgtaagccaataccagagaaacaacttgatggtcaaccagtctagctatattgatcaaactccagaatcgatgagagaccctgtctcaaaaataaaatgatgaacaatctgagaagacaatctatgctgacctctggcttccagacacacaacacctgtgtgacacatgcacacacacaaatcaaatgtgttagatagggaaggaaagccagtgggcttgatgcaaatgcttgcagaggtgagagctctcagaaccaccatgctttgttttggggtaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaagttgtgtctctttgtactgtagttggggaagaaggaagtgcaccgaggtgcctcttagagccatggctttcggctgagggtctgggtggccatgggggtctaagtatcacatgttttctttagggtgttccttcctagagccattgccttgactgctgttgaggacatcaggaggaaaaccacaaggtggtattgcacagagggcttgtcaggggtggtgtccaagatttaggctgctcatttgcatgtgtcactgggcaggtggtggctaagtatgacctgtgaccacaagaggctaggtcatatttactttttggcagatgagtaaatatctgagcaaccttctgccaccctcaactccctgcttcttgaatagacacatttccaggtctagagcagccattggctggagaaaaatgacagcttggacctggaacgataattcagtatgtaaagtacttgctctgcaagcatggtgatcagggcttgacccctagcaccacataaaaagctaggcatagaggtatacatttggtttgtgtgtgtgtgtgtgtgtgtgtgtgtgtgcagcacacacctataaaccacgagccctgtgaaagaacaggagagcttagattcccctcagggctgtctgctgcatgctggccctgggaaaatgtcatcgctgagttggctgagccatgatggaagctgttctgcttgtgaacctgtgaacatggaaggaaatactcacctgtctttgagagagtggccatgaagtgcagggaccaagaggactggaatcacatccaactgtgtctcagacgttctcatggccagcctgtgtcgggccctgtgaggagggcaggactgacttaaccgtggctgtcttacagaggggacatcactgtcagggaagtggagtggcttctattggaccaccagaatctaacacagtattgtgtcttctgaacccacatcattggccacatagttggctatgttttcttattcatgtccttctctctatcaatgaatgtggaattgttcaaaacactgttactagaaatagctagaagcataaaaaaccccatgtcttagtcagggtttctattcctgcataaacatcatgaccaagaagcaagttggggaggaaagggtttattcggcttatatttccacattactgttcatcaccaaaggaagtcaggactggaactcaagcaggtcaggaagcaggagctgatgcagaggccatggagggatgttccttactggcttgcttcctttggcttgcacagcctgctctcttatagaacccaggactaccaacccagagatggcaccacccaaaatgggctgggccctctacccttgatcagtaattgagaaaatgccttacagctggatctaatggaggcatttcctcaatggaggctcctttctctgtgataactccagcttgtgtcaggttgacacaaacccagccaggacaccccagcaacaactgaaaccaaagacaaagaggaaggtgaaccgtgtgcacgctgcagcttctgtcagtgcctggtacttgagagctgggtgtacacagcctgtcttcccatttagtctctaagtctttatcatgtgcaaatcatgtggtttttaagtctagagtagaagaaattagtgtctttccactcccagcacacctgtggtgataggcatgtgcatagcgtggctgtggagacacataggcatgtgatgtgcatggggtaggtatgtatacatataggcatgtgatgtgcatggagtaggtatgtgcacacataggcatgtggtatgcatgggataggtatataatatacacataagcatgtgatgtgcatggggtaggtatgtacacacataggcatgtgcttggcgtgtgtgtgggcacacataggcatatacatagggtgagtatttacatacatagggcatgtgcatggggtgggtatgaacacacaggcatgtgcatggcatgggtatggacacacaagtacatcttttgtgtgctgaagctgtcagagttcatgacagaccagccaataactaaagtgaaattaggcaaacaggatcctggggaagacagctgaggaagagaaggtctggataaggctggaaagttcaccagggctgctctgcagacctctggcttgaaccccagacagtgggtctgctgctgactttcccccattcacttggatgcgttttccatccgagttcagaagaggctggaggtttggtggtttctgttgtaataatcatgtccattctgtaacagtggaaagtattagaaactcagagagcctccgtgccgccttgtttaaccacagattcctgctgtaacctgagctctcagagcactctctctaaacgtctgctggtgatgtgtgttcctaaagcaatctgtttttatataagtaggtgtttcagaggaggctactacccaaaactgtaagatggtgaatcctgttgcttccagttcggttgagccttagctagatcattcttttggcttggaaagagatcctcagcccaagcttggacattagaggcagcaagaggtcattgtagacactcccctgctatagatggtagacctcccagaccagctgtagaacatctgtctcatttccaaaggatcagggaaggagattctagagtagcgcaccagtagggcctgaatttcatcccaaacactgaaaacagcaaaagagaatcccaaaccaaaccaaaactctgctgagaaccaagaagtgaagcccatcctagaaccaaatgcagggacattcccttttctgtatattagaactctcccagcgtctgatgctcttctttccagggggcagtggtcaggtgtgggcctcatctgtgctggcatgggccagaattcccagaccctgtgggcagagggcctcagccacctcttgcttcatggtcctaagtgttatcttaagacctggactcacaacctctttctggtacagagactgattgacaagctgacaggccacaaaaacagactagagacagcccagcctttccaaggagtatatgggagaaagaatcagcatccaggtctgaggagagatagccgtgcagtggtaaagtgtccacgtcttagtatacaccatccaaatactggcaaaacttgctaatgacccccaagattgtttttaaaacacagttttccaaatatcgtggaagagcccctctctctgaagctgtatagaatgactttcccccaaacatagcaaatttatgttgccccttccatacaccacattcctatgtacaatagcacttgataggaccccagggcagctacacaagttgtcgccttgatctctgctggatttaaggatgtgtgactgagcgagcagatatcccatgttgttgagaaaaacatattgtcctcgaaatacataaaattgttgaattttatgcattctttctcaaaccgtacaaaataacaatagacagaatgcagcaggcttcagaaggggagggaacagctgtctagagcataatagaccaaaacacaacctgagcttaacccatgagagacataaaaaacaaggtttgtttttaaattaacaaacccaaaatctgcgaagaaattcttggcgttattaaagactgatttcagtgcccctgaatgttagtcagatattctaccactgagccagagggtcttgcttaattacccaggctggccttgaacttaaatcctcctgccccagtctcctgagtagctggaattacaggcatgtgatgctgtgtttctatattaaagaaggatttgaaactatgtgctgcaaatctctgctgagtatggaggatctctgtaggtcacgtgatctggacagaacctcctagctggatttctgtgaggaagggaggggatggacagcttcattggggttcagagtcaaggctttcttcttcgagaaggtcggaggatatgtcctttggctcagggcgttctgtttgactttggaggagatgggggcacaaacaggtggagccagtgcttggtagttgcttgggactctgggactcccatagagggtatctggagtccagtgcctgctacctggccaagcacaagaagatcaggatgactctacccgtgctcaaccttctgacgttcatgtcctctgactaaaggacaagtcctcatctctccctggctctggtcagtgaggctgggcagcctgagggtggatctttcccataaggttcctgccaccctggtgccagctctctgactcggtctgggcagcaggctcttcagaaactctctcacggtgctggttacttttggatcagagcgggggatatcctgcgagccgccttttaggccaaggagatatttccgtccttcagtgggagaccattgtctactccttagctcccccaagtgctgtacccctcagggtcacattttcctcctggtctctcgcctcttcccaggtatctggtctaagataaatgccctgacctcctcaaagccacacagtccccctccccctctgctgagtgaattgaattcagcaatatgaattcactttggcttgtccctcaggagcctgatattcggctggtaaagcattaccagcccacgacccccaaagcaatccattaaatgagctcctaggctgggcacgtggtatgaggtaacagatgactttggtcggtggtcggaactttgaagacattgatttctcagactcacaggcatgcgtgaggagcgaggcctgggcaggctctcctgcagtgtgtttggtgggggcacttttatcttatcaagctaaaagcccaggaatagaaagttttccattggaggaggtggccgggacaggatctcagctgaggaggaggcgatatccgtgaggtctcaggtgcctattctggtcacaggaagcctagagccctccacggggccagtgactccctctcttggcgccagacctaaagaagagctattgatccgcagacagcttaaaatgagggagggcccagatgaggaggtggtggccgcctgcttcagcacagtcactgtgcgtctccagcggttcttccaaaggctcccaaggagccatgagctctcagaaaagctcaggaccccacagaggctctgcagcaaggccctggctcatggtaggtcccagcctgtctgtctgtgagatgctctggactagagtagaatgggtatttgggcttccgggcctctggtagcttttctcatggaaaaggaatgtggggtcttttaggcagcctggcaattaatagtgagctcagaaccatttcttggtcccccctccatccccccgactctgcaaagagcaaggtgtgggtgctgtcaccttggctgattgaagctaggcaggcatggcagatgggcacactcgtcctggtttgaagaccctgtttaggctgtgggttttagaagggctatgacttaggatagtagccactgggaccaggcttcctgatccagtagaacctggtgcctttgagggaccattctgcctgtctcttagcttacacggcaagcattgtgaagcagagtgagcaaggaccatcgagtagcaatggatgctgggcaaagctttcctaccagtgttgctagtgaaagtgtgaatggtgtgcagggctggatgctgctgggtggagctgtctggaagagacctaccctcaggcagtgactggccactgcttgcttttctttcctgaacactactaattaggatgagaatagtccttagctgggatagagagacagaggaggagtttatgaaagatgagcaggagagacaatagcaatcaattacctattctcattgctgcttcattcctcctcccctatttcctgggtccagcaaaggctctgctagtggcagcatagggccgaggatggatggatctgagacactactttccagcaaaggacctttccgctgggtcaagttttctcttacactcttgtggtactgtctgcagaaaactggagacattcctatttatttttagtgtctttcacttgctccagatccccatgtggagggaccgacagaggaattagtcttttgcagtgagtccatacagagtagtgaggccctgtcaagggtcactgcctggcagccagggctggaaccctttgccactggattctgctcattgcactgacatatgaccatttcctttggatggttggaagtctttgggggtgcattgcctttcattggccacccacctgcttctatttctcaatacatacagaggtaagtggaaatccaggtactcacagcatatcttagaattggaactaagattaaatactatatctggaccaaaaatttggaatcaaatttttttaagtattatggtgtagtgacaatgtttgaattttggtttcttttaaaaaacacggaaatgttataaaacatgctttcattttaatcccaggtctggggatctggggctcctttggactatctgaggcaaggcatctgactacgatttgcctcatgttctagcagaggcatggttttgccagctgcaagtagtttctgagattgtgtgatgtttgaaattctgggaacttttcagaaggtacataaatgctagggctcataggtgaggttggcagttggtgatcgttcagggggcattggttgccatttattagtagtagtgttcaaagattgaatcaaaggaaaggaattagatttagggaatttagggattctctctctctctctctctctctctctctctctctctctctctctctttctctccctctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccttgttcctctgctattcagctcaggtaaattatcgactgaacaaaaatctttcaggcctatcagggcagcatgaagttcaaggccattgctacacctcattacaatgtgctggcttcactttgtcagtgtttcaatgtggctgttgccagaggaggggagaacgggtggctagagagctgggagccatggagttctgtctctgccttcctcaaaggactccatgagcagctgggctgtggcattaaataaaacagatatagatacatgtgaacttgcacacagcggtaagacagctttctggctgccaggtctttggtgagcagagtgacttccctgagccttggtttttccaagtgaggcttctccttgggcgctcctgtcattcacattctcaggcagacactgtggacaagctccaacacggctgcctgctcttgctttgcacacaggccagagtggacatctggctcacatgctaaggcatagtgtttgaaggttgcctgggcagaaatggaagcgggatgcaaaactcttaaagcatcttttctagaaaaattcctgtcagtgaattaaccacatcagacaatcaacaggcagagctaggtgggaccatgttgcaccatctggagctaagcaagtgtgtcagcaggtaacaaatctatcctgtgaacggactggactgtgggtgtgggggacgggctggggggagctcagggatgagagaggagctgacctagactctacagaaccctctgtggtcctggctacagggacctagctgcaagggagccttgtctcctgcagagaggctggccacagatgttatctatttacttttcttttcactgaagaagtgtgccataccctctggcaagctgcgctttgggtgtctctaagtgacataaaagcagacatggaaaaaccagttggatatagtggcttggtttgtcccatgaaggactggccctgcctgctcctggccgtgagtaactctctggctctcgggccaggcatacctgtacaagcaggtctctattatactcaaacctgcacatttggaccagtttcttttggtgtcctgcagtctgcatgtagcagacaagattccggcttggctgaggtcagtgggtaactgacccactccaggttactagggtgctaggctaccctctgctccctctcagagttggtgtctgctttagatactaagtaacactggcttcactttgtcagtgtttcaacgtggctgttgccagaagaggggagaacgggtggctagagagctgggagccatggagttctgtctctgccttcctcgaaggactccatgagcagctgggctgtggcattaaataaaacagatatagatacatgtggacttgcacacagcggtaagacagcttcctggctgccaggtctcgcaccatgcccctcactcctgagcttgggtcctctttcagctctccagggaacccctctgtcttcttggggtccccagggatgttggtgggggtccagagctggaggtcctctgctgttttgtcttacttatatgtggagtacagtgatacttgctacattgggggggggggggctgagggagcatgtagcacagtggttctcaaccttgctaatgctaccaccctttaatacagttcttcatgttctggtgacccaaccataaaattatttcattgctacttcatacttacagttttgcactgctattaattgtaatgtaaatatctgatagctttagcgaccacacactggctgtttcttgctcagttctttaaacttgtctcctgtagttcaaaaatattttctctggtaactggagctctcctttctgtgtgaccatccaagcagggtgtgtctgtattgaactctttcttttgttctctccctatgaagccttttcatacacttacttcttcctgttacacaaaatcagggacatgtgtcctgatgggcactgctttgtccaaaaattgtcccgtatcattgcactttcctctgcatgaccacgccctaagcacaacctgggccttcaggtgtggtgtcctgatgaccactttccaccttcataagctcatgaaaactaagatccatctgtcttcctcaccctgacgcacataccccgccatgaacattgactctttcctcccagaacctcctgcttcctaccctacagcagcgtctacacatcccttacctgcctacactctatcaccaccactaatcccactgtcagcaacgtgtatgtcatgaggccatagtgccccagcataaagaagccattaaataggggcatgtctctttaaggttacatgctgtaccattaggaaacattgcatacctttaggaagcattgcatgggaaaattataaatacactccctacagatagtcaagagattacgtaaaattgagaatagtttagcaactgtaagaggactgactccattatgaactgacttgcctgctctactctactctgtgacatgagcccagtcactctacccctgagctaaagctggagctaattttagacaacgtatgaccattgtggttaaatctgtgtccgtggtataaatgttggaagcatcgaaaaaatacagaaagaacaaatctgggatgagaaagatagtcctagcactcatgtgtcagttagtgctatctgcaatagaagccgagtccctgcaaattattctgctaaatttacaattgagtgcacaagcacacacacacacacacacacacacacacacacacacacacacacacacgacagggggcatgcttcgggtagaatactctcagatagcaaaggagcgtagatagtactggaatgtgcaccaggtgacctgtgctcctcctaccccccgagtcactgacatatggcagatgctgctgagcccctcctgctttttgcatctcctgtctgaacttgttgtgggctgagctttctcccgttttttttttagccatcccaacagccctcatctccagcctggcctcatgctatgtctgccctctgttggtggtgtcagtctgggatcgtgcagttgcatttgtgatagatgaatgtgcaggctgagaggcacacctacacacacctacacacacccacacacgcccacacccgcatggggcaagactgtgcctctgcaggcctgcctggaagccagcttctgccaggtcaattgtctgtatctgggacaaaggtacaggagacatatgcagtgtgcctggggagtgacaaggagcccatcatgaggagctagttactgagatgacaaagggagaggccagtgtcccaaggaatattgataatctgtttcttgagacaggatcttaccctgtaaccaaagcaggctagatctgccacatagcccggggctggccttcaccctcctgccaagtgttgagattataggtttacacctccacagctggtccagagtctgttttaatatctgctaagcaacaacccgagcaaagaggtcctttaagaaagagtagacacgtcaacttcacccagtcttgccctagcaaaagggggtcattggcagttaatgatgtccatagtcttggagtaagctttggatcacttccttaggcctcagttctcacaggctccccaacaccaccctacttctctacttctgaagcttggacctgtaagacctgctttcatgaagtccaccttcactctgttttacatagcaaccgaacagcagagtcaaactcaggcttgctcaggtagggcctctctctttcagagataggacagctcttcagctgcgtcttgcctgtctgtgagagagccagcaacttgacctcagttctaggtctctgttttactactgtatcaatctttactgttggttccctggcatgcattctgacccccttactttgtgtgtgtgtcagtctgtctgtctgcctctgtcttatgtctcttttatgtttggtgtatgtagtgggcttgttggagtggtctgcctttcttctgaaacaaggaggtacagttcatgggagactatgccctcaagctccttcctggaaaggctgagacacaggggtcccaaactggctgtctgaccctgggagtaggaagtttccatcctcctgttgctggactcattaggagtttagccaggagtgtgaaaactgtatagttgatttgagctgtggttgcagacctccagacctggtctctgcagcatgtctaccattctactcatgtgaaacctacttgcccaaaagatctcatcttccatccatctgcctcactcctttggaccagccacaggcagaagtagctattagtgtaccaccaatgaattggaaaattagtgtgcccctaatgaaggggagagttagtgtaccacagatgaaggggagagttagtgtgcccctgatgaaggggagagttagtgtgcccctgatgaaggggagagttagtgtgcccctgatgaaggggagagttagtgtgcccctgatgaaggggagagttagtgtgcccctgatgaaggggagttagtgtaccacagatgaaggggagagttagtgtgcccctgatgaaggggagagttagtgtgcccctgatgaaggggagagttagtgtgcccctgatgaaggggagttagtgtgcccctgatgaaggggagagttagtgtaccacagatgaaggggagagttagtgtgcccctgatgaaggggagttagtgtaccacagatgaaggggagagttagtgtgcccctgatgaaggggagagttagtgtgcccctgatgaaggggagagttagtgtgcccctgatgaaggggagagttagtgtgcccctgatgaaggggagagttagtgtaccacagatgaaggggagagttagtgtgcccctgatgaaggggagttagtgtgcccctgatgaaggggagagttagtgtaccacagatgaaggggagagttagtgtgcccctgatgaaggggagagttagtgtgcccctgatgaaggggagttagtgtaccacagatgaaggggagagttagtgtgcccctgatgaaggggagttagtgtaccacagatgaaggggagagttagtgtacccctgatgaaggggagagttagtgtgcccctgatgaaggggagttagtgtaccacagatgaaggggagagttagtgtgcccctgatgaaggggagagttagtgtgcccctgatgaaggggagttagtgtgcccctgatgaaggggagagttagtgtgcccctgatgaaggggagagttagtgtaccccagatgaaggggagagttagtgtaccacagatgaaggggagagttagtgtgcccctgatgaaggggagagttagtgtgccacagatgaaggggagagttagtgtgcccctgatgaaggggagagttagtgtgcccctgatgaaggagagttagtgtgcccctgatgaaggggagttagtgtgcccctgatgaaggggagagttagtgtgcccctgatgaaggggagagttattgaactgttctgactgccttaattcagcagaagagggcctggaaatcaagaacatcttggctagagcaggcatggtaacacatgtctgtaatctcaaccagtgaggaggctgaagcaggattatgcatgtgagttcggggccagcacagacggcctactgagatatataaaagctgctggctagtgctaagttacatgctgaatcaacaaaaatcaggagtatgacctcccacagagctgaaaacgcctgccgctgtttattgagcaactatgaagtatcaggtgcccctgggtgctttatctaaacattctctaacttttcagaaaaatttcccaacaagaaagctattattccgatattttagacaaactgaggctggatgagttctaaatttaactaggagaaactgttcagacatctcatacccaagtaggggcttcaagttcaaaactgacccatgtggctccaaggataacttgaattatatccactctccagcaccaggctgagtatcataagggcctccagctgatccccggctgatgagtagagagaggtactggtaccatcctatacggcagctggtgctgagagtgccctgtccatcctgacgccaccaggaggagggtgcagtgagctacttcctgctggagcagaagaaaaagcactcgtaactccagccctttaaccccagcctccctaaccccattcaggagggactccaccttggcctccaggaggaggggcaccgggattaagtggggatgctgctgaggtgtacgctattgcatgaccaaacaggactgctgcacagcagtcacacatgacagatcgccacgctccagctgctgcctgctggcggtgaggctgccagctcataaccttgcctcttccattcactgtcgctctagctctcaagtggaggttgattaaaggagccggaaactaatgtctgcacagaaacctacacatggatgcttctcacagctttacttagaattattaaagcttggaagcaaccaagacattctccaagcaggtgaacaatgagcgtggtacatcaagacggtggaacatttgtcagacagttaaaagagatgaagcgatcatagccataaaacagatcctacttggtgagaaagccaatctgatagggttacatagtgtattatgccaggtttttgttgttgttgtttctttctctaaagatttatttatttatttatttatttatttaatgtatatgagtacaccattgctctcttcagatataccagaagagggcatcagatcccannnnnnnnnnnnnnnnnnnnggtgtctgaagacagctacagtgtgctcacatacatgaaataaaagttaggggaattttagggcagaaaaaacattttgccataacccatgagcgcacatctagattcacagagtgcacagcactgtgtaaacctgatgcaaactgtggccttggggcagttgtgagtgtgggttcatgagctgtaacaaatgcacctcgcagtgggctgtttataacaaggaggcgtacacatgcaggggagggttataaagaaaacgtgcttccctgttaacttaaccacaaacctacagcttctccaagataccctactttaaaaaatacaagtagtcgggcgtggtgtcacacgcctttaatcccagcactcgggaggcagaggcaggcggatttctgagttcgaggccagcctggtctacaaaatgagtttcaggacagccagggctgcacagagaaaccctgtctcaaacaaaaaaaaaaaaaccaaaaaaaaaatgcaagtagaaggatacgttatgcagcccagcatggactatgtaaggtcctacaggagcactctctagcagcaaacagtggttggtacccagtcatcatcactgacttttctctttttcacagtgttctggtccaggttgctccttgttggggtctttgcaaacaccacagccagcagagtaatgctctgcatgaggcaagaaggaaatcttctcacgcagttcaacatgacttagtagctgctatttccgacttccagagtctgaccctgggaagtttactttaggcatatttaagtacagcacagtttgaaaaacaatgcaaccccatatacacaagaaggcataattgcatggaaacttgtctcaaaggacacagcccttcttccatgaagatgggttctatggacaagctgcatgtattatcttaaaggcctaggggaggatctgctgtggtcttggtcatacaggtagcatagaggtcatctagactattagatagccccagtcctggttgcctgagcttggggtggtctggccctacagatagtgcgaatcaccaggctattagccatctccattcacaaccttctgggtggaaaaaccagctaatacatcttttcccttgaaaagagaacctgtgtgttcaacatccctgtttccctagtgctatctgtgggttcaaggacctttgtgctcccaacaactactgctgtgatgaaacaccaggagcaaaagcaagctggggaggagagggtttatttgacttacacctccacattgtagtgcatcactgaaggaaatcaggacaggaactcaaactgaaaaggaacctggaggtaggagctgatgcagaggacatggagggatgctgcttactggcttgctccccatggcttgctcagcctcctttcttattgaacccaggaccaccagcccagggatggtaccacccatgagttgggccctcccctatctatcactaaccaagaaaaatgccctgcaggcttacctacagtctgatcttacagaggcatttttctcaattgaggttccctcctccctgatgaccctagcttgtgtcaagttgaccaaaactagccagcacacatggtatatttcccatcatatatccactgcaaaaccacaaacaacttagacaactatagagagaggatacatgcctgaaatcccaccccttaggccttccttgcggacacttctctatgtatggcattatagaagtatgtatgtattttatacgattacgctcatgagacagcattatttcctctttcatgttgaccagagttgagctgcatcacatatgatagccacgttccagttcatggagaaataggtcatcacagttgtgagtcagctgcagatggatgtttctgacgatttgtcgtgataaagagctgtgggccgaacatcttagtaagatctatttaggtagtagacacacccttaggagaaatctccgcaggagccagtgcctcacataccaatagaatgtttcctcacgtctccacacctgtttatgagacctttcctaaggagatgtgacagtccactcaccctagaaaggaacccaccaaagacaaacttgatgagccagtgagtttttattggggtcactagtaagaatatgggtgaggggttactttagcaggagcaggatgactcaaaggcactcaaaggcagctgcttttctgagtagcctacctgacaggtgacaagcctacctgacacaggtgacaagttacgtaagctgagtccttaagctctgtgctcagcttacaagcagccggtaggtcggggaatctcttttctgccacagagggcattggtctccttccctggccagctttctgtatctgcaaccctggggaggggtcctgctaaacccagcaagtttcagctttcctagacaagcgtccctgagtctcatgggcaccccaacctcctccctcctagagggaatgtttcagttcaggggaaactcgcctgtgatcatgactatgagcaatagctttcttgtctaaaagtagaacaggagtttagaaaattgagtgttgaggggagcaggagagcaatttgaaaagaagggaaatcccagggcagcagaggtccctcttcaggaaggttacctcattggatttaggggacacctgatgtcgtcttctgagtagggaaacattaggggccctgaggaggcgtcaggacctgttgcttcaggcctcggtagaggtctggaggttggcaacactgaagggatgtgtacagacaggcctttggatgcttgatgctgaggcagacagccactctggactcagattttagactgctagtaagaatagctagcatttatcaagcttcagtgtataccatggtgcaatagtcccatgtggtctcactgaatttagccacactgtgagatagggactaccaccacctccacttaaaatgaggatcctgaggcatgtaggagttggcacagtagcccgggatcttagcctcatggcactctgggctctcactttcagctaaaagcaaggtgcttccttcctctgctggcactaccaatttatctaagactcttttgaggcatcttggtgagtcagctttaccaacgccaggctggagatttggaagtgcagccctggagacctacagggggctgctgtggccacaaagagagtattcccatctgtcacagagctggaggggcatggtgggataagtaaagagagctagagagcaaggtggggactgtgggaaagtcaggggcaggctgcagtgatggagcctgcctggctaggtggcacagagtagggtatggtctccctgcatggtcttagaaggtcacagctagttcagcctgggggctccaggatgaggaaacctagctcaatgagaaaaggattgtctgaacagccaggacagccaccctggcttgttctgagaacagggacaacccttactccacttaagatcttgggtaaatcagatttcccagggcccattgtccctttagattacccagtagtacccgatacattattttgaaactaaaagctccccctgtgtctggcggagtgttggtaaggctgtgttgcccgtccacagcttgggagggtaagaaagaagttcacacagcaggggaggggaaagaggaataggggagggaatattagcttgggcttccaggttctggactaactctggacaggagagctccatttaatcctcaagatggccccacgaactactgtgattctcagtctatagttgagattaatgctcagagacgttgagcagctcagactctgtcacaaagcaggttgatgaaagtctagaggccacaaagtagcgtctggctccattacaccacagtataggccaggtagggctggccttgaagcatagggtaggatataggggacagcgtggttgatttctcagaaggcctaggatacccaaaggttggtagtggcttcaaaagtcggaggctgtctgctttctcttgatggtccatacaggaaagaggaggaggatcgttgttgactggagtgacctcgaggagccaatgggcactgtgtaactgggtcctatgtctttgggggcctgggcaggaggagctgagggctaaagaggaaacactatattacctccgtatcttgtgtccagctcctttgtggaagggattcttttcaatgcaacacatctggttcagaaaaatgagccacttgggttttgccattacacggcagagtctgtgtgtgagctttgtgtgtgtgaacactttgcttattgtgcatttgtgaaccggggtggagcactgactttggcagctctggggattaagaggacattggcagcatctgcatctggagaaaactgtttccgaacatatggctccggctgctggctttccctcctctaagttcaattagtagatgcaatgttgttgctacacacaatttctcatggtgtctgagcctaactctgttgtttgagatggtaacctgtgggtcaaagccaagagccaggacattggctgttcttggggtcagtaggtggccccagtttcagtccacccatcccatccgtagcccctggccttccagcccgctgctgaagctgttgtccatggggacctccatctgtttgggcttaagtattgtgttttcctgggatggcctgggatctctcagggttgatctatacttcctgtcaaaagaccctaactctcaggacctggtatgaggccccatgtggaaacagggccattgtggatataatacatcaagatgaggtccccctggagtagggtgggccactggttcagtctgaccaggattcttttgaagaagacagacccatgaggagaaggtcctgagatgatgctggaagactttggaggggtatagctacaagccaccaagtctgttactgtctgtgagacctcagaacctcggaaaaggcaagaaagatgccccattcataaggagtgagaccctgtaaacaacttgaggagccaagttcctgccgtgggcaatggtgagcatgtggaaataagagaaaacctgtaggttggtgctttccttccaccctgtgggttctggcgaccacactcaggtcattgagtgagttcccttttccccgtgagctgtctcagtaaccctgacattagccgttctacggctgacagcgctggtgtcagagataccagcacatccatgtctgtctctgctctcctcactgccggcaggtaatgggatcgatgtaggtgctcatcagcggtgggtggggtctgcacacaaggggggttaaattcagctttaaggatgaacaaaatgataccatttatgagaaaatggatagaactgaaaatcatgctgagtgatacttcagactcagacaactgtctctcctgggtagagtctagatcacgtagaaagggaggtggagtggggtagtggggggaagaaagtaggattctccagagggagcaagaagacagaacatgatgtgcaagcatgaaagtgctacaataaaacccatcgctttatattttttacagccaatatacattaattacatggccagagcctgctccctaaacttgtgttgcctcttggtgacaccatgtttgtcctagctattcagtgatggcaggcctgggtctcctctgttccctctaatcaaggcacctgagctggctgcagtcactcctttctttccatgccctgaaggctccttcatcctaagccttagttcccgctgtgcctggaacagccaagtgggagctgactttcagctatttttttaaggtagctgtatttttctgtgtgtcttaactgtttccctggttcctgagagtcctgtctttgtttgttttcccagtaaataaccgcctttgttttctctgctcctcagtgatcttacacggtatctggagagagtagcccttacaccaaatgccaggtggtttgtggggatgctgaactgggtgaccatttagcttccagaagtgaccaggaaccaaagcctaaaatggcagagaaagacaaccaagtgcagtcctccctgcccaggactggagccgcggaagccatggtaacccttcagtgtcttgacctaggtctttaactataccagctcccacatcccctggaccaacacaggtgactgttctcattccttggtgacaacagcatcttccatgcctctggggactgcactctgaagctcatgactgattccaggggacagctgtgggtagggctgcatttggagctgttctagaaaggcctcctgctctgtggccaggtcggccttgtcgagctgtgctagtgtcagcaggcactggtgccagagcacaggcagctggtgcttctctgtccggaaggccagaaaatgaaagaccagaacgtcgagcacccagtaggccttatccagtggggatggagcacttggtgatgctgctgcccacgatgatggcttcgcagagggtacaggtgccagactcacacagccagatcaggatccctttgaaccaggttccaggcttgaacagagccttcttgagtgccatgtagaggtgaaagttgagtcgtttgtattcagcaatgtcacctcgcactccgggaagcagaatgaggttgtagaagcgctgagccatgcggtccttcacgttagaggcaaaactcctggtggcagctgcagttcaggcctcaggcccagtgacatagaggatcggctcccagttggacagctcagaggtgatcttaaaagccttgggcagtttcccacttgcagtacttacataatagctcccagactcctctgcagacttccaggacccggggatccagctgaggcctagggaaacctggtacctatgacatgacgaccgtctccacctctgtnnnnnnnnnnnnnnnnnnnnagcgagttcccttttccccgtgagctgtctcagtaaccctgacattagccgttctacggctgacagcgctggtgtcagagataccagcacatccatgtctgtctctgctctcctcactgccggcaggtaatgggatcaacgtaggtgctcatcagcggtgggtggggtctgcacacaaggggggttaaattcagctttaaggatgaacaaaatgataccatttatgagaaaatggatagaactgaaaatcatgccgagtgatacttcagactcagacaactgtctctcctgggtagagtctagatcatgtagaaagggaggtggagtggggtagtggggggaagaaagtaggattctccagagggagcaagaagacagaacatgatgtgcaagcatgaaagtgctacaataaaacccatcgctttgtacagccaatatacattaattacatggccagagcctgctccctaaacttgtgttgcctcttggtgacaccatgtttgtcctagctattcagtgatggcaggcctgggtctcctctgttccctctaatcagggcacctgagctggctgcagtcactcctttctttccatgccctgaaggctccttcatcctaagccttagttcccgctgtgcctgaaacagccaagtgggacctgactttcagctatttttttaaggtagctgtatttttctgtgtgtcttaactgttccctggttcctgagagtcctgtctttgtttgttttcccagtaaataaccgcctttgttttctctgctcctcagtgatcttacacggtatctggagagagtagcccttacaccaaatgccaggtggtttgtggggatgctgaactgggtgaccatttagcttccagaagtgaccaggaaccaaagcctaaaatggcagagaaagacaaccaagtgcagtcctccctgcccaggactggagccgcggaagccatggtaacccttcagtgtcttgacctaggtctttaactataccagctcccacatcccctggaccaacacaggtgactgttctcattccttggtgacaacagcatcttccatgcctctgtggactgcactctgaagctcatgactgattccaggggacagctgtgggtagggctgcacttggagctgttttagaagggcctcctgctctgtggccaggtcggccttgtcgagctgtgctagtgtcagcaggcactggtgccagagcacaggcagctggtgcttctctgtccggaaggccagaaaatgaaagaccagaacgtcgagtacccagtaggccttatccagcggcaggcgcaggaagatgctgtttgcactgatatattccatctcagcaatctttagcatggcagcactggagtgcagcacggggatggagcacttggtgttgctgctgcccacgatgatggcttcgcagagggtacaggtgccagactcacacagccagatcaggatccctttgaaccaggttccaggcttgaacagagccttcttgagtgccatgtagaggtgaaagttgagtctgaggttgtagaagcgctgagccatgcggtccttcaggttagaggcaaaactcctggtggcagctgcagtccaggcctcaggctcagtgacatagaggatcagctcccagttggacagctcagaggtgatcttaaaagccttgggcagtttcccactgcggtacttacataatagctcccggactcctctgcagacttccaggacccggggatccagctgaggcctagggaaacctggtacctatgacatgacgaccgtctccacctctgtctccttctcagcttctccatgatgatgtcagccagggtatgcctgacgggagggttcttgttcatgaacatttcaatggcacgttcatcttcgggttccatgaccacctctgcctggtggtccaccctggtcattttggctgccttctccagggtaggccattccttaccctcctcatccgatccatcccgtagcactccagccccatccacgtggtgcgctctcgaggttttgctggtccatctccagtcccatgttcagtcttgagctcctcctgcttgctgcaaaaatccttttgcacaacaggaatcccaaatactcttcctcctctttgaccccaagtccccgctgtttttctcgagtccccagccagaatctgcttggagagaggtgcatgcctctcctgatttctagccccacaagtcaccttgaatttaggcatttttgttgaaaaccttgcccacaaggtctatacgtgtgaagccagctaaaagcagagactgtggtctgtgtgttttcaagacagggtttctctgtgcagtcctgggtatcctggaacttcctctgtagaccaggctagccttgaacagagattcacctgtctctgcctctgagtgctgggattaaaggcctttgctaccactccttcagtgagagtcctgtgttggaggatatttgactgcactgtgaacaccaagattgtgaactgaaaaaacaaaacaaaacaacaaaaaaaaaaaacttgttgtggcctgcctcaactgtagcacatatccttaatacaggagctaaataaagtcaatcctagatcaagaggcagagcaagtttgtcagctgtcaggagactgaatgtaaataatcaggagggtctttgagttgaaggggacttaagacagtgtggagaaggagagagagctttttctctctggaacatgggtagagtagtagtgtagttttgtgtcaacttgacacagctggagttatcacagagaaaggagcttcagttgaggaaatgcctccatgagatacaaccgtaaggcattttctcaattagtgatcaagggggaatggccccttgtggatgggaccatctctgggctggtagccttggttctataagagagaggctgagcaagccaggggaagcaagccaataaggaacatccctccatggcctctgcatcagctcctgcttcctgacctgcctgagttccagtcctgatttcctttagtgatgaacagcaatgtggaagtgtcagctgaataaaccctttcctccccaacttgcttcttggtcatgatgtttgtgcaggaatagaaaccctgactacaacaaataggaaggtcagctgggaacattctagaaccgcctctctgaaccagcagggttttcacctgagcatctggctcctgaatattcattgctaaaatcaaacaactgggatttctgtttttaaagcaacagtcctctctttcttgtacttgcgtcttaggctagcacagagtatatggcagtccaggccttgtacgtggatgatggtggcatctacctggcccagtttcacccaggatctgtcttcctgtgcccaaactgaacgccagataaaggttataacacatagtaggacaccagagacagaggctgggtcacagggatgagttgccttgagagaaggatggctggggagggggggttagttctaggggtcccctgggacatggctaaagctttgggacatagagcattgactcacccctgccctgtaggacagtttctgtgtgtagtgatggtccagggctcagatgttaccgatgctggcctagaagccctgagtttggcatttccaggggctgggaagtatgaagatgtgttccaggagttttgctgccgccatgactacatggtcttattagagttactaattattaaagttactggtgttcatgtacattccttgtttttaattgcatagttattttgttttgttgagacagggaacccactatgtagaccaggctggccttaaactctgccctctgagtgctaggattaaaggtatgtgccgccacacagttttaaagggcgtggtgctatacacattttctgaagttccaaacctgctcttgggagtcttccattcctagcttgaccagttcagtttcagaactataaaaaaggtcttcctgaggtgttggggcatgtgtgtgtcaaagagaagcagtgaaagaaagcagcccaggtgcacagaacgtgccaaccatggcagacactgcgaggcgaagagaggaaaccctgtgctctctggaggcatcccctctggggacacagtggctctcaccgtggagcgtcagagtttctagcccaccctctttttcatgtccccactttttaaaatttttgactctggagcattcttcaacactcagagcgtgaccagaagccacgcaggtgtgtccccagagctgagccccaaatggccccaccctttatgggctctgcccccagtgttagattatcagaaactggcatttctggatgctacagttgaactaggcacaaagccctctgtgccctttacccactgagggtgagctatctccactgagctgtgtgtcagccattggagctccaaggcacctttgggacactgaaggggcatgatgtggcctcagaggactgaccttacctgttatgacttctgttggttgttgcccgacccctaccttccagcttgacacaagccaaggtcatctgggaagaggaaacttcagttgagaaaaatgcctccgtcagattggcttgtgggcaagtcagtgggcgtatcttcttgattaatgattaatgtgggggagcctagcccattatgtgtagtgccacctcagggcaggtggttccaagttgtgtaagctatggagagagtcttagttaatgtcctgttgctatgaagagataccatgaccaaatcttgtaaaggaaatcatttaattgggggcttgcttactgtttctgagggttagtccattatcaatcgtcatggcagggagtgtggctgcaagccggaaggcatgatgctggagtggtcacggagagctttacatcctgactgcaggcaggggctgggggctgcaggggctgggggtaggggggagacactgggcctattgtgggctttttaaacctcaaagaccactcccagtgacataccacccccaacaaggccacagtgactgattcttccaaacagttcgccaactggcaaccaagcagtgagcatctctgggggccattctccttcatactaccataaagagcaagccaggaaacagtgttcctctgtggcttctgcttagtccctgcttccaggttcctgccctgacttcccttcatgatagactataaactataaactaaaataaactcttttctccttaagttgctttgatattagtgtttaatcacatcaatggagaaaaagctaggaggatgctaggaaagaactaaagaatgggatgctggcagctttccctgaggacccaagggatatgtgcactaagcttctattagtcgtcaccccaagaaggtggacatgaagttagaccatggaggacgcgtagggttctggaacctatgtccctgtacttgtcagggtctttatataaggactatagcctgggggcccatttgaggggatttaaggaggcagctggggacagcagggatcatattctggaattcctcagctgagtgagaagaaaaccagctgcctcagggccccaagatagagtatgctgcctggcagcttgcagaaaaggagaccaaatgtgccaaatttgaaatttggtagatagaagggattctcggggtgcctgaaccatcatcagccaagagtaaccctccttcttccagaccatccgtgcaagcccaggctttgaggtccctgcccccaaacccacgtgctctggtttacctcaggcccctggcttcacagtcaggagagccagtatgtggagagctttgccctgactgagctgtggcaccttcaggacaagggaccacagctggcccggcagccatctatgcgaaccctgtcttctgccagccccaccctcctgtccttttctcctgcctctggctgagtctctctgcttcctggccccttggaccgcccttgccttttgccaaggaggctctagaggaaggtcctgggaaacaggaaacagcagcgtatgctctgccacttgtggtatgtgccactgcgggccttcctttccatctctgaggaagtccctggatgaaagtctaaaggttcttttcaattctggacattaagtctctacttccatggatgagaacaccacctctggaaatttgtgcctttcccccagtttggggtatcgtcagtggactattccaatggggttaaaggaagcaccccaacatttctagtctagacagggccagagagagaatgcgtgtgataatgactttgcctttggggtaattttaatgcttgcagacataccctcttatgcctgtagaaacatctttacgtcacagtctggataatacctatgttttatagattgacaaagcgaagctcttccagggctatatggcctctggttatcaatatgtattggtagaatatatagccagatgatctgactatgaagaaatcactgaggaccccaggtcccaataacgaatgcagagtcacaccagatagtgcaggcagaagcggtctgcacgggtgtgaagcatttgctgccaccatttgtgccagtgcagaggtcagatgtcacccttacacagtcccctgcactccccctcccctcttcttcactatactgcccttcccatcagtgctaaacgcaatcccagtttctctggtaaagaaggtagacatctacctgacccctgatcccttttatctctctccctctagattgtaaattcacctgccactcggagtgccgcagcctgatccagctggactgcagacagaaggggggccctgccctggatagacgctctccagaaagcaccctcaccccaaccttgaaccaggtaagcaggggagcccgcaggccaggctggagagcagcccctgtaggtggcacaagtccatatagacaagctgttctctggccacacggagcctcagacacaccctaccacaggggtctgggaagtgacaggcctgccctggagatttctccatgaagtctatttgtccctgggttctgattcaggtataggtgcagatgggagcagagtggctcctagagaactttctagaagacctgaagctccacacatcagcttgcctttagatcatagttccttccagacttctcagaccaaccttcaaaggggctgggcatttctctgcggaagcaatgggagtatggtgtcctcagtggctcatgattctgaggtttacaaagcacacaaatggccatgcatctgaactgtaatgtttagggattgggctgtggaggacagagtgtattgattgttgtgttaaacattcatcaagtatctgttatgtatcaagtgctgttgaggatatgcaaaataagtgataacttcagaatggtccacagagagcttccatgctggctggggaattgtaacacagctgactggtagataccaggacatgtgtgcaataagtattagccaagtattttggggtacactgtgtaattgtttctgctaacattttaaaaagatcacggaaggcttcccgaaggaggtgacatttgatgtgagccttgtccttcagggtgagggcttgctggtcagggaagttaagtgtaaataggatattactcacttattgatttagcaaggttttaagtgtccactatggggggcttagtgatacacttaagaaaaatggctcgttcctgtcttatgcttacagcaaggtgagaaaggagcaagctctgactgtgagggggaaatgcacaggcattacggacgactcacgagcagtctcaagtccccacagccttcaggcacgtgctctgtggtgtccaaatgcctggccctcccgcggacattcccaggtccccgctgtctctgtgcctgctcccatggaacaactgtgatatgtgtttacaagggattatatcgaactgtcctaagatgtacattgaaagcttcagtgccccctctccagtctgtggggtcatggcgactctagcagagtttgcagccaggcctctgggagcagcctggcctacacacaagacctgagatgcactgatgagcaatgcagatttctgtcttgcattctgtcttattttgctttgctttgctttttttttttctgctgctggcaatggaacctgaagcttgctgggccggtgctttgactgagctccccctcagcagcctgttaatgaacattcccttataagacagagagcgaatagcacagcatccctataagggttttgtttttgtttgtttgtttctggtttttccttcttgtttttggaaacagggtttctttgcatacccttggctgttctggaattcaatgtatagaacacactggccttgctggcctccaactcagagactcacctgcctctgcctcctgagtgctgggattaatggtatgtgccaccactgcccagcccctaaagtatatttaaacaactgctttctccagtttctctttctcttcgggttactgtcaagtctcttctttctgctcccaaccttccctatcttggttccctggatctgcttcttggggtctctcatactctatctaggacaggctgcagaaggaagtgatttgccccctcccctgagacgtctggccctgtctggagatggtttggtttgtcagctgggacctagtacatagaggccaatggttctgctaagtgatctacatgttgcaatataagccacagaaaggcagaatggcagcaactggccccaaatgtcagctgtgccgaggtggaaaagcctctgtaggctgtgggccaactcccagggctatggacagaaggcagggaagggcatggttttattgcacacacacacacacacacacacacacacacacacacacacacacacacacacacacacacacggtctctttcttagaacgatggccaggaggggcgctttccagcagttccggcctccttggaagaaaaggcatcccagagccctctggctgagtcatggctgtctatcacagaagcagctctgcagcattacagagatgtaagaaacccacacggtgccagtccccagcagcaacagctcctgtgggcccaggttgctgggcgctgcggcatgagccttggacaggcttggccctggccttcagtagagtgccccgccaggctctgtggggaaagccaggccctgatccgggttctttgcttcttctaagaaacccgttcatgctgatttccgccttggcttggattcggatatatgagaatggcaggtactttctcctatctggttggtgttctgcctggctgaactaactcacctcttgccatcttcctgaagatttatcgaggcagaggcctaggcctgagctcagcaggtgagggcccaatccaggggatctattgtgaggtctcaatccggtggcatttctccttttcgctacttaagggaaagaagatcatagattttttttcatcagctggaaagaagcagtcttacatgaattttcatgtatcccactgtataagcatttacgtgtgtgtgtgtgtgcatgtgtgtgtgtgtgtgtgtgtgtgtgtgtgtgtgtgtatgtgtgtgttactgagaattgaagccggagtcttgtgcactcacaagaggcattcacgatccactactgaactgcaactcccagcccttcagacatttttcaaaatatgactgagatcattctacagatagtatttggccttcaccttttaaaagcaataatggcagatttctgactatctcagcagaggaaggaagaagggaaggcagatgtgggagggcaggatggcttagagcctcatctctagactgcagactcctgaggccttgtggtccctgcacctccttgggaaagcatgagagctgcctgcttttgcaagccaaaagatgaatggttttacaagtctttcctctggaatcctcaaagctccatgcctttcccccaggcacctttagtgtgatcagacacatctcctgcaggccttaaaagtgctcttactatgtaaccccagtgatgagagccccagtagcaccccagtgcacccacagtgaagcagcctagcccctccgtgacagcgactcaagagaagatgctgcgcttggctgcactttgattctcatttagcgtgctctcccgatccagacagctctggccctctggctgttgacacacttttcttagaaatggaatacataaattgtaagagacaaatcgaatcccctccccccccccaccaccaccctgttactcaaaccctatttcccatttcttctacccagtagactcctgagcatccttctggagagaccatctcctccagcagcagttcccgggccacaggcactctcttggcataatcctgcttggggccttatagccctggccttgctgcacatgacttgtttatttcagtactctgtgcatacgagcgttttttaaaaatttatttctattgacttgtttgtgtgtgtgtgtgtatgctgtatatgtgcacatgtgtgtgtgggtgcatatgtgtgtgctgtatgtgtgcacatgtgtgtgcaggtacatatgtatgtgcagtatacatgcatgtatgtgggtgggtacatatgtgtgtgcacatgtgtgtgcaggtacatatgtgcatatgtggaagccagagatcgactctgggcattgttctctgagacagtctccctggagctggggctcactgattaagcgaagctagctggccagtgagctccaagagccacatctgcagcgctgtgatcacaagcatgtgctactatgcccagctttgtacatgtgttttggggatcaaacctttggagtgggtaaaagtccactcatcgatctgacaacccaaactagatatggtcagatgtcctaaggcaagggggaaattacttccttctgtgaccggctgttctagaggaaagtatagagactccaagcagtagatccaaggtcaaagccacagctcaggtccttaggtttgtgtggcaagcagcatctgtgggtgcataaagaccatgtctctctgcaagcacacacattcattcgactaaccatagaggtctaagccattgtgccactgtgtaggtgaccctgttccatttcacccaatggacaaatgacttccagatctccagagtggatcgacctggctggtggcccttcaacccaggaggtctgtttcctttctgcctacattcccaccccccaaacatcacacacccctcaaacagacacacccctcctccctgctgttccttaacggagcccgctacagctgagaactgactcagttggcaggagttcaaatctcctgactcctaacctggaactgcctcccacagcacactgtctccactccaggccctgctttcccaggtccttcagaagaggaggggctgccgtctgtgagcccaggaccaccacacgggggagccagagaagaggaagaaaggagtcgcaaaggacaaaagtctttttgtttttaatttttcatgcagtgtattttgattatattctttacccttctccaagcttaatggctctcttctttgtcacagagattcttggtggatttaatatatatatatatatatatatatgtgtgtgtatgtgacaaacaacaacaacaacaacaacaacacctccaaaaagaccaaagcagtaagctgtagaacaaatgcaaagagccaaacgataatatatgtaagtggactcctccagaggaaagcagtcagagagtggaaaaacctgaagaaatgcctataaattccccaattttgagggcaacataaatccacacagccaacaaagcgaatgaaccccaagcaaaagaaacatccaccagcaaagcacatgatactcaactagtcaaaagccacagcaaagagcgggccaggtggtggcacacatgtttaattccagcactcaggaggcagaagcaggaggatctttgagttcaaggtcagcctggtctagttccagatcagccagggttatacagagaaaccctgtcttaaaaaccagaaggggcggggggcatggagggagatgtagacacagcnnnnnnnnnnnnnnnnnnnnctatttgctttttgtgcttgcatgcgtgcaagcatgtgcatgtggtgtttggggtggggggaacaaaagcagtgtctggatccataccatgtatacatgtagaggccagagagggtgttaggtggctttctctatcactctctacctagttagtgagagacagagtctctcactgaacctgaagccagccatgtgtgctgggtggctggccagggagttcttggcttctgcaggtctctgccctttaatgctggagttccaggcatgcacagtcatgtttaagttcatgttggagattcagacttagtccctcatgctcgcaggggagtgttcttacccactgagctatctcctcaacattacagtgtcttcctacagccgtgtgttgttagccatagggatgtgttctgagaaacgggatttgtcagtctgtaaaggtcatgtgttgacacaaactttggcatagcttgttacactcttggcttgtgtcgagtgtatgcagatacatgccttcagcctcccatgtctgaaaaggtccttgtttcgtctttggatttgagttgaaaattataaactgaaaggctttttcttttgttactttagtgtaaattcatttgatacactaatgtcactattatctctcttgtggttctcacctcaaactgttctctgtctcgggtcatctgtatgtggcacagtctctttcccaggctgtgtctacatctccctccctgccccccgccccctctggtttttaagacagggtttctctgtataaccctggctgatctggaactagaccaggctgaccttgaactcaaagatcctcctgcttctgcctcctgagtgctggaattaaacatgtgtgccaccacctggcccgctctttgctgtggcttttgactagttgagtatcatgtgctttgctggtggatgtttcttttgcttggggttcattcgctttgttggctgtgtggatttatgttgccctcaaaattggggaatttataggcatttcttcaggtttttccactctctgactgctttcctctgggaggagtccacttacatatattatcgtttggctctttgcatttgttctacagcttactgctttggtctttttggaggtgttgttgttgttgttgttgttgtttctgtttcccttggggcagttactactgccatcctctgtccaccataaagtggaggtgatctgccacctctagcttgtgaacattcgcatgaatgtggaaaggcagagatccagcccagtctctcctggcagacttgggaagcgagggaacagactgcatcagattcccacccggtctcttcagcgtttgctttcttggttctcatgattacaatttagcctatgtttctgtcctgactcgtttcctagagaaggaatggttcgtctttctcccagtgaattccagaagtggccagacaggtgccagcccgtccacatgtgccacaggagagccaactctctctacctgactctggctacacttggcataccctgtgccgtggcgtctgtcaattccctaccatttcagagccagcagttctacctgacctaacaattctcctgcacccaggaccttccacacaggagcctcccaaggccactttgcccggcatagggagaactcattcttgccgtgccagagccagataccttcaaaacaggatagtacctgagagcctgcctctaaaaagggatggaactccaattctgtcccccgaaaagcttgggagcccctgagacatttctttgtgctccccacagcctgtgagcagtgggcttccaagatggtcattcccgaagccccgaggtgcatggcagcaggaccttcctttctgtgggtagtaccatgagggctaaaatctcacagtagaaggccaccccaccccagattctacaagattagccgcacactggatgggggacctgagggagaaagttgctgaacagaaacgctcctgttctctagtttcatgaaaggacaacaagggcacagattctagacctgaccccagcctgatcatgagctcttcagggcttcagctttttggtgtgggtggctgagttaatccaaccgaactcacagtctatatgcatccagactctgtcggagctcttagcctggcagtcaagcaagagaagcatggtgtgggctagtgtctccgagaaagtgaatctcgagtgagtctaacctaaatggtatacagatgcttatcttgtaagacaggaaatcgtctgtggaaaaactgagtagtctgctttacacggccccatgtcatgctcagaaatgccaccccagggacgggagatagcggtcttaagattgaacctaaataagacatctgggaaaggatgcttctgaggaaggtgtgggacgtgtggtcatcactgggggacaggaagcagaggacagaggaaggggtgtgtgtgtgtgtgtgtgtgtgtgtgtgtgtgtgttaacacatacatctatgtatgtatgcatgtggtagccagagaacagcctcaatgcccattcctcaagaatgctatttaccttatttctgtgtgttggggtggtatgtgcaggggagtatacatagaatgctcatgtatgcgtgtgcatgtgcacgagaggcctgggaagggcatcagataccttccttggccactcatgacattaaccctaacactcagtgactcagctggcctggctggccaacaggcccagaggaccctcctgtttccttctccctggttcaggaacataggtgcgtggcatcatgccaggcttgttatattggtgttggaggttgaacgtaggtctccgtgcttgtgtgacaagccctttattgactgagctgtctccctgacccccagaagaagattttgacaaacagagagaacacgagaaggaaggatggcttctgggaatgcaagtcaaatttagcacagctgtaaggagggaacttggttgtggctgctgccttgatggtaatgggctgaatctctggacctgtcagccagccccaattaaatgctgtcctttataagagttgccttggtcatggtgcctgtctgttcacagcaatagaaaccctcgctcagacactggggctgagttaggagaggtggctcagaggttaaaagcactggctcctccagaagtactgggttaggttcctgactgtccagtggcagccagcaaccatctgtaacttcagtcccaaagactccaacacctggactccaggggcaccaggcacataggtggtgtgcagacatatgcaggcaaacacactagtccttgccccccagtgtcactgcttttctggaacatgctgaaccccaggatgaatatgacaagggctgtgatctcctattaggatgacgtgtgaaccaggaggacagcctagcatcatgtctttcattgcctggccctgagtcaggggagtgggccactcaccgttcaccaagggtttcacaacctgcgtggtgcaggtagggctctgcacggcacactttgggcccagtcctgtccctggccccatgggcatgataaggcagatcccatgttctgtggcttaccccttataagtttgaattctgccacccaagctcctccactccccctccattcccaggaccaatcgatattactggtgttcattattcaatatcaagattccaactaggtgctcacgacagactgacggacagactgacagccagccagacagacagacagcttcctccttttcagactctaaggatttcagtcaggatttttcccccctaaaagctgctcaacttgctctattgggtatgatctttgctggtttcttttcatcccctgggactctgtctgctgcctcaactttgccgacttcttactcctggcctccttccaagcctagatccaccggcaggcggtggtggatgggaaagatagcgtacctaggagtcaggaggctttgcaaggaatgagctggatagaacaagttactgccattgggtttttttttttcacctgtaaaatgggcataatatgaccagcagtctcaactaacctggacccttgagatctctcagacactgagccaccaaccaggcagcatgcaccagctgatatgaggactcccaacacatatacagcaaaggactgccaggtctggtctcagtgagagaagatactcctaaccttcaaaagacttgagaccccaaggaatggggaggcctggcaaggggtaggatgaagggatgtggaggtaggaacatcctcttggagacggggggggaggaggaatgggatgaggaactgtgggaggaggacagacggggcaggtaacgactggattgtacaacaaaaataaaataaaagtaataaaaaatgtttaaaatgagcgtaatacctgctctcaaggttatgtagtggcctaagcgaagtgtgggtatcaaaggcactccgaggggctggagagatggctcagcagttaagagcaccgtctgctcttccaaaggtcctgagttcaaatccaagcaaccacatggtgactcacaaccatctgtaatgagctctgatgtcctcttctagtgtgtctgaagacagcaacagcatacccacatacataaaataaataaatcttttaaaaaaaattaaaaggcactctgaaaaccctactcagcatcacctcacagtgtctggcatagcatggagcaacact

SEQ ID NO: 1304 - DNA, 610 bp, Mus musculus
tctgttggccaggctcggtagctgccgccgcctgcgggccttggccatggcttccccggccatcgggcaacgtccctacccgctgctcctagatcccgagccgccgcggtatctgcagagtctgggtggcaccgagccgccacctcccgcccggccgcgccgctgcatccccacggccctgatccccgcggccggggcgtcagaggatcgcggtggcaggaggagtggccggagggaccccgaacccacgccccgagactgccgacacgctcgccctgtccggcccggtctgcagccgagactgcggctgcgacctgggtcacaccgaccccgcgacgtgaggagcatcttcgagcagccgcaggatccccgcgtcttggccgagagaggcgaggggcaccgtttcgtggaactggcgctgcggggcggtccgggctggtgtgacctgtgcggacgagaggtgctgcggcaggcgctgcgctgcgctaattgtaaattcacctgccactcggagtgccgcagcctgatccagctggactgcagacagaaggggggccctgccctggatagacgctctccagaaagcaccctcaccccaaccttgaaccag

SEQ ID NO: 1305 - protein, 203 aa, Mus musculus
LLARLGSCRRLRALAMASPAIGQRPYPLLLDPEPPRYLQSLGGTEPPPPARPRRCIPTALIPAAGASEDRGGRRSGRRDPEPTPRDCRHARPVRPGLQPRLRLRPGSHRPRDVRSIFEQPQDPRVLAERGEGHRFVELALRGGPGWCDLCGREVLRQALRCANCKFTCHSECRSLIQLDCRQKGGPALDRRSPESTLTPTLNQ

SEQ ID NO: 1306 - DNA, 20478 bp, Homo sapiens
  misc_feature (1)...(20478): n = A,T,C or G
aataaagaaaaacagcttagggcaaatctgccctgagttaggccccagacgaaaggggtatggtcctccttattttgttaagaatatttaaatggaagcattagagaatcactcagggtcggggtgtcgctgtgaacccctagcacccagcctctttacatggctgttccccaatcacctccagagctaaaagaagacattgcccttttccaccgcataggacatgtgagcacaaacctgtttttcaccagtgccctggacatgccaagtgcattgggaacagctcagccatctgccaccaatgccaggggcttaatcggaatagatgaattccatgccagatgcactgagatgtgtgagcccccaggagagacacctcacatgccaatgtctatatttgttaaatcataacagagttccctattctgtctctatcttgggccaccccaagaggcaaaactgtctgcttggtttctcgctttgtacccgtggacagatccttaagaatctggcaggtgaataggaatcagagtctttgtcttatcctctgaagattgctatagtatcgatctcgctctcatggcagatagtgcctgttaggtaaacctttggggtgtttgtgtgtttcttggcaccaagtgttaattcagcagctggatgaagacccttgaggtctggaattgttgtgaggggtctgtctatttcagttcttttcgaatgttgctgcgaattaaaatcaactaggagatttttaaaattcccatgcccagactgcaccccagaccaattaaatcagaatctccagggatgaagcccaggcagctaagtttctaaagatcccccagatgattgcactgtgcagacaagtttaagaaccactggtctggattatacgccatctcttgggtggaaaaaggatccgtgagccctcgtggctgtggctggctggcctaattcaggaggtgattcatttggtccatgggtcacatcttgtctgccagatatttttgtgggcagcagccatcccagacctgggtgctggcattccatggctgtgacattcgtagtgttggctacacacggggctcctggcactcccagacagggcttcccatcaccagccagagggccaggcctcagaatggtgaggtcagggctgctgtcttttgagtcagccctggaaggcagaggtgcctgtggccacttgcgtcacttccccgcgtttgtggtgggaaggggagagatagatgggtctatctgctgaagaaaggggaacaggaagaagaaaccctaggctaaggcagctttgcttctcactgtattcaaaatcaagcctttgaaagccacagcacagctgccttttcttacggggaaatggctctagcttgattggaaactatgagaggagatctttccgaagcttctagaattttctttccattacttattttttatagacaagtatgagaaagctattacctcctgaggagcaatagcctacatgcgtcagagacagagtgagtgtataatagtaaccagacaacggggtctttctaattagaagctcccagcgggaaggtataggggtagggccagggtcaggcacatctggtcccatagacatgtgctcagctggcaaggactgaggatggggagctctgggagctacccaagggaagggatgaggaaaatgagaggcttcactgtgagagtccccgggttaatggactgacagtgaatgaagagagtctgtgaggctcacactacttgctactcacctccggcaagtgggagatggccagagctgcttgcccttgggtggtctgcaacagaatcaaggttcagttccagagacctgggaaggcacacaggagaaggctgggccctgcatcctggtggctgcatctcacttgagttagaagtccttccttcccaccttcacaggtgacatggtgcctctggggcctgacccgctgcttagactcatcttagatgaacatttcacagatcaggtaacttacaggctttggtttaacagctgctcatcccagccccgcagcacagagtttcagtgatcattatgggtgtggcaggccggccccttcagcaaaagatgccgtcccatggtggctacatggtgaattgagaagagcatgggccttagatggatttgattccagttcctacttagcttcttactagcaggggaccacaggcatgtttcttaaactcagcctcagttttgttatctgtgaaataagaatgacatacatagtatgtaagagaaggtatgtgaaagtacccagcacaggctgttattaataggtcaggaccccttggggagagtacagcgggagcagacaggccagggaacgatgccacgatggaaagaggatgtcagaagctgggtgcggtggctcacacctgtaatgccagcactttgggaggccaaggcggatggatcatttgaggtcaggagttcgacatcagcctggccaatatggtgaaatcccgtctctactaaaaaatacaaaaattagctgggtgtggtggtgcgcacctgtaatcccagctacttgggaggctgaggcaggagaattgcttgaacctgggaggcagagattgcagtcagccaagatcgtgccaccgcattccagcctgggtgacagagggagacgaaagaaaagaaagaaagaaagagagagagacagagagagaggggggagagagagagagagaaagaaaaggaaggaaggaaggaaagaaagaaaggaggatgtcagctgtgctgaggggttggaggtgggaggctggagccacgccagctcctcttggcagccagagcctgacattgcatcggttctgtgggattggaaagtggaaggaagtgatggcaggttgttcagggtggcgtgtctcccacatggcttgctgaagggaggaaggtagggcaaagctctgtcacggagggggggccctgttgtgttccgcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggggccctgttgtgttccgcggggtggtggtgtgacgtgcggcagctgtgaaattccccagccaaacccatacacccacaggacagtgtcagatggtgtcagagtcatccctcactgggcctcagtttcctcatttaccaaaggagaatcctgatccaccccaagtctgctacacttgaacgtcaggcaaattctgggtgggttctgaccaaccagttcccacactcccagccactcagggacagtgtgaagataaaaccgggaggtgggtaacagtgaacttgagagagagccagagaactgactgagggacagtggcttcgaccccagaattcacccctgtattgtctctacaaggtgagggccattgacctcaatctcctcaatttcattgttcacttatccttcccagggggtgggaggaggagggcatctgggaacatatgagaagaatgaacacatggtctcacaggaggaacacaatgggacagacctggaatttctgtttcattctgtacatactgactgtagggtgtgaggcaggttgctaaacttctcttagtctcaatagtctcacctgtaagatggggtaataaactatcttacagacttctggtttgtgagaatcatatgagataatgtatgccaagtacttggcacagaagaagtgctaagtaaattctaggtgtccctgtgcccagtagcggtttatctcctcttttatggtagagggggctacagcccttcatccctgccagttcactcgttcatttgacaaatagatatttacttcttgctatgtgaaaagcactgtggcaagtgatgtggggcctggactggtctctatgtgtccttggtccttgggatctaagagaattcttgtcttcccgatcagtagtatatactggcaccatgggtagacgcctgtccctccagctgtgttgttacttccttgaggagacagaccatggcttgtatttctttgcatctcccatagcatcaaagaagcatcttttccatagcagctttccataagcaaatgcggctctgctcattcaccagattcatagtcagtgcctgagtgccagacgctttcacactaatctcaagacaagcctgtgcagtaggtattgttcccatttcacagatgaggagactgaggcttagagaaatctgagttacttctccaggagggctggctagacactggcacagctgcaatttgacctctcattgtctcactccgagtccgtgcagttagttccactctgcagggctggatgctcacttcttggttagagaggctttggggagggcgtggttgttccctttctcaccctgagaactactacacatccacctccacttctgtgtctcttccagaatgtctgtaaacctgtggaggagacacagcgcccgcccacactgcaggagatcaagcagaagatcgacagctacaacacgcgagagaagaactgcctgggcatgaaactggtaagcgcccgtccaccctcaacctggcccctgctccaccacccgcttcgggtttggcgcctctgccctcactctgaattctgtggctactccctggcaggtcccctccctttcctccggcctccagaggcctccggggtctggaaggctgatagccagagccctcagtggcctccatgtgctttagggaaatagatctgactctcattttttgcttgtgattttgggaagctcttttaactcctcctctgagcttcagtgtaaactaagtgattaaacggtacgtaatgaccaagggcccagtattgcttggcctccagggagccaggacaatgggacttagttgctccccttcctatcccttcgattgtgagagagggacatactctctcagagaggggagggcacccaacttagcacccagttgggaaaggctgtcttcaatagggaggggagaaggtagaaaaacactgccccctgctggtggctggcatcagctggctctttggggttcagccagatggagcaccagaaaatccagtcacaaatgcacctaggtttaagtcttaaaggctgtttcttagtaaagagatacaggaggaaatctagtgggctggttctccaaggccctcattatagagccttcctgcttcctgcctggttcagaggtacaaactagagtggctaccccacaccctgcctcttacaatgggcactcaccaaaggcaactggttacaggaggtttagggagctggcctgagcctcctgggagggaaatccactgcagccccacaggtcctctttggtagctggatcctgagggtcttctcccagcccactatggggaaagggatctctgctccttcctccagctctcccacgtcagcagaggcaggaaagaactcaaggagacaggtgggtgctgctggggcaatggccccgagtggcagatatgatcatgcaaggcggacggccctgaccccctgtgacatgcccccgctggcagagtgaagacggcacctacacgggtttcatcaaagtgcatctgaaactccggcggcctgtgacggtgcctgctgggatccggccccagtccatctatgatgccatcaaggaggtgaacctggcggctaccacggacaagcggacatccttctacctgcccctagatgccatcaagcagctgcacatcagcagcaccaccaccgtcagtgaggtcatccaggggctgctcaagaagttcatggttgtggacaatccccagaagtttgcactttttaagcggatacacaaggacggacaaggtaggagaaagagtgaacccaaccagaccgttcccttcctacctgtgtccaagcccaccctctaaaactcctgccggccttgggtgggagctgtgggcttctcctgagcaccaggggtccagctgcccatgtggtgttcagatctgtggaatccgggcagggaggcaagagcagagtccctgactctgcatgtgacttcaggaaaaccacaccctaggctcccatttcctgatctgtgcaatgggaggaatctgccccaccattcctaatctttcaggagatgatgtgaatggaatcatgctttaaactctgagcagacacccaagataaaaggttattgccctgttcattactgtcatgttcatttcattaaaaggcccgtgtctacttccagttgtacgtaccccacctctgcatttccaatcctttcccgcaagcctgggccccgcccttcttttctgggaagagctcccagcaccctctcttggtttgcagtgctcttccagaaactctccattgctgaccgccccctctacctgcgcctgcttgctgggcctgacacggaggtcctcagctttgtgctaaaggagaatgaaactggagaggtagaggtaggtctggacccattgtgcaaacccaggccttagggcaccctgggtgggtgcaggtgggtgttgtcctaactacctcacataggtgggagccacgcagcacgggcaggaaggtgactgttgagagagtgagcaggggtgggtgatgggcctgggggtcagtgtttcagccaggactctgaacaccctggggtagcacattagggcctgtgtgtggcaaggcctgtggaaagaaaggatttcatgtgctttatttctgaaaactcagggaggagggggaccaagaaactccctgtgctcaggcacaggctgtttttgcttcaaaatggcccgagggctaccaagctccatctctgggctccactgggtatagacgtttttgagccatttgtcctcccttttcttgacctccatcccccaaggggagctaaccagtgtgtagtcttgtggcataaactggagtaaaaccaggccggtgacacccatggcctgagaatgaccaacaggggaaggtctcagtgtttgtcacactgtgttcagtggaggcctagagttttaaggagttttgggagtcactgcggagatttagggatcaaggcagctgggactctgtcccttctccccatttcagcaagggccgctctgctcccatctgctttctttattggcatctgtgcagaatatgtttggaaaaagtactccatggacagtagctgaatgctgctggccctgtggaaagctcaggcactttgaagtgtggagacctgggctctagttccagttctgctgcaatgagctctgtgattgtgattacgccaccttccctgtgtggacttgaggtttctcacttatccatagcgaggaccaaaccagataaaccttagtactctattgtgctcaaagagcttaggagtctcaattgttggccgcacagggcttgtgctcttgggtcagcctgatggaagtccaacttgccttctgccatcagaggccaggtcctttaggggtaggcctgggccagtcaggctctcattatctgctctgccagtcatgggaggtagataccccaatttcccagcagataacaggctgagaagggtggaaagctgtgctcgaggtcacactgctgggagaggtggagtcaggcccaaccccggtctcctgagtccacgttccactcctccacctgctttctgagggtctgcatgttgggaggctgggtggttccagcatcaccgtcaagatctcggctgctacacagaaacttaagattattgagtttcaaaataaaaacatggttcatagactggcaactcttggtcatgagatgccagcatttggaattttattgctgctatgacaggcatgcaaagcccaggcttcgctgattcagtctgttcagtagcaaactgtgtgtgaatcacggatgtgaactgggaaggggaaggcagcagggtctctcaggtcgtgtcaacttctaacctgtctcctattctgtttcttcccacaaatctccctctcgcctcacagtgggatgccttctccatccctgaacttcagaacttcctaacaatcctggaaaaagaggagcaggacaaaatccaacaagtgcaaaagaagtatgacaagtttaggcagaaactggaggaggccttaagagaatcccagggcaaacctgggtaaccggtcctgcttcctctcctcctggtgcattcagatttatttgtattattaattattattttgcaacagacactttttctcaggacatctctggcaggtgcatttgtgcctgcccagcagttccagctgtggcaaaagtctcttccatggacaagtgtttgcacgggggttcagctgtgcccgcccccaggctgtgccccaccacagattctgccaaggatcagaactcatgtgaaacaaacagctgacgtcctctctcgatctgcaagcctttcaccaaccaaatagttgcctctctcgtcaccaaactggaacctcacaccagccggcaaaggaaggaagaaaggttttagagctgtgtgttctttctctggctttgattcttctttgagttctcttacttgccacgtacaggaccattatttatgagtgaaaagttgtagcacattccttttgcaggtctgagctaagcccctgaaagcagggtaatgctcataaaaggactgttcccgcggccccaaggtgcctgttgttcacacttaagggaagtttataaagctactggccccagatgctcagggtaaggagcaccaaagctgaggctggctcagagatctccagagaagctgcagcctgccctggccctggctctggccctggcccacattgcacatggaaacccaaaggcatatatctgcgtatgtgtggtacttagtcacatctttgtcaacaaactgttcgtttttaagttacaaatttgaatttaatgttgtcatcatcgtcatgtgtttccccaaagggaagccagtcattgaccatttaaaaagtctcctgctaagtatggaaatcagacagtaagagaaagccaaaaagcaatgcagagaaaggtgtccaagctgtcttcagccttccccagctaaagagcagaggagggcctgggctacttgggttccccatcggcctccagcactgcctccctcctcccactgcgactctgggatctccaggtgctgcccaaggagttgccttgattacagagaggggagcctccaattcggccaacttggagtcctttctgttttgaagcatgggccagacccggcactgcgctcggagagccggtgggcctggcctccccgtcgacctcagtgcctttttgttttcagagagaaataggagtagggcgagtttgcctgaagctctgctgctggcttctcctgccaggaagtgaacaatggcggcggtgtgggagacaaggccaggagagcccgcgttcagtatgggttgagggtcacagacctccctcccatctgggtgcctgagttttgactccaatcagtgataccagaccacattgacagggaggatcaaattcctgacttacatttgcactggcttcttgtttaggctgaatcctaaaataaattagtcaaaaaattccaacaagtagccaggactgcagagacactccagtgcagagggagaaggacttgtaattttcaaagcagggctggttttccaacccagcctctgagaaaccatttctttgctatcctctgccttcccaagtccctcttgggtcggttcaagcccaagcttgttcgtgtagcttcagaagttccctctccgacccaggctgagtccatactgcccctgatcccagaaggaatgctgacccctcgtcgtatgaactgtgcatagtctccagagcttcaaaggcaacacaagctcgcaactctaagatttttttaaaccacaaaaaccctggttagccatctcatgctcagccttatcacttccctccctttagaaactctctccctgctgtatattaaagggagcaggtggagagtcattttccttcgtcctgcatgtctctaacattaatagaaggcatggctcctgctgcaaccgctgtgaatgctgctgagaacctccctctatggggatggctattttatttttgagaaggaaaaaaaaagtcatgtatatatacacataaaggcatatagctatatataaagagataagggtgtttatgaaatgagaaaattattggacaattcagactttactaaagcacagttagacccaaggcctatgctgaggtctaaacctctgaaaaaagtatagtatcgagtacccgttccctcccagaggtgggagtaactgctggtagtgccttctttggttgtgttgctcagtgtgtaagtgtttgtttccaggatattttctttttaaatgtctttcttatatgggttttaaaaaaaagtaataaaagcctgttgcaaaaatgactcatgttagaaacgtctcccttgaacttcaccatcttacggacactgggagcgggggagagagggtgagaatggacatgatcacatgcttcctggtggagtcagattttcttttgccagtgagcagagaaatgaaggctactgttcaaataatttgggaaaaattgtccaaatgcgtaggcgggagggcgctgcctgggtgaccagctgttccatgtctccgcagtgcaagagagtcaaggagactgattgcaggcagagatgctgatgtgtgggaaagagaagggccttctggagctaagggtgatttgacaccaggacaggctactgagctgagccatgattcttctacttctggaattatttaaaaataaggtagaaaggaatagatctttaaaagtttaagatcacttcacctggaggaagggggctagatcaaatgaccaaaacaaacagtcctttcacttgagttctctgactttcatcaaaggaacatctcagtaatcatggaaataaccacattaaattattaaaaagaaattcttgctgccttccagtattgatcacatagaatgcaatacatggggcccaaagaatgaatgaatgtccaacaagcatccttaaaactgcccaagaatggggcacatctgtaacatttttgttcatctaaacccccaagaaatgtatctttcaatgattttgccaaagtccaaaaatgaagcactttctgcttttcattgaatctcatatggttacagcatagggttaataaattcaaagttgtacgtttgacattgatacagattatttgacttagcacataggaaaaagaacctgttacacagtctggctctactctgcctttgaatatgtccctatgctgttcacagggggagagggaagatgactcaatgcaaatgtgtcaccgttactggaaaaaccactcaatgcacaggtctggacagcactgtgtcatggcagaattgtgggtcaaaccacaattaagggtagatgttcattttagacccagccctaccacttactggctttgtgtcttcagcagagatcaacaaggcgggacatgacctttcttagcctccactcccttcaagatcgtgcaaaacaaatcaagtttgtgaaagaactttgcacagtgctatattttacttgtattcacataaggaaccatagttcattactactatacagatcataatccctcagatcagactctggcaggccaaaggctttaacaggatcctgtttaggctcaatttctggaaatccctttcctagtttcatatgctcatgccggtagagataggattagtgaaattaaggagtttactcatgagtaaaaaggtctattctgggcctgataacagacggtaggaggcgccacacacacattttcaaacccattccttttttccttttcaagcctcaaacgggcaatttgtggatattgtggatatttttaagcctttcttatctcagtttgagaaaaactgagaagagaaagaaacaagtaaactgaagtgcaactgtctcttaatggtaaaacccaaaaactcagggaatttagcccagttctccctcctattatacaaggagagatccagtcagtgaaatgattccataaactgagcagggaccagcgcagtggttctgcacttttctggcatcaagtgatccctttgggaatttgatgaaagcatggtccatctctcaggaaaatgatcgtacaaaatctgtgcaccatttcagggagttcatggatcctctaaagacctattaaagaccccttccatgacctccacgttaagaagttggggctgaagagggcatgtgttggatgagactcttcactgtaacaaagctgtcatcttggagttacatcacaaatttaccagttagtggcagtgtcctaaagttggggaagaatcactgtcctatagaaacccacgtcctaatatgcctgtatactgtttctgatttctatctagcctaaattctactgcaatttagggtcaattctttcttctgttgctttgattgatgacagagaacagctgggatctgttttctacgtgactaaccctttagagatgtgaaggaactattttggggctaggaagttaattaggcagtaggatatttggtagaaggtctttgaaaagaggaaggccccacctgtccgaactctgaatgggctggcctgcctggaaagcagggaaggaatgaaatcattgaaaccacatggacagaatggcagccaccgtgacctcttctgtccatttagaatactcccgacttcaaaaattagtacattttagctaagtggaggaaacaagagggaagtcagatttagattagaataaaaatttatttttgtaaagaattatattttgtatttgcaaaagctgaaaatgctcataaaaattaccagcccagagcttggatttccaccggatccaccacgtgagacaaaagagtctgtcacttcttcttgccaggtttgagggccttttctagaccttggatgtgttttcgagggagctgatactcttctacaatccaaaaagcacacactcctcagcggagcatgaccttgctccccggctggccctccaccagtccccgttgcctcacaatgtcattccacccagctcaaactcaacttcgggactgaccacttacgcctacacctcacagctgatgtgtatatttctgaaattttcacactgagagctactttctgggtgtatttcaggcatttataattttttcacgagagagaatgtgtctgttcagtctgtgctcctcgctcttgctcataacatttcttctcagtaccttgtatggggttcttcacataaagaggctcaactctagaagttaactgtcaggtactgccataggccatggaatacatttgcctaaatgagcacttactatccgccaggccctgaggatgaaaaaggcaaggtttctggctcatgcagctcagtctggcaggaggttcagacattagaaaaaattagccaagctgcagacattaaccggaaatataaacacaattggaaagtgctacattagcaatgtttaaaatgctaatttaggctcaggcctcccaggacccctgggctgggccagtgagcctctgaggtcaggtgggcttgggcgtgggagggcatcttaggcaaggggatagcccaggcggaagcacatgtgggtgaacatgcaaggagaatctggagaactgcaaggagaccaggacagctggtgcctgcaacatgggtgtaggagctgccagagagagcctggcagggaaggctggggtcaggctgggagggtcttgtttattgagcttaggagttaattctgaaggcattgaagaggcatacaaagttttttagaagggagtgatgtgatcatatttgtttaagaaagctgactcaggcagagatgtgaaggctggtttgaagtgaggaaaaacgggaggctgggttacccagagttagtagaaagaacttaggctttaggccaggcatggtggctcaagcctgtaatcctagcactttgggaggccgaggcaggcggatcatctgaggtcaggagttcaagactggcttggtcaacatagtgaaaccccatatctactaaaaatacaaaaattagctggccgtggtggcatgcgcctataatcccagctactcgggaggctgaggcaggggaatgactggaacctggaaggtggaggctgcagtgagtgcagtgagccaagattgcgccactgcactccagcctgggtgacagagcgagattctgtttcaaaaaaaaaaaaaacttagactctggagtctaaaaaagtttcgtgcccagctgtatcactcaagagtcagaggatctcagggcaaggtacggaacctctctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaactctgtctcaaaataaaataaaacataaaataaaatgaaggtattagattaggctggtatgtctcaacttttttatcatgatgatgtttttttaaagtgaaaaaaaaatttttttttgagatggggtttcactgtatcacccaggttgcagtgcagtggcatcatcattgctcactgcagcctcaacctcttgggctcaagcgatcctcccacctcaacctcccaagtggctgagactacaggcatgccctaccatgcccggctaatttttgtattttttgtagcgacagggtttcatcatgctgctcaggtgggtctcaaacccctggcctcaagcaatcctcccacctcaacctacaaaaatgttgggattacagacataagccacagtgtccggccattaaagtaaaaaacaattaatggaactctcttcatctggtagtttaccatctgtatctccttttaagaaaataataccataatgggtacaaatatacagttagatagaagaaataagtttagtctttgagagcagagtaaggtgactgtagttaacaacaatgtattgtgtatgtcaaaatagctagaaaagaggacttacagtgttcccgacacatagaaatggtaaatactcaaggtgatgataccccaaataccctgccttgatcgttatacactctgtgcatgtaacaaaataccacgtgcaccccataaatatgtacaaatatctatcaataaaaataaatacctaaagctatgatgacttcagtaaattctttgtaagcttgcattttattcctcacaatagccaattaaagatgattcatgggtatttgtgagagaatatttacttagtcggtagtcaatgttgatcgtatacatggatctgaacaccccagacaataactctgagtgtccacagcccatggtttggaaaccactgatcttaattacctctaagatgctatggttttctattctccctcccagacatcctccccaaatgtgtctatgtctgataaagacaaagacccaataagacagatctggtgcttctcatgcactcactttttgttgtctgcatcaaccaggtcatttttcttggcgtagttaatgacgatcgttcggacctcactgccctccagaaagctccccttcctaggtgaggagaagtgacccaggggttagttcatgctgtgccatgagacaaaaatgcagatgcccagactcactccctgctgagcagggaactttccttagctttcggcctctagtttcttcccttttcctgactgaagtgagcatgaccatgtgaagaataattacacgcagaaaagggtgagacctactcgttcatttagtccagaggaacttgcccagggaagaaggctggaagctggattttggagaaggggagaacaggggcagagcaggttttgccagtcgcaa

SEQ ID NO: 1307 - DNA, 2858 bp, Homo sapiens
tcttccagaatgtctgtaaacctgtggaggagacacagcgcccgcccacactgcaggagatcaagcagaagatcgacagctacaacacgcgagagaagaactgcctgggcatgaaactgagtgaagacggcacctacacgggtttcatcaaagtgcatctgaaactccggcggcctgtgacggtgcctgctgggatccggccccagtccatctatgatgccatcaaggaggtgaacctggcggctaccacggacaagcggacatccttctacctgcccctagatgccatcaagcagctgcacatcagcagcaccaccaccgtcagtgaggtcatccaggggctgctcaagaagttcatggttgtggacaatccccagaagtttgcactttttaagcggatacacaaggacggacaagtgctcttccagaaactctccattgctgaccgccccctctacctgcgcctgcttgctgggcctgacacggaggtcctcagctttgtgctaaaggagaatgaaactggagaggtagagtgggatgccttctccatccctgaacttcagaacttcctctcctcctggtgcattcagatttatttgtattattaattattattttgcaacagacactttttctcaggacatctctggcaggtgcatttgtgcctgcccagcagttccagctgtggcaaaagtctcttccatggacaagtgtttgcacgggggttcagctgtgcccgcccccaggctgtgccccaccacagattctgccaaggatcagaactcatgtgaaacaaacagctgacgtcctctctcgatctgcaagcctttcaccaaccaaatagttgcctctctcgtcaccaaactggaacctcacaccagccggcaaaggaaggaagaaaggttttagagctgtgtgttctttctctggctttgattcttctttgagttctcttacttgccacgtacaggaccattatttatgagtgaaaagttgtagcacattccttttgcaggtctgagctaagcccctgaaagcagggtaatgctcataaaaggactgttcccgcggccccaaggtgcctgttgttcacacttaagggaagtttataaagctactggccccagatgctcagggtaaggagcaccaaagctgaggctggctcagagatctccagagaagctgcagcctgccctggccctggctctggccctggcccacattgcacatggaaacccaaaggcatatatctgcgtatgtgtggtacttagtcacatctttgtcaacaaactgttcgtttttaagttacaaatttgaatttaatgttgtcatcatcgtcatgtgtttccccaaagggaagccagtcattgaccatttaaaaagtctcctgctaagtatggaaatcagacagtaagagaaagccaaaaagcaatgcagagaaaggtgtccaagctgtcttcagccttccccagctaaagagcagaggagggcctgggctacttgggttccccatcggcctccagcactgcctccctcctcccactgcgactctgggatctccaggtgctgcccaaggagttgccttgattacagagaggggagcctccaattcggccaacttggagtcctttctgttttgaagcatgggccagacccggcactgcgctcggagagccggtgggcctggcctccccgtcgacctcagtgcctttttgttttcagagagaaataggagtagggcgagtttgcctgaagctctgctgctggcttctcctgccaggaagtgaacaatggcggcggtgtgggagacaaggccaggagagcccgcgttcagtatgggttgagggtcacagacctccctcccatctgggtgcctgagttttgactccaatcagtgataccagaccacattgacagggaggatcaaattcctgacttacatttgcactggcttcttgtttaggctgaatcctaaaataaattagtcaaaaaattccaacaagtagccaggactgcagagacactccagtgcagagggagaaggacttgtaattttcaaagcagggctggttttccaacccagcctctgagaaaccatttctttgctatcctctgccttcccaagtccctcttgggtcggttcaagcccaagcttgttcgtgtagcttcagaagttccctctccgacccaggctgagtccatactgcccctgatcccagaaggaatgctgacccctcgtcgtatgaactgtgcatagtctccagagcttcaaaggcaacacaagctcgcaactctaagatttttttaaaccacaaaaaccctggttagccatctcatgctcagccttatcacttccctccctttagaaactctctccctgctgtatattaaagggagcaggtggagagtcattttccttcgtcctgcatgtctctaacattaatagaaggcatggctcctgctgcaaccgctgtgaatgctgctgagaacctccctctatggggatggctattttatttttgagaaggaaaaaaaaagtcatgtatatatacacataaaggcatatagctatatataaagagataagggtgtttatgaaatgagaaaattattggacaattcagactttactaaagcacagttagacccaaggcctatgctgaggtctaaacctctgaaaaaagtatagtatcgagtacccgttccctcccagaggtgggagtaactgctggtagtgccttctttggttgtgttgctcagtgtgtaagtgtttgtttccaggatattttctttttaaatgtctttcttatatgggttttaaaaaaaagtaataaaagcctgttgcaaaaatgactcat

SEQ ID NO: 1308 - protein, 201 aa, Homo sapiens
FQNVCKPVEETQRPPTLQEIKQKIDSYNTREKNCLGMKLSEDGTYTGFIKVHLKLRRPVTVPAGIRPQSIYDAIKEVNLAATTDKRTSFYLPLDAIKQLHISSTTTVSEVIQGLLKKFMVVDNPQKFALFKRIHKDGQVLFQKLSIADRPLYLRLLAGPDTEVLSFVLKENETGEVEWDAFSIPELQNFLSSWCIQIYLYY

SEQ ID NO: 1309 - DNA, 32359 bp, Mus musculus
  misc_feature (1)...(32359): n = A,T,C or G
ttctctccaccatgtggtttcccagggatctaagtcagcaatcaggattgagagcactgttcccctacctactgaaccatctccttgcttcccaagatcactgctctatgtaggtctcgggaatcgcgtaaagttttccagatccttgaagcaaacgttcttctcatctcgtcggcccagataaagtcacgtgccctatcctgaactaacctcactcgaatctgggtttgtatagttacctacgaggagattatagaaaccacacctgatccccaactcaccagcctccacacaacagcaaagatgagggacagagactgaggaggcagtgagataagccctggtttcctgtcgctgccgcaggtacctgaacctcaccattccatgtttgagaaccttaagttcttgatggaagactgaagccatcatcctctatctacgctgaagatactactgggaactttcttgtctccatcatacctgagacaagggcttttgacataggcatctctcatctcacactcctgagttaattgtcagtagtttggtatctatatatctagagaaccaggaaacacttgagtggcaagtaatggctagcctgtaggagcagtagcaccagtagcaacagaacactcgggcgtagagttcacagctatgatatcaaagtacagggagcttgggttattttgaatttcagttattaaataatttcagtctacttgctctttgctcccaaactagaacagtttccaagcctacttctaaggaattttgtgagaacacaccatgcaatgtaagccgctgtcactcacagttctgacctttgatcatgcagagctcagcgcccacctcaaagacctgtgtgtgtcctccagcattgagactatcacggagcaagcacgggaaagcaggtggtaccaccgcctaaagtctaagtgtgagaatagggtttctggaagtttctgtctggtccctgatggaaggaaaatcatgcggtctttcctgcctaactgagctctatttaaagtaagggcaactctggaacgttatgtggcttcagtattaaggattacagagctgaaggtaaaaatgctatacaagcctgaatccaggtcacaaagtaatggtcgaaggacagaaccatctcccatgacctccatgtgcacactcacacacacacacacacacacacacacacacacacacacacgtgtacacaagcacacagaaccatctcccaaaagttctcctctgacctccatgagcacactcacacacacacacacacacacacacacacacacacgtgtacacaagcacacagaactatctcccaaaagttctcctctgacctccatgagcacactcacacacacacacacacacacacacacacacacacacgtgtacacaagcacacagaaccatctcccaaaagttctcctctgacctccatgagcacactcacacacacacacacacacacacacacacgtgtacacaagcacacagaactatctcccaaaagttctcctctgactcccatgagcacactcacacacacacacacacacacacacacacacacacacacacacacacacacacacacacacacgtacaggtacacaagcacacatacaataatagtattaaatgttacacaattctggcatagacaaagccctctgctggtaggatttttcctgtcctttgatcagttcttataaatcaaaccaaatccttctcctatgaaataaccttactattgttaaatgtaagaacactgaattactaagccattattaacattattgacattgttcatttctaccttagactgtattgttattaactgtcttatttcccaagaataatatatcttcatgttgaatgggaggccatgctgattcaccagtttccatggcagtgtgatgaagcagtttagtcatctgaatgacaaatatggccccgtctgctctccccagataatgaaggaggcagattgccaatgaaatccctactttggtgtgggtatctgagactggtggggatttgggtctgtctgtcactttttttggctttttgaattgggaactctcaccatataattcagtatgactttgcactcacaatccccctgcctcagcttcaaagggttagaagtgcaggcatataactatgtctagcatctggaagcttcttggccaatatgataggtagtttgctgaggttgaaggtggtggttatacaggggacacaggctctgcagattttctcttataaccagagctttgcccattgctctggaatataacacgaagtgacaattcctatagcaactaagaatccaaacatgagagctcatgttgctacattggtaaagtgcttgccatccaagcatgaagtcccgaactggatccccagggcccacgtggaaaagccgagcatagtgctatatgcttgtaattctaggaccaggggaggcagagacaggcagatcactaaggcttgctgtccagctagtgtaaccaccagcaaggtcttggcagtgagagaccctgtctcaaccaatgtggtagacagcttctggggaatatctgaggttgacctctggcctttagatgcacacaggtatacacacacacatacacacacacacacacacacacacacacacacacacacacacacactacttttaaacaaacaaaagggttcttacagttcttaatgtaaagctaattcttttaaatcaaaattaaaaacaaataaatcagggctgaacctggattgaaggttgttggcatttttatcttactttaattactttgtctttaaagtgtgtattagctattgtttgacgacagccattttattataatctctcttatatttgagattatgattacatcattgttctaatgttacttgtacatttatttatgcttttagagctggccatttggtattggataaccaatggggggctcttttctagggaagcctgtttctcccactctcgatatgccatctgtagttgtctagggctgaggcatcatgggcttttcccttcctcattagcatgtctgttggtgtctttatactcagtttggtcaacactgaaagaaagccatgatgaaaaacaaagttttactatatttcctattgctatttggagtcaggatactttcattcaactacagtttctttttcttttctgtttctcacatttagggttttgctttgtttggggggcattaaggatggaactctgactcccatattgatcaagtaatcaagtaagtgctctacaactaaactagttccctgatccatggcttgttcctgttgttgttgctttccttttcttctttacaacagggtctcctgcaggtgaggttagcctctaactcagtaggtcctggaagatcaccttgaacctctgctcttcttgtgtcagcctcccaagtggtagaagtttaataagagtatactgccacacatggctctgtgtgtgtgtgtgtgtgtgtgtgtgtgtgtgtgtgtgtgtttccaagttagcaattatgaactcagacataatccccttaacttggcaaacttaacaactttatatgaccatcctctttgagtgctgtatagaatagagattgtcttcagtaaaaccatgagggcctcatttctgacaaaagttacttaggatccttttttaaactgtttcatccctttatttccctcttactgataaggattcgactagaagtatcccacacatgaagtatttcttcagtggttcctacagtttggatctgacaggtctccaaaggccgatgtgttacaggtttggtccccatcctgagatactggtaggaggtagtggaaccttcagatgtcacctgctgtctctctttttcttttccactgctgtgacaaatgcctgacaagaagcagcttaagggaggaggaatttatttgggctcttttgagggtgcagcccatcacaacagtggaggtggctctgatccatggtggtaagagcacagggctgctgctaacatctggatgcatcaggaagcagaaaatggtgagattcttgtgttccttgggctcatttttgtctgagtccctagcctaggggatgaccacctacactcaagtcatttcccttaggaaatgtcctcacaaacacactgataggtattcctcactaatgtgctacatgtttattaagccagtcaagttgacattcaaaattaactgttacaccggatgtaaaggaagttaggtgggggtccacatgctccctcctctccttctgcttcctgtgttctatacagtgagtggctttgctcttccacatgttccctactatggtgatctatacaacatgcataaaatcaagagtcagccatggactgaatcttctgaaaaccaggagccaaatacaactttcttctctgtgtcatttattcctgttatttgtctcagtgctagaggtgactaacacattgtgacccactaacaactctgtgaccctggatttagggtaaacctggcagagcatttacttaaatcatatccatgtaacatccttatcttgtttaaagccacaatcatagctattcaaagtttatctgtgtgctgtctagttttgtgtcaacttgacacaggctggagttatcacagagaaaggagcttcagttgaggaaatgcctccatgagatccaactgtaaggcattttctcaattagtgatcaagggggaaaggccccttgtgggtgggaccatctctgggctggtagtcttggttctataagagagcaggctgagcaagccaggggaggcaagccagtaaagaacatccctccatggcttctgcatcagctcctgctttctgacctgcttgagttccagtcctgacttcctttgatgatgaacagcagtatagaagtgtaaaccgaataaaccctttcctccccaacctgcttcttggtcatgatgtttgtgcagaaatagaaaccctgactaagacaatctgctctacaatctttcttccagttagccatgtttaccttctatgtggccctccatgtttaaatgtatctcatctttgtcacatgtcaatgtgttttcctggccttgaaggcagtttctgtgcctaaaaagattaaccaaagactttacttttatgttattaattattgatggtataatttgtgcctgtaataaaatatatccacttgaatgcatttttccttgagctgtagaaaatacataggcctatattaccagctgtttctctgttcctctctgtggttcccaacctgaacaatagagattttgcattgtacctatagactgacctattttacaacttcctataaatagctcttaaaagcttcaacgtctggcatcttccactcaacatatatgaatgttcatctctgactgtgtatgtaataagcagctcactcctttttgttgttaagtattcgaccctgaggatatatcacctttattattgtttcatttaatggtggaaatttgagttgtttgggactctgatgagcaaggtattaggaatattcgtaggcagttctttgtgtgactacattccaagttcttttaggtaaaatctagaattaggattaccatgtcacgtggcaaatgtgtgttttgcttcatttgaaaacaaaaacaaatgcatgtgaaaaactgtttcccaacatagttatgatagctcacattcccatcagtaatgtgtgaataccagctagtccacaattagtgtgtgtgtgtggggggggggnnnnnnnnnnnnnnnnnnnntatgaaatctcaatgtggctttaatttgaaattgcttgatggctaatgatattgagcagctttctgatcaatgcatattaactacacacacacacacacacacacacacacacacacacacggctcctccccccaacacacagcacacacacacaagaaatgtatgtcaagcttttacttgctgcttgtcttactgagttgtaagaggccattacatattctggattaaagtcttgttagatgcatatattgatcagtcttccctactgtgtgatttgccttgtcacttgtttttagacaaggaccaatagttattagtttaaataatccatgttagtttcattttcttgatatgacaatttcccactggaatatatatcctttcacagatctctgcaagacttttcacagctctctgttagatagaaagcaccctctctctctctccctctctctccctctctctctctctctctctctctctctctctctctctctctctctcctctctgcccctgtgtgtgtgtacacatttctgtctaggtgcatgtacatgtaattttcaccttaaaatagttagcattactaagaataggcacatgcctttaatcccagcactcaggaggcatgagtaggcagatctctgtaaatttgaggccagcctggtctacatagctaaggaggattgcatagtaagactatgtctcaagaaaaagaaagaggaaaaaataaaataaaataaaataaaatacttaaccctgaaagtatgctatcttaggtgtaaattagttttaacatctaaagagttaacatttaaagtaccataaatggagtttataacccagtatattaggtttcttttctttttttttttttttactggtgacccaagaagtgctaacggacctatggaagagcttgacaatggtgctggtgtcctctgaacagagcctatgaatcacctcctcgaactttcacccctacccctatccctgtttaacgggaaggataatatctgcagactcagggccactgaaaggaacagcaagacacgcccagctccttcgggcagcaatgatcgtctctacacgtctgtttgttactcttccttctaccccgctctatgttactttctgattcagtttatgtcacttcccatttaccttcaacccaactgtactgctagacaagtttttaaatttcacttatgctggactcttgataaaaacctcaaggtcaaggttgatccaactgtaatggacctgacgggctgttttgccaaatccagattccaatgctctctgtcttaaaaggccatgcttctctgagtctatctcagagtggctgaggactctgctgtgtcacctagctcccttactgtgccgtgaaacctgagaatcacgagaggaagaccagttccacaatttttgagccaaatttgaagcaagctttaattaaatgttggccaggaggatagactctggccaggaccattctgagattcccagaatacagcaaggagttccctttgcagaggcataaaaaagcaaacccataagaccaccatatttcccaacaggttcaatctggagcaagcatatttcctgcagagaaactgaagcctgggctgcctttcggtgagagaaacatcccaccagacaccgacaattaagatagatggtgttcctgtaatggatagctttaggacccggaaatttgttcctatttaaatccatttgagctagatttcgttgcaaatgggaataatggagtcaattcctcaaaggaaagacttcacatcctcccctcttgccccgaattggtctgaacaaatgaattctccatttctggtctcacaaaattcctctgcacaccactgtccaaacagaattgtcacttccttacaattaaaattctaaggaccattttccatgccgctatacacagggatcttgctgaaggacaggttcagctcacatctttccactgttcaggagaaaaaaacaaacaaacaaacatcccttttcctctgagactcatgttacagcatctgtggtttttagtttggttttgttttcttttttgccaacttcctgattactcaagactaacacctgttttatagtcgccccatccaccccagctctctgccctcgtctcagacagatgccgttcagtataacagcctgtcgctgttcacgtggtcggttcacagggtgctaagcagtggacacatttctcagctcgttacacatacagtattgtaactcaaaccttcagcatacggtggtattattttcatttcgcaagggaacctggggcacagaaaagctaaataaactgccctagagagacagagctacttaagtggggatgcagacaggagagctggcagagctgtgaagaatcttaacactcactctaacctcccagttcttcattctcttattgtcgatatcccccacatttacccatgtgtattggtactgtacaggtgccagggagtcatgccttcctagcagaatcagtggacatctgagggtctgtggagaggtgccagctaagggaggaacccttccaagttctacaggtcagtgtttgactaccaaaaagccagaaacctggaatgtagctggactgaaaagacccgacagctgcaaagagaattaatagattctgctcatctgcctggggttcctctctgcctcagctgtcctaaagggaaggctactgcctttggggcagcatccacccgcagtctagggctatgttcagaacactccctcttgtctacatcctcactcattacttgaattcctcagcccttcaaaaacatcgcacaactggttctggtattttaaatgttttgaacaagggaagccagtgggtaggggtagggtggctgagacacagtttcattagcctcccgtgcttcacctcgatgtagatttatctagatcggctctccaaatgcaggcttggtgagttcctcccaggatgctggctctgtccagtctccacctcagctgcttcaccagaacatacagcggcactcttggggctgcacaaagccaccttaagaatcttagcttcttccaccatgccctgtcctcctgaacatcacctcagttatcattgaagaagactcttcctggcgtcctctcccaaggcggaaaaatctcctcaaagcctatactgtcattgtaaatacaaggcagccaaactcagcaaggccccacaaggcaccacgcaagcttaattagcgctcgcgatgactataattagaataattcattgagtgcttccttatgggccaaacgctgtcctcagtcagttttcaagcccttaaatccttcaagacaatgctgggagctagactatccgatctctatcatgcctacatgtgcatggggcacagaacagggctctaaacggctctgtgcctctcccagtagcaggttcacctgttaaagttaaggaataggagagagagaggagaaagaagcggcaaagaactacccagaaagttggcgaggacgcgcactgagacacttcctggtcatcgttactcagcactttgagtcgaactgcagcatggccgccctagtctaaggatacacctctgcctgggcagtcctagggactgtccccagccccaatctggaagtatctgacttaggtctagtttggggcatgggcagtgtgattacagaaggactctacggtgtgagagaggaccgtgatctaccccggcgctgttcgctgttaaagtgcccttgaggcagctggaagttggctcttaggggtagctgccgcgcggcgtctggagcctggaaaaacccgaagctgctccaggagcctgtgctagctccgccccttataaactaaggttcttgttcggcagcttagagtggggcggggaagccaggagtgaggccagcgctaggacagtccccaggctgcactagtagccgactctggctccgccccctggaaaaccgccccacctcttgggggcgtggtctaggcgcggcctgcccaggcgccttggcggacgcgggaggcgggaagcgcgtccccgccgcgcgtgcccgtccgccccgccctgctgcgctccgccctatttctataaagagaaggcgggcgccgcactcggttgcaagctccgttgggcgccttggatccatttccatctggttctgctgagacgcgtgtggctccctccccgcaacagccaaaatggtgaagctgatcgagagcaaggtacgcatgcccgggcgccgcgcacatcccgcggtgctgaagaggacactctcggtgtccccgcgggcttagcggcccagggcctgtgtgcgccctcggcggtggagcatgccctgggggaggggacgaggggaccctggaacgccgggtacgggagatgcactcgtgggcagcacctgagtccccggagctgcactccctaccgccagcccaaatctggcggaggtgaagagatggaccggggtcctcctgtgacactccccccttcccgtgccccaactgaatcaggatttaggatctctaggaaaagatggagagccgccacttctcgagtacgcggtgccacacgccgcgcgggtgtgttgtactgctgggctcggccttagtttccctccatcagtgacctgccgcctagaggacacaggccaggtcggtgcatgagggtgggtctcgggtcccagttaagtaccctcggatcggtaccccaggtgactactaaggagaaaggtccaggccgcgcccgagagactcctcctcctgcgtcgcagggcgtgtttccggcagctctggctttggaatgactcagtccccaaagtctggccccggggcctcgcaaccttaaggtttcagtgattgaccctccataagtgggctttgctggaaccagggctctcccccagggagtagtcaagtacaaagtcctgccctttgggaaaagaaaaataatacccaagggaaaaactgttaccatattcgaaagttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctggctcacccttaaactagggaaatccgtgggaaggacaggtccgcgccctccagttttgagcacctggttgggtctcagtacaaaagttggctcacccactaccagccatattagtcccagcacccagttggatccttatctgtttaaactgacctacttatggaacctttgccattccaataggagcggtgtacattggtgccaggaaaccagttactcggaaaaagcttgggccccaaaagcctgctaccaaggctctgatcggagtcgcccagaatcagaagttaaactgaatacacataaatttcatgtgatgggcttaagttgattaattaaactatgtaaaatgtagccttatttctgacgactgtgtgggtagttaaaggcccctggggtcaatctccacacaggagtggaataataggctatgatataatggctcagaaatcaacagttgatttgccgtgtttatctttaagaataaaattattccttgaactacacacacactttgctcagtgcttcacagaccacgtgttagaccaaggcgttggctcatgcctctaatccccagcgctcaggaggctgggctgtctcaaaaaaaaagcaaagaacactttgttatttgctgaatatggttttgttgttggggctttctgtttcggtttatattcacatataggggtggggcatccattggcagtggtcagaggacaacttgagagagttggctcacttctaccttgtgggtcgtgggtattgaactcagttcgttggtcttggtggcaggcactttaatgtgctgagccatcttgccagcccctgaattgggtatgtttgagaaaagagatgatagcatctgctccggtctactccgggtgtgttgttttgtctccaggttattggtgtcagtactggcgacacttgccaattgtggttattggtttctagagctaaaaattgtgatgtgcttcttagtagataattttgaatactcttcaagccaatacagatcggcagaagaaaacttgttttgcaagtttgcacatccctgcctctgtaattggtgttcactgaagcccgaaattaggattgtgagccgcattttcagtattttgagtagtgttgcttggttttgcctcatagcttttgggggtaaaccttgagagtgtttgagatgcagtttgccctgttttgtcatgtaatctcatcaactgggactcaggtcccagctaaggaccctcggatttggatcggtaccccaggtgactgctaaggagcaaggtccaggccgctccctagagactcctcctcctgcgtcgcagggcgtgtttctggcagctctggctctggaatgactcttttcttattgaggatcaatcgtggtccagatgtgggtgtcatcagagcagcctgccataccaccttgacctgtgtcttacaataaagaataggtgctgtggcctctgataattacataaggggagattttgtaagagaattatctgcaacaaccagtggtggttgggaacagtggtttccattgctctgcccgctcttcacacccagacatggatttgatgggcaagtctgactagacgtctctggaagctgtcgtagccattctgtagtgttctcagaaatgacatgtgattgttttccttgaaagaaaaaaaaatgtgagatagaaattaaaaacctaaaaactgtatccagggccaaagagacggcttagcagataagaggattgggtgttcttccatagggtagggtggggctcaatacccaacaccaacatggtcacttatacccatctctaactccagttccagagcatctgataccctcttctggcttcttaggacaccaggcacacaagtgatgtacataaatacatgcagacataaacactgatactcataaataaataaatgcaaatataagaaacagtaaatataaattaaaattaaagtaagtatacccccatgaaaatgcattaggttttaactaggggtgtgtgtgtggttataagatatttactttcctttgttggaccagatataatattcttaatttgtcttagtttttgctaaataatttgaccagcatttttcccagaaggaaatgttggcttcagatacaacttgtgtgtgttgctttgattcactttgttgccccggtttgggttttggtcactctccatgactaatggtggtttgaatgagtccctggtgactagactgttaggttcctagggttacagtctcaaggcttttagtaaataattcagagaggttggcagtgagggtttgtttttttttttttttaatcatttttgctggggatttcatatgacagaataattccttcttgagaaaccaaaacttggattcatgtaaagaacagagttttgatccatagggcaaaagccaaaggtggataaaccagaaagatcccaactctataggccctggttaaagcacacagaaggggctggagtgctggcgtggtggttaagagaccctcaggcagtacccactacccatggctccagctctaggggggatcccaagacccctctcggcaccagcagatacacacacaaattaaatcttaacacagcaacacacaggacattatgctagtgatgagctgagtaggagactgctctcctggactctgccttggggtcagaggttttcccatgttttactctagacaaatacggtaagtgttgccttcatttgacccttggttaagtaacttgtgacttccccattgcttaactgtgtcttcttgtggagcttcttcagtttttgaggctcctttcaccaaccccctaagaatccactatctatcacagaactgattttaaagggtaaacatttttaccacaaatgcctatttccctttcttgtatttagtgtaaatgttggttatgtgctaaggatgtaactcagaggcaggtgccaggccctgggtccatacaccacctcaggttaggcagttcgtaatatcttatacatattcctgaagacttgaagaccaatacactctgcttatatcacctgatcaagtataataatgccaactgtgtgcaggattcctttcaggccactttatgtggttgctttggattaaaagataggcccgaagagccgaacctcatcttttgtacttaatatctctttgttgctgatttgcatgtttgcttgggtctttttggaggatatgggggagggggggtcctcactgactggcctggaactggccactgtggtagaccatgttggcctccagcgtgagtgctgggtttaaaggcgtggtggcacctggccacatctcacggaaagtgaaagtatatgatgtgtaacacaggtgtttctttctccctctgcaggaagcttttcaggaggccctggccgccgcgggagacaagcttgtcgtggtggacttctctgctacgtggtgtggaccttgcaaaatgatcaagcccttcttccatgtgagtggagtagcagtgagctttgaggctgggtggtagacccaagccagagaaaaggattgaaattaatgggtgcgaggagtttgctgtttgctttattttattctcctgtgtcattggcttaaaagtagtactagcatggaaacttacgtaatatagttcattgaggacaactttggggagttttgttgtcttaaataattttgtcccctgccccaggatctccccccccccttccctgatttgatacctgggcctagtgtgaaattcggccttcaaagttacagtgccgaattactttactcttaggaacacttgactgagagacagctgtgtccctggcgcttgcttcatctctaggctgaatttttagacctggctagtgagattgctcagtgggggaaaaaaaagacacatggctcaccctgccagcctgaggatctgagtttgatcctcaaaacccaccctggaaagacagaaccagttcccagaggttgctctcggacttccacatgcacctgtacacatttacatcaataataatgcaataataaataaaataagttctttcaaaataagtgtatggagctggagagatggctcagtggttaaaagcactggctgctcttgcaggggactttggtttggttcccagcacccaaatgggagagtcacaaccttctataactcttgtggggtgttcagcgccctcttctggcctttgcaggcgccaggcacacccatggtgtacagacatacatgtaaccaaaccacccgtatgcataagctaaaattaaataaatgtttaatctctgttacatttcctttgaagacgcttaactatgttgaatgctattatccagttctaacgcttcttggtttgtttgaatgtttccagtccctctgtgacaagtattccaatgtggtgttccttgaagtggatgtggatgactgccaggtacgtagtacgaaatcggatgctaccaaacaccttcacagtggcctccactggagtctaccctgttgtttaaaataaaaacgtccagtaatactagaagtgggactctaagaagttctatttcggaagaatagggcgtgtgccagttatgggtgtggtcctagacactcagagagctgtgtttgcacatctagagtaagcatctcaccactcgcagcctgtgggggcctttggggcctatattctacatccccccgcccccagatgatcactggaaataagttcactttggctctaagagatagtagactaggtggcatcgtggaattgtgaggccactgttgaggtgctctgaacttctcgtgtgtgggaactgtatccacgggctctttctaaaaagaatattgttattcgtatgcttggtctgaatcggtgagaaagccctggcattacaacaaacattagagtcaccctggtgccttagagagctggggggaacttaaggggaaactcacagcctggctttatttagcaagttcatgcctgttgtgcactcagctctgttctgtatactttccacattctgatatcgttcctctcccgttccccatgctgccctgctttagggatgggaaagctgagacagagaagacttgttcttgcagagccagtatttaaaatgaggaagcatacctcctctgcccttggctcttactctccccagcttcttagcatatgccctttgctctcacacaggccactgggctggaaaggcctgtgtggtatggagcaccagggccccgaggaaggatgcgtgagtgcttttacttgccctgggacagaaagaagttagcgaatggggtggccgcaaaggtattggtctcactgggttctgctttaagctaatctcccatctttttcaaccctggttctcagtctataatgagatctctgtacctagccatcagcttggcaaaagttcgggagggtcacatgaggtgttcagaggtcctcttcaggctcccagtatccccagcatggctgtcctcagtacactttctggcctgtcttcgcttgtgtgtctccccggcctgtcctttcctacctggctaaaccatagtcacaagcttcgcttcttcatttacctatgctataccctcagtcagcttttcttctgagcctacagtggtacaagaagagatggaccccgtgcccctactgctggttgcctgtcccttatgaacagtggaggcttgcttgggttgtttctctgtgccttgctttcatcctctaaatggcagtgttgtccagtgtcacaatccagattgagcaagaccgtaattatgaagcctttggagtgcctggctcctaaatacttggtgaaacgtgactgcttttataggtagtgagcatccaatatccaaagtggtctgagatccaagcagttttgaaagtctgtgcagatattatgaaacctagaaaccctaaaacacacctggtcctaagcattttgactaagggatactccattgtaattgtctatcacttgtctttgtaaaatggctaagaagttactcttctaatagagttagggaggaagttgagggcataacctgcttgtcgggggaagaaaattcttgttctctgttttcacaaacttagtctgtccgtagtacccatccccagcctcttcatacatagctgcctaagactatcgggaaacgcatatttacattgcgagtctctacagtagcaaaattagttatgaagtagcagttttatggtgggggtcaccttagcctgaggaaatgtattaaagagtcgcagcaataggaaggttgagaaccactgctatatggttaattagccaggagatgtttactcttggtttagatcagttgaccctgtcagataattctacaggcactgaagtctcctgggccctctgcctgtgtatctgtgagagtgttttaacgctcaccctagggatggagaagggacttcagcacagccggtgatggaggcagaggaaggccctgtggaactgaggacaggtgcccctgcctcagtcctgaccccttcaaagatatatatgtacagcagctggggccatgcaatgacagccccttcaggtctgtttgggtgtctttcaaaacttgaagtgaccctgtgaccaaattgaggcctttaactttggttccatactctaaagaccacagcatagaaaaccttacagaattcccttaaacaccggagtacctgtaactagttgagatagacaactgggcctacacccctagtgtataggaaaacaaggaaatgactgcagtcacagaaagtgacatggaggttcttctgacagtgacaccaccgatcatagcccagtggtgaccaaggaagtggggtttgtgttttgtaattaaacaaacaaacaaaaaaacaaatctgtaaactttcaaatattgtgtgttttggctttgctcagaactctaggtgctggttaatagaagtgacatgagtaaacgtggtcactgttactgtgacggtagaagactatcctagcactgtagccctgtgacaccgtctcagaaaatcagaaattggtcattaagaagagaaggcaggagagcagttatcaggggtgtgtgcagagggtggtgactgattgcaacagggcagctgggaaatgagaggctgttttacatcctcctgaacttgtgaacactgtcaaaatgcccaggctctctggatatgtttttgattatttttaaaaagcaggaagtggggatatgaccctgggttaaatgaggggatgacgagagaaactcaggatcgtgttttcagaactcaggatggtatgagtgagtgtggaggctcacacctgggatcccagcacatggtgtgtgtatgtgtgagtgtggaggctcacacctgggatcccagcacatagtgtgtgtatgtgtgagtgtggaggctcacacgcaatggcagcacgcgttagaatccccaagattttgagacacaggctatagagtgaagttctaaaaacaagaagtggatcttccaaatcattatgtgtaggcactgcagcccttggagcattagctgggcagagtccagacctggcatgctgacggaactgtcagcaggcagtactgaagtccatggaaactttaatacatggcagtgctgttgtgttcatgggtgttggcttggtatagttaaaaccccccaatttaaatttaacccagtctgaagctggtgtatttgggggatttatggtgatggtttgaaacagtacaggcaggaaaatctggacaatggtttttaaaacaaaggaagggaggagagaaacatctctgtaaagttgtacaaatatatattagctacattgattaaaacattgttttaagccaatactaattaaccatatgttaataattaactgtttagagttaagctgttgctggtctatcttgttctctagtctacataaatctaaaagataaaggttgtaggacatacatgggcgctataaaacagctttctttccatgctgagtacatagtgcagctctgagtggggccttatcgggtggggcatatggagtctgccctgagtaggcagggctggtgagcttgatggcctaaaagtcatgagaccgaagcacagtcaagagttctgcttataggattggtgagtgggaggagcggggcgggggggcgggggagggggccggacgggacattcgtacgtgaggactggaagtgcattgggaaatgccaccatttctaggtcagatccaattgcttgaagtatagttcacttggggctgaagagaagctctgcagctaagagtgcttacacagaggacccgggttttattctagcaccagtatcaggtagctccctgaaactccagttctagggaacctgacaccctgcaggtatatatgccttgccttagttgggtttcctgatctgtgatgaaacacatgaccaaaagcaacttgaagaaagggtttgttttggttacacttccaggccacaatccatcaaagggaattcagggcaggaagctggaggtgatgcggaggccatgaaggaggaacactgcttcctgccttgcttagcctgctttcttccagcactcagaaccccctgcctgggtgtcaccacctacggtgtgctgtggcccttccacatcaaacactggttaagaaacaggcttgcctacagcaacagaagcaattttctttaactacagttccctcccctcaggattgtagcttgtgataagttgacataaaactagccagaacacacatgaataaaaataaaagatctttaacaaataaagtattattcatacagtggctgctgtggggcagtaaaggggtgggtgggtacaaagtccatatccgaggatttattgtttgtttggaagtcagggtcttagagcctagtctggccttgaagtagctatgtagccaaggatggccttaaacatctcatgcccctgcctctacttcccaagtgctgcgattataggtgtgtgccatcaagcttggctaagggtaacttttgggttgttattgaatgtgtggccctgagcccagcatcatggtgtacacacctatactcccagcgctcaggaagctgtcaggaggatcttgaattaaggcagttaaggtttcaaacctaactaacagggcaactggctaactggtgcctatttaacatatcatagcagacctagctgacagattctcttagcatccctcagtccctatctgttacagaggaaggctgtcatgcctgccccttaccctaaacttctccagtcaggacactggctgctcttcccccagtgacctttccctatataatccagccattttagttacccagtccttttttttgttaaccctttagcctcctggcttttccctccacctcctcccagatgtatgtatgtctgtctctgtctctctctctctctgttcaccttttatctacaataaacctcctccaccatacctaagagcagtcaagtctccttgttttgttttgttttgtttttcattcacaggccagccttggcaatgtggcaagatcctgtccagagggttagaaatactgcttagttatagaatatttgcctcgcatgtacaaagcactagcttccagccccaggatccacaaataacaattatccagctcttacagtcatctgtatatcccctgccccttgataaaactggaaaaacttagcaaaaaaaaccaggacctgctaattttgaggagcagaatctgtcatttcctcctcttcatgctgaacttaattgaattataaacagtgcagtgaatagccactgcattagcattctttttattaatgcccattaatggtggtagatcttagtaaaacattttaattgagaatgcaacacagtgggcttttatctgcagttgtgtcggtgtgcttaagaggttctgaggctgaagtttggagtatataatggaaaagaggatttttttttctttttttgaattttccatctatatttaatgttcacgttcttgttttcatcctctctccctgaccaccttccctgcatcccaggatgttgctgcagactgtgaagtcaaatgcatgccgaccttccagttttataaaaagggtcaaaaggtacgtagatctcgatttaagagcaccagctggagctgggcatggtgatgcacacctttgatcccagcactggggaggcaaaggcagatacagatggatcttggagttccaggatagccagggctacacagagaagtcatgtctttaaaaacaaacaaaaatctggggctgggtgttgagcacgcacgcgcacacacacacacacacacacacacacacacttgtaatcccaacactttgggagtagcctggaagattgnnnnnnnnnnnnnnnnnnnnnnnnnnnnnnnnnnnnnagagagagagagagagagagagagagagagagagagagagagagagagagagagagagagagagaagagagaagagagaagagagaagagagaacaaagaaatggctgaagtgagttactcaggagatgggttctgtcatcttctatttaatgtctatatacaacctagtgtgctgttgcatgcttgtatttcagagcttacaaggccaaggcaggaggattgctgcaagtttgaggctagcctaggacatatagtaacttatgagctaacctggattacaaaggaagaccgcatctaaaacaaaaccagaaataacacttcagccaaatcacatatagtgcacatgcagaaagcactgaggtcatgtccacacaagtggcgtctccctgtctgcattcaggatgatagagttgtagtgatgctgtaatctcagcacttgggaggctgcggccagcctgggcacaggttatctcttcttactaaattaagaggtctttatgtttgggggaaattttgctggaaccctggcttttctccagatttctttatttttgctattagtcttgtcttttggtttgactttttgggttgtcttttaaaaacttatttgagaaagcttaaattaaacctcccccattctgcattctctctgagcctcttatagaattacagcctcttatagaataatggcattgccctggctaatagccctttcatctctcaacaggtgggggagttctccggtgctaacaaggaaaagcttgaagcctctattactgaatatgcctaatcatgctctgaaaagtgtaaccagctaccagctgtttaaaacctgtaccttttttaatttgcaaaaaactatgaagtgtggagagtctatacccaactgccatctgattataaatgacaataaaatattaattctaccctttttaaaactgcctgatgtgttttaatataaatgagaaatggcctgatttagtcccctaagccactgctttaaggcaaaaagataggagctggagaggtggctcagtcgtttagaacattgcctgttcttgcagagggccaaagttcagttctcagcatccatacggcagctacctgttcctccagttccagggaatctgatgtcctctactggccaccatgggcaccaagcatgtctgaagtacatgtacattacatgtaactaacatacacataaactttttaaaatctttttttaaaacttaatatttagttgtagaaaatctcgtttattcggttacattaaaagtcttgggggggggggtattttaccttaataaataaacatggtccagaccatgagtgtgactgatggttcacttgtgacgaaactgttgctctgatgtgagattcctgtgccaaagattacagttagctgctaacaccctaacagtgagaggcacaagtttctccataagcctggcagtagtggtgcatgctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatgtttctggtatagatgctatagttccccaatcaccaagtgaagacaggcatacaatgaaggattaagtaatgctcccaacaaccgagctactcagtgggtcagttgggatttgaacctttggccccagaatgtaatatgtagcaatccaagtattgtgtggtagtgcttgggtctgagtttcttgcctcttaaaaaaattgggaatttggagtcaatgattggagggacacgttatgtccaaagcacgacgggcttgacatagttgtaaataggaccttgactatacttacacagcagagaagacaaactagtgaccgcctatacgaggtacattttgtgaggcaaactgaagaaccaggagactggccacagcagaacagggaaacctgctcccgatcaggtggttgggtagggctctgcgagatgactgagctgaaacttgatagatgaaaaggactcccaactgccagggagtcagctttccagagaacacaggcaccaagggtccaaggtgaagaggccggtgcagaagccatccgagcatgaaaaaggatggagtagcattgccggggcttcccgggcttcgcttacgcaggtgatgacgttggggcgtcaagggttcatttcaacgtgagaaatggagcttaaatatgaaagccaggaggatccctgcagatacctagggcagatacagagacagtgatgagaaatgtcggggtggaacaagcagcctgaggagagcaggatccaaaaaggtatcatgacggggtaccaagcctcgggaggagggtcagagcaagcaggcaaaggtaatgaagtctctctaggagtgtcacatgctttcaggatgtacattcaagtgagaagtctgtgagggtagctgggtgcttgtcctgtatctactctgccgtacagcattgggcagggagctaaatccctacggcaacacgagctagcattaaagttccacagggctagatagataagagcaggagttgggagacatgatttaggaaaatcaaagagaatccagagtgaagggccccagacagagcccaaagaactctaaggtttggagatgggggacacagaataagaagaaacaaaggagatgatcaactggctggagcagaagtgggggccaaatgattctgagagatttggggaggtgaggagcaagagcaatcttaatgggtgtaggctggggtgggaggagcagagagggagaatggacagatgtttaacaagtgctgcgtgtaccaagggctgaagttagagctctatctcacgctgtacaaaaaatcaactcaacacggatcaaagacttcactgtaagaccagaaacaagccatgctgggtggtgcgtacctattatcccaaaactgggaaggtgggggcaggagtaaactatcctgggctacctaaaagcctgtctcaaaaaaaaaaaaaaatcaataatgaaagaacaaagtggaagctggtaatgaacgcaacagaagttcctgtagcgtgcgtgatggggatggaagccggactggtggggacagaaaaaattaacctacaggaagtcgcccctgtttgtgaaggaacatgttcagagcagcacacatgataaacatgaacaaaggcgtgtgatgtgctctttctcaactggttgtgatgtgactgattccttcaagctcttgtcaccttgatgccaacagtgatggtcacagtgatgccagcaggattgtgacttggattgtgagctgaacaaacccattttcccttaaactgcttttgtccaggtatgtagggtaaatgctgttcatactgagatagaaaaaggtgcctaaaagaccaagtgtagaacgatattaaaaaccagactagtatgattgtgtatgtgtgggacacaaggcatgctatctatccctatcagcaagtgttcgtgtaatttaccagcagcagttctgtgaggacagattccagctaagcacagaggtaaccgagaaaggagtgtaagataagaaggacttaaagtctagctttatctgtaagtatttgggtgtttcataacagcaacaaacaattgcaggtcatagttcatcactgctggaggtcaaggtgacaggagcttgaagcaaatggtcatgtccttgcatcctccgtccagagcagaacccactggattaatgaatgcatacctttgcacagctcacttgctttctccacccttacccagttcaggaacccccgcctagggaatgataccacccacagtatcaagaaaatcccccatagacatgtccaaaggccagcttgatcttgatgcaactatcttcccaggtgactctaggttgtgtaaaacagacaaataaaacttgccatccacgtattatccatgaatttaaaatgtttaaagataaatagaaaggggaaaagtggtggcaggtcaaagaattttgctagaacatagagctgactgtggaggtaagagacattttgtgtgtaggactattgggtgggtttgccaccatcatatgagtggaaagtatgtgaagtgaatattgactgtaagtcaaagaggattcctgtgaaaggaactttctactatagtctagaaagaacagaaggacattacgcctaacatagaaaagcaagcactatttgatgtcatctgtagaatcataaacagactcagagcagagtgtgaagggtgtcataggaaagttgggagcaacggggagatgtttgtacaaaaactgcacttacaaaatgggaccagagctccatcctgattgacttttaggctttatccattctggataccagtatcagtgattttgttgtttgttgttgttgttgaaaattaagaagaatacagagtacagctttttataaaagcatgatgtgacctaacctgtgatcccagcattgatggctgaggcaagaaaatcatgagttcgaggcaatactgggctacttgatgagaccttgtctcgaaattattattatttattattattattattatattgatagtaaatatattattaacaataaaattataattatcacctaaccacagtactgcatgcctgtaatcccagcacttagggggtagaagcaggaagatcagtagttgtaggtcagccttggctatacagaaagtacgaacacagtctgggctgcctcagaccctgtctcaaacaaaaaccaaagtactgggacaattttgaaagaattaagtcaccattattctttttttaattttctttttttttaattattacttttttttttttacttattcactttacaccctgctcattgcacccctcccagtcactcttcccacaacccttccccctctgattctcttctgagcaggtggggggccccttccccccccccacggagtatcccttcacctggaacatcaagtctctgtgaggctaggtgcatcctccccactaaagccagacaaggcagcccagctcgaagaacatatcccatgtgcaggcaacagcttttaggatatcccctgctctggttgtttgggacccacatgaagaccaagctgcacatctgctacacatgagcagggatatctaggtccagcccatgtatgttctttggttggtggttcagactcagcgtgccccaagggtctgggttagttgagtctgttggtcttcctgtagatttcctatccccttagaggctacaatccttcctcctgttcttccataagattccccaagctccatccactgtttgctgtgggtgtctccatctgtctgagtcagctggtaggtggagcctcctgtctgcaaccataacagagtatcattaatagtgtcagggattggtgcttacccatgggatggatctcaagttgggccagttgtgggtggccattccctcagttccagctccatcccccatgcctgcattttttatagacaggataaattttgggtcaacagttttgtaggtgggttgatatccctactgctccactggggttccttcatggctacaggaggtggtctcttccggttccagatcccaatgctgtgaatcacagctaaggacatccctaattgattttgggtgcctcccttatctcaggtctctgtctcttcctggagatggcccctaccttcgcacccctggcagttgcaggtttccattcattctcatggtaacatctcttctgtccctccccacacctgatcatggacctatcccaactcatctctccaacccaattctctccctccatctgcctcttatgactattttattcccccttctaagtaagagtcaagcaccctcgcttgtttagcttctttagatctgtggagtatagcatgggtatcctgtcttctatggttaatattcacttataagtgagtatgtgtcatgcatgtccttttgggtgtgggttacctcactcaggatgatattctcatgttccatccatttgtctgcaaaatgcacgatgtctttgtttttagtagccgaatagtattccgttgtgtagacgtaccccattttctttactcagttttcagttgttaatttccattttttaaaaagaaaaaaaaaaaagaaaagaatctactgggtatggagtgtgtgcttgccacagcaatgagtgttgaggtcagaggacaactttcaggagtccgttcccgctttacgccatgtgcgttcattctaaggctcaaaatcagatcatcaagttttgaggcaattgcctcttcctgagccatctcgtgggccatgacatcactgtgttttgtctcaggcacagatagggtagggatggggtggggagagttaaagggggtggaggtctctctatatagcctcgactgtcccaaagctcaatatgtaggaccaagctagccccaaactcaagatcctcctgcctctgcctcttggagtgcttcggattaagggcatgtactaccacaccctgctgccttggagcttttacgcgctggttttgatctcctggattgaagcagtctgtaactgacctggctgtggtagtatgtgattgctccccatgtgaaagatgggaagaactttacagtgcagagaggatttggggaggagcattaggttataacaatgagcgagagaaacttactcactcttagtttatacttggattacaaagtatttctcaaagcgcaggagaacccactctctgacagatcgttgtgctcccggtctctgcaggagcacaccacttgcatgcaggcacacacgtcggctaggacaatgttgcaacagttatacagagctgaggagcattttctaatatcacaggattccccttacccttgaatgtgtgtgtaaattcacaggctgtgatgtaacatggaaatgtggcactagtcataatcctttacttgggcaagtagctggacactgacactggaactaagtaggcttagttccaataaaaatatgtagcaagcagcagttatacgcacaggctgctcttccaaaggacctgggttgaattcccagtaaccacactaagcagctcacaactgtctgttattccaattccaggggacctgatacctgcttctcgcctatactggcaccaggcacatagataaacacacaggcaaagacatctatatgtctctgtgtagccctggctgttctggaactctttccatagaccagaatagcttcaaactcagagctccacctgcctctgcctctgcctctgcctcctaagtgctaggagtaaaggtgtgtgcccactaccacccagctttaaaaataaaaatttaaatgtagcaatacttatctagtatttcatagttttgtatatcctttattgaattatgccctttaggtttttttgtcctcaaacaatcttgagtattttaaaagaacagtatgttccggggaggaggagttcgtatgtgtttggttttgattggttgagtcggggtcttcctgtgcagcccaggctgggctttagctcactttcctctggatattcttaactcacaagcttgacccaccctgcttagtactccaaaaccttccaaaagcattcaatcggctcattttaagcccacttatctgacttcatttgttcctttctttggaaatcacagtagagagccagacacagcagtacatccctgtaatcccagtgttggaaggtagaagcagaatggtgagttcgaagctaccctgagcaacacggagggctctgggaagcccaaacagtttagcaagaaactgtcacaaaacacaagcaaaggggcttgttgccaggcgtgtgggctgagttttacccacagaatccacagggtaggagagaatcctgattccctcaagctgtgctctggctcctacaagtgtactatggcatgagcactccccctccaacacacacacaagtacaatgagtcaagcaatgtagtttatttcctgagtgcctctgatcttacctgcggggctggtccccatgttgggaactgtgatggaaacctaccttctaatgacagtcatctttgaatctgcaggcctcaccacacccaaataccagaagctctgttctcaaagcacacatacagaagctgtagagaccagcttttccagtcgaactctaagaaaaaggacactctgtacatggtctctctgtctcctgggttacctctggcaagtgtgggtactggcggctctctgaggtagattctaacccgaagcaccactgcttacagaagaggaagcgtgggtgcctgtgcagagcgcaagcagagagcagagcttgtgtgatactgagcaggcaagtcggcactggctagggggtcccggcttggtgtccttcagaaacaatactgctgagcaaagcatcgtgtgtcctgttcagccaatctatgcctgactgactatctaaagaacaatggaagtagcataaatgattttgaaactcggtgttagagggacccaatagatcaaaacagtaagataactgactgttatccaggatggaggatttttaatttttaattttactggttggtagggaaaaattctccaaaaaaagaaaaaaagatagttgtacttagttcaattagattatcagagaaatctgtttggtgacacggtttcatttgtcccatatatatatatgtgtgtgtgtgtgtgtgtgtgtgtgtgtatgtatacactgtgtcttgcctttttccttttagtggtactttatgagaatagaaagatttcggggctggagagatggctgagtggttaagagcactggctgatcttccagaggacccaggttgaatcctcagaacaatggcagcaaattctcaactgtctgttaattctaatcccaggggatttgatggtctcttctgggcgcgaggtatgcaggggatgcacatacacacatatagacaaaatgttcacatatttaaaaaaattaattaattaattaattttaaaaatacaagattttaagccagtcatagaggtacaggcctgtaatcctgacacttgagaggtgaaaagagaggaatcagttcaaagccaaactgggctacacaagaccctgtctgggagagagaaaaacaagcaagccaacaacaacagtgggaaagaggggaatagaacataaggatcccttagttttaatgtaaactactttgtccgtcacactcttcattattagtagctccgatgactcacaaaagcaatctttgccttctgtgagaaaaccaaatagtctatggttccttttgaagatatactctaattttacacagctataccactcttgggcatgtaccccaaagactctacatccgactacagagatgcttgctcactgatgcgcactgctgctctgttcatgatagccagacgctggaaacagcctggatgtccatcagcagatgaatggataaaggaaacctggtacatttatacaacggactattgtttagccattaaaaacatcaaaattataaaatttgcaggaaaatgaatggagatagagaaaaatcatcctgagtgaggtaacccagatcacccaaatcaaatattgtatgtttcctctcatatgtgcatgttagcttttaagctttcagtatgtgttctataatcagaataactacagaggttagatacctagtaagggactggggggagggtggcctcccaaggaaaggggagtaaaatataatgttatgggaaaagaagaggaatcttcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaacccagtttacatagctgtgggcagctacatggaatcatcaggtaataggagagacgattcaccaactagacaactaacaccaacaagtaaaacctctagtgccaggaataggttccgtcttgggtcattggtcaaagataccccatgaaaacacccaaacatggagctggagagatggctcagcagttaagagtactgactgctcttccagagatcctgagttcaatacccagcaaccacatagtggctcattaccatctgtaatgggatctgatgccctcttctggtatgcatgaagacagatacagtgtactcataaaataaataaatcttttttaaaaagagaagagaaagaaaaagaaaaagaaaaaaagaaaaagaaaacacccaaacaccaaaagctaaggctattggttattctccacaaactgatgctaagggctaattgctgaacacagcacttatt

SEQ ID NO: 1310 - DNA, 538 bp, Mus musculus
ccgttgggcgccttggatccatttccatctggttctgctgagacgcgtgtggctccctccccgcaacagccaaaatggtgaagctgatcgagagcaaggaagcttttcaggaggccctggccgccgcgggagacaagcttgtcgtggtggacttctctgctacgtggtgtggaccttgcaaaatgatcaagcccttcttccattccctctgtgacaagtattccaatgtggtgttccttgaagtggatgtggatgactgccaggatgttgctgcagactgtgaagtcaaatgcatgccgaccttccagttttataaaaagggtcaaaaggtgggggagttctccggtgctaacaaggaaaagcttgaagcctctattactgaatatgcctaatcatgctctgaaaagtgtaaccagctaccagctgtttaaaacctgtaccttttttaatttgcaaaaaactatgaagtgtggagagtctatacccaactgccatctgattataaatgacaataaaatattaattctaccctttttaa

SEQ ID NO: 1311 - protein, 116 aa, Mus musculus
DACGSLPATAKMVKLIESKEAFQEALAAAGDKLVVVDFSATWCGPCKMIKPFFHSLCDKYSNVVFLEVDVDDCQDVAADCEVKCMPTFQFYKKGQKVGEFSGANKEKLEASITEYA

SEQ ID NO: 1312 - DNA, 32934 bp, Homo sapiens
  misc_feature (1)...(32934): n = A,T,C or G
tttttagtgtttttgtattttaataatttttgtatttttagcccggctaatttttgtatttttgtatttttagtaaagatggggtttcaccagtttgagctggtctcaaactcctgacctcatgatctgcccgcctcagcctcccgaagtgctgggattacaggcacacctggcccaattctagaatattttcaaggcctcaaaaagaatctgctaccataccattactagtcactacccattctcacgtcccctggtttctggaccactaatgtatttactgactctctggatttgcctattctggacatttcatacaaatgtggccttttctgtgtggttcatcatgttgtggcacatgtcggaactttattccactttatggctgaataatattccatcatatgaatatatgaccttttgttatccattcattagttaataaacatttgggttgtttctatcaaggctgttaagaataatgctcctatgaacactcacatgcaagtgtttgtgtatacgtgtgttcaactttgttggatatatacagaacagaattgttagatcatatggtaactgtgtttaacttattgaggaactatcaaactcttccacagagctgcaccattcttcagtcccactagcgatatatgagagctctaatttctccagatccttaccaatacttgttattgtctgtattttttattatagccatcttagtgggtgcaaaatatctcattgtatttttttttctttccttcaacttttaagttccagggtacatgtacaggatctcattgtagtttttatttgcactttcctaatgttgaccttattttcatgtgcttattgtccatttgtatatcttctttggataaatgcctattcaaatcctttgcctatttttaagatgggttatctttttatttttaaatcctaagagttctctatgtattctagatgcaagtcccttatcggatatgacttataaatatgttctcccacactgtgggttttttcactttcttcttcttttttttttttgagaccgagtctcactctgttgcccaggctggagtgcagtggtacatacaatcttggttcaccacaaccgccacctaccgggttcaagcgattctcctgcctcaggctcccgagtagctgggactacaggtacacaccaccatacccagctaattttggtatttttagtagagatgggtttcactatgttggccaggctggtcttgaactcatgacctcgtgatctgcctgtctcagcctcccaaagtgctgggattacaggcgtgaaccaccttgcccagccctttttttttttacttttctacagtagaatcaatctttttattttcttgatggtgtcttttgaaacacaatttttttaaaattttgaataagtctaattttatctattttttatgtggttgttcttttgggttcatatctaagaaatcattgcctaatccaaggtcataaaaatttacacctgtatttccttttaaagagttttaattttatgtatttgatccattttgagttcatttctgttactggtgtgagacaggacccaatttcattctcttgcatgtctatgtacagctgtcctagcatcatctgttgaaaagactctgctttccccactgaatgatcttgtacctttgttaaggtcaattgactatagatttatgggtttatttctggactctcaattctattatgtctgtcttatgctagtaccatactgccgttttttgtttgtttggtttgtttttatttttatggatacataatagttgtgcattaataccatactgttttgattactgtagctttgtagtaagtgttgaaatcaagaagtgtaagttcttcaactttgttcttcttcaagattgtttttggctattctgtgccccttacatttccatataaattttacaatcagcttgtcaacttcagcaaaaaaaaaaaaaaaaaaaagcacctgagatttttgataagaattatgttgaatctgtaggtcaacttggagcgtactgccatcttaacaatattgtcttccagtccataaacatgagatgtatttccatttatttaactctttaatttctttttcctttttttttttttttttttttgagtcaaggtcttactctcacagggtctcaggctggagtgcagtggtgcaatcttggctcagtgcaacctccgcctcccgagtagctgggacttcaggcacccactaccatgctcagcatttttttttttttttgagacggagtctcagagtctcactctgtcacccaggctggagtgcagtggtgcgatctcggctcactgcaacctccacctcccaggttcaagcaattctcctacctcagcctcctgagtagctgggactacaggcgcacgccaccacgccggctaattttttgtattttagtagagacagggtttcaccatgttgcccaggctggtctcgagctcctaagctcaggcaatccacccaccttggcctcccaaagtgctaggattataggcatgagccaccgcgcccggccttggctaatttttgtatgcttttgtagagacggagtttcaccatgttgctcaggctggtctcgaactcctgagttcaagcaatccactctcctcagcctcccaaaaagctaggattacagggatgagccaccatgcccaggaactctttatttctttcaacaacgttttatagtttttgctgtataagccttgtacttcctttattaaatttataccaaaatcattattttttaattttatatatttagtttatatcctgcatccttgctgaacttgtttattagttataatagttttcaagttccttaagatcttctatatacaccaagaaaccattgattttactttctgtcactatagacttgcctgttctagaacttcatatgaatgaattcatttaatccttagtgtctggcttctttcactcatgtcatctgcaaccggagacagttttgcttctacttttccaatctggattccttttatttctttttttaattggattttattttcttgtttttagacacgcccaggctggagtgcagtaaagcaatcttggctcactacaacctccacctcccgcctccctggttcaagcgattcttgtgccttagcctcccaagtagctgggactacaggcatgagccaccaagcgtggctaatttttgtatttctagtagagacggggtttcaccatgttggccaggctagtctcaaactcctggcttcaagtgatccacccacctcggcctcccaaagtgctaggattacaggcaggagccaatgcgccccgctaggatccctttatttttcttgcccagttgctctgttgagaactggtagcacaacattgagtggaagtaatgagagcagacatccctgtattttacctgatcctagcatataaggaggattcttaccctacctttcttagttatgtgcagctcttgaagcattaatgtggatggctccatctcctttgtaaagaggacaacaagctctttttacttgtatgcttccctcagtggttctccacgtctcagcatttaaggtaagtttggtagattacccaattaacttgtctatgcttaatatctgtatcttatttgaaggctaccattgctataaaaggcttatcaacttttgcatgcactttcacttagccatgcttagaatttttgtggcccaagttagagctctgctgaaatgtttcaacttatctttgttcccttacatatttttatgtttttatgtattttaatgtctttacagatggtttttgtgcctagacaggattattcaaagaccacatgttttacagtttaaataaactttattgagggtattatttgtatccataataaaatgtacctctttttagtgcatttttccatgaggtgtagaaaatgtacggacctatgtaatcaccaaaaagtttcccgtgccttactgcaatcctcccaccccaacaccaagaaaccattgatttactttctgtcactatagacttacctattctagaacttcataggaatgagttaatacaatctttagtgtctggcttcttccactcagtggtgctttttatatttactcatgtttttgtgtatataagcattttgttcctttttgttgctgagaagtattctattgtatggacatatcacatttattattatttcacctgttggtgaacatttgggttgtttttagtttagagctatcatgaataaagctgctcccaacattcatatgcaagtccttatatacatgtgttttaatttttggagggtaaatgcctagaagtggaattactaggtcatatggtaaatgtgtgtgtaacttcattaaaaacaaaaacaaaaaacaaaacttgccaaactgtttttcaaagtgggtgtacaattttataatcctaccagtgaagtatgaattatttccaattagtccacaatcttgccagcatgtggtagtgtctgtgtatgtgtgttttgttttgttttaattttaccagcctagaggtcacatagtggtatcttattatggttttaatttgaattgcactggtgacgaatgatgttgagcaatccatctgtttatgtgcttactggtcatttatatatcttctctttcttttgagaaaacgtcccaggctggagtgcagtggcaccatctcggctcactgcaacctccgcctcctgcattcaagcgattctcctgcctcagcctcttgatatatatcttcttttaagaagtatgtgttcaaatctattgccatgtttttactgcttatttgtcttcccattattgagctgtaacagatccctatatattctgaatgtaggtcctttgttagaagtatgtattgagcatactttcttccagtcacagactgggagaaatttatttattcattttcatttatttttaagcaatggttttcaaagagcagagatttttagtttttataatttattctatttatttttattttcttgagatgattctgttaccagtggaagagatccaagttaccctgaattattagcggcgatctgtacacatctgcagcaacttcgtccttgcctcctcagaagaattcgacttcatctcaggattttataggcttacctctttcccatgattcttccctcagggtgggctgcctgcctagtgcctgcccccttacccttgggaattgagcacacacagcgtgtttaggaagtcatatgcatgcctatctgagactttcttccctttttctggaagagcctgcctggaatgtcttattttgccattttgtctcttagtgcacatgcccaggcagtttcttctcccgggcatctggattcatttaacgctttaatgttaacagctgtggatcaccaggaaatggcctctccctggcaccctggttaggctgccacattatcgtttttagagtggtggtgtgataattgtccaaccatcacctgacattcctagtgggtgggtagagagccctctcctgcctcactcatgcctatctaactacttataacaatacttaatatcaagtaaaatccacccactagaacatacatcccttcacaggggatgcaagactgctagcttcccccatttttaaaaaattattttttaattgacaagtgaaacttgtatacattgatggtgtacaacatattttgatataggtatacaatgtagaatggctaaatcaagctaattaacatatgcatcacctcacatatttgtgtatgtgtgttgtgagaagccaaatttattaactttttcatttatagctagtgatttctgtgttctgcctaagaaatatttgcctacctcaaggttgcaaagattatctctaatgtcttcttccaggagttccttggtaaattctaagtaattttatggcatgctgtaaaggtcaagttcctttttctttcaaaaaaaaattttttttttctttctaaaaatctgggattttggaaggagaaagaatctggatgcagcaaagggaagcacttgccttaccgcctggctgtgacatacatggagcattgtatgtcatgcaatgatatacactgagatgggcaaaactttcggttaaagcaaaaagaaacatctgggaatacagtggtgcttgctgaatccagatgattccatgctacatggtgaaagggctcaagcgggcagcaagggtgaccactggaccaaattaagggctataaggagcagtgatgtgcagggtaggttactcacaggggttattatattatctgaaatttacattaaaatacttggcaattaaagtgtgatatagttatgcgtaaattagtttttacaatctaaatagttaagatttgatgtgttgtaatatacggcacattagcataagggatgtcagatatttttcactggtgaaatgaggagtacttaatatatgcagatgggcttgagaactgtgctgatacttcccacccttcatggacagagtataagaattagtgaacattggatatgactaggtgacctctttgaatctcaatttctttctctgtaaaataggaaaaataatgtctatcttctaagggatattgagaggaatgataagacacgcccaactctaggcttggcatttaatgactgtcccacccaggttaatttgttccttttccttctaccactttttttactgtagtacttcgagctcctgattttatgtcacttaccacattctcttttgagttcccatctcaactctcttgctagacacagtcttgaagcttaactaatgctggcctccctctgaaggtcccatggcaaagctcatcaaatcttagtgtacccaatcacctgagatgctttttaaaaatgcagattacaaagccttacctcaaaagactgattctgtatgtctgtctgggtgtggtccaggaatgtgcagtatcatcgagcacctttggctatgatgaattaggtggtcaagaaccactcagagacacgtgggatgtgagaaaaacttgtttcagaaatcctacaattacattttcttcaaattcgagttgagacccaaacaaagacagctgacccagttctccagtcccatgtggaggctggactcagctgacccaggcctgaagcaggcccatcacccttgttacatgtttccgcccttctgggtgacataaaaatatcatttttgctggtccggcagcaatctccccttttctggtaaccccctggattttccctactcttagtgcaaagcttcaagcaaggctaatccctttccccaccatgaaagtgaaggtcagcctctcagacatttataagaacaaggaagaggaacactcttcctgtagagatactaaactagtaagaacctaagtctggagctgcctactccactcttacatagagtgcctacttgagaatgaaactaagagagatggtgccctttgacatcattaggcccctggggttcttgctaatctgagttactaattctctttttgctttacgtcagtttgagctagaatttctccttgcaactgaaaattctgactaacacacagagcctctacatttctctgcacaaatgaacgcttcctctctgggcagtcccaaataattcccctgtacctcactctcctcaaagaacgtcacctccttgccacaaatgcagggaacctgctccttgggaccaggtgcagcccacttttctttcttccttgcagggaaaaaaaaggccttttcctttgaggcttatgttacggagctcactgttcattactactgtcttcattacttaattcatttaagactgacacctgttttataatctctccttccaccctagctctgccatcattccagatggatctcatcattcatttaatagcctataatcatagttcatgtagcattcactacacaccaggcacggttctaagcattttacatatattttagttcactcaacccttataatagcacaagctattattacgcccacttctcacataaggaaactgaggcacaaaaaggctatttagacttgcctagagttacccagtcatgaagtggtagagtagggatgaggacaacggagtcaaattgcagagtccagactggcctcccagttccttataactgtaccatcctccacatctactctgcattggtgctgtggaggtgggagagagggagtacctccttcactgagtcactggacatttggaaggtctttggagagaagtcagctgaggatggcctgcattgccccttcctggaactcaatgatttgttgttatcacccatgcaaattcaccaacaaacagataaaagtcaggaagctgggatgcagctgaactgaaaacccagcagcagaaaagcaggttatagattctgctctgggtgctccatacagctccttcctctctgccccaataacctccctctctttgggaacattgctgcattcagggcagtctgtcttccctccctatgggctgtctttagaatgtgtcccttgcctatatccatattcatgctccgtgctcctcagccccctagaaactttgcacaatagattcaaaacctctggtttcctcccttcctctgtctgaaagagtgaaagaaggaagccagggatttcagggggcagccaggcagcagtatcaccacccctaggcaatcacacctagttgcagcttcatcgggaacagctcagctctgaaaacacagacctgggactctccctcccagccttctagctctcgttcctgtgagcagcttttcaacctccacttccagccgctgacaggccctcctggctccacaaggccagctaacatacccaccttccacaatccccagccctgccagacataacctgcaacaggcattcctggatcaatgcaaactccgacttctgttccaggagtctgcctctgttagaagaatctcacacaagtgtgcgtgctgtgccattgtaaatgctgtataaggtggccaggcccaatcagtccctgcaagacaccgaacagtaagaactatctatggagtgtttactatgtgccaagcaccgtcctttgcaagcactattaaccctcaaaataccaccaccgtgagattgagaccatcatgattcccgttctacagaaggaaacactgagacttcaggaggtcaggacctttccagggtcacaactgcgtaactaagttgcagagctcaacccagtggcacttccatctcacacgcagctgtctgatggtcaagagcccaaccagtcccccggtcgtttctaccgcactaaaccgctgtgtcaagctggagcagcgggctcagcagtgaaaatgaaagaacagaaggaggttacagagaagagaacggtcacggtaaattccggagaggaggcaaggacgtacacaccgagatacttcccggtcaccgttactcagcactttgtggggttcacgtggctgggggggccggggcgtggcggcccttttcgaggaatccagccctgcctgggcggtccccatctcgagcgtgggcgtgttcgattcaggcccggcggacgcatccccaggtgacccgggagggaccttgtgtctctgggggtgactgtccgtctccccgcctcccaccgtcacgcgcagtgctgatccccacttccagctggagtgcgagctgggcttggggttacaggagccgaagccctggagctccgccccacgcttgcgccagccccgccccgatcccggctcgcaggctccaggggcggggcgtggccggggcgcagcgacgggcgcggaggtccggccgggcgcgcgcgcccccgccacacgcacgccgggcgtgccagtttataaagggagagagcaagcagcgagtcttgaagctctgtttggtgctttggatccatttccatcggtccttacagccgctcgtcagactccagcagccaagatggtgaagcagatcgagagcaaggtacgcgctaccggggaaggccagggtgccggcgccgcgcgcggcctctgtaactggggaaggcggtggcgggaggtggggaaggcggtggcgggaggtgcggaggccgcccctccgcatcgccaggggaaagggacgcggcgtctcggcctgggactgcgggaagcagcggcctgggcgcgcccgaggcggtggagcctgccctggaggaagggaggagaaggacgagggtcccctggagggcggagtggcggtgcccagcgtttctcgcaccctgttcctcgggggattgcacgcacgcggggagcgtccgggggatgtgagagcgcagacagcgtgaggagtccccacgctgcgcctcctgcaccctcccgtccgggcagccccgactggaggaagatgagggaatggaaggggtccgcccttggccccccatctgtatccagattcaggccccaggcaaggatagggagggcccttgcagaaggcacgggtcggtggccgccgctgcctttccgtatgtgaagtgatccacccgcagcgggggtagtgatctccctttgggagcgggtctaggccggagacccccgcctgcctccacccatgcccgaccccaaaggtgacgcgtgctgtatccgcactaagggggcggattgcggctggagaccccctggcacgtgcaggtctgtccaggaggcccgagggccccaggtgaccgcgaggaagtgaggtccgggccgcgcccacgggactcctgtggcgcagggcgcgtttccggcagcagtggctttggaatgactgagtccccaaggttgggcccgggggcctcggctgccctgcccgtccatgattcaccctcagtcggtgggttttgctggagccagggttcctcctgggagcagccgcgccctgctgcctgctcgccgacctatcggtatcccgatcgttgttttgtcctcttaaaaatgcccaaggcgaaacagccttcccatgtttgaaagttattgcaagcctaaaaccttgtagactgggaaacccagagcctaacgcgcagtgtctagtccaatgtagccactccagaaatatttgttaaatgcagcgtcagaaaagtgagtggaggaaattgatactgctcgaacggtagaagacccctcgccagcgcctaccctgcgattacccctccctacctgcgggaagcagaggagggcgggtcctcgcccgcctcgggtgccctgacctgtttggtgccgggtgggcttcggaaacagaagtgtgtctgcaatgtgtccccgatccttttgttcctttgattattattgactctcagtgttttttcctcatatgttgattgccactgtcatcttttatcttcctctcaatcagttttttcttagtgggattctcattttagcagccctcatgtgttgaaaagatccttagtagtgaattgtctttcatatactttttttccaagcacctattgtgtgacaaattattaatccattcctggggaagggagtggggctgggattctgttctccagggtctggcaacctcagtataacccaactgctaagaaccccctccactgagccagaagacctttgagtggtctatgttagttgtcccaaaatccagacactacaaacaaagttgattaggatttctggagcacacagtttagtcctcccagttgtcagagcatgtcagagcaccttcctcctctaccagtgacaaaggtgtacaagggtgacaggaactttaaaaaaagcactacagcctggggcccaaaggccctgataatcaattaatcctcaaaataacaatccaaagtcattgatcgaaagttacactaatttgattgttatttgtctgttagtttgtttttcgagatggagttttgcccttgttgccctggctggagtacagtggcgcgatctcggcccactgcaacctccacctcctgagttcaagcgattctcttgcctcagcctcctgcacagctgggattacaggcatgcgctgccaaaatgcccagtaattttgtatttttagtagagatggggtttcaccatgttggtcaggtttgtctcgaactcctgacttcaggtgatccaccaacctcaggctcccaaagtgctaggattacaggcgtgaaccaccacgcccagcctgttatttgtaaatgttgaatacatgttacattttcatcctaatgggctaaatttgcaccatttgccattcagaacaattctgtttctgaggtactctgttggtgctttagggccaactgggatctatttcagagaggaatggaataattgactgtaaatgtgatgaggaagaaataaacacttttaaaaaaaatgacacctaccatttattgaactcccatctacaaggcacttggctaagtacttcagaaaccactcacacttattaccctcagagtaggtatgttgaggcaacgagatcttagactcttgctcctatttaccccaactacactgttctgcttcccccagattattggtgtcagtgatggagacatttattaatcctgttagtttctgggagctagaaattgtgatttcttcttagtaatacaatcttgaataattttcaagctgatacccgtttagaagtatcagaagagaatttgtacatgaagcctgcacatacgtggggtgtaactcatgttcagttaggctaaaagttattgttgcgtgcctcttttcagaattttaggtacttgtgcttaaatttgattcagaactgttttggaaaagccttgagtatgtttgaaataccttccctcttgaaagtaatctcaagtttttaataagggttaatcatgttaaaaaaacaaaaatgtctattcaaccagacattggcatttcttgaccttttttcctgtcttacctggatcttgcaataaaggatgcctggtttaactttcttgaaaatcacattagggaaggctttgaatgaaattgatctggaacaataagtgatgatttggaaaaacaattgctatacttctatgtaccctgctgcagctctccccatgtctccacctctagaggtggggttcagggatttgcataactaaaaaatttatgaaagtgttgtcctacctttctcaggaacaccatttgtgaattattttcccaaaaacgaggtagaaattagaaatctagagaagtaactattagtacatgaggtcatattagtgttttcttgttgggtttttttttgtttatttggttttttatcttatggttttttatttatttgatttctttctttacgagacctcttgtggcggtggggggcggggaatgttcatttttttttaaacctatttgaccagcattgtttccttgaagaaaacctagatttcagatacagatgtttatgttttgatttatcttaattgctctggtttggtttttgggtttggtcagcactaacgtactaatgtggttaaaatgagtcctttgttttgggaggccaaggcgggtggatcacttcaggtcaggagttcaagaccagcctggtcaacatggcgaaactctgtctctactaaaaatacaaaaattagctgggactggtggcagaggcttgtaatcccagctactcaggaggctgaggcaagagaatcacttgaaccccggaggcaaaggttactgtgagccgagatcaggcctttgcactccagcctgggcaacaagtgaaactccgtctcaaaaacaaaacaaaacaaaaatgagtccttggtaactagaatattcggttcccagggttacagtatctagatagtaaataattcagggaagttagtggtaagagatttcttgatcatttctactgagaattttatttaacaagcattccttatgaaaaataatatctatgaaaaatttccttcatgaggaacgaaaactttcatttaatgaatgacaagggtatagttttaaaataaagggcaaaaatcaaaggttggtaaacgtgtgatctcagctctggaaaccccattatgcttatgtcaacggtgatgtctgagtgttgaggtttgggaaaggtgagtttccttgacttttcaaaaaattttagattttcgtatggtccaccatagacaaatgagtttaatcaaaagtcatagcttttttttttttttttttttttgcgacagagtctccgtctattgcccaggatggagtgcagtggcacaattttggctcactgcaacctccgcctcctgagttcaagctattctcctgcctcagcctcctgagtggctgggactacaggcatatgccaccacgcccagctagtttctgtatttttagtagagacagcatttcaccatattggccaggctggtctcgaactcctgacctagtgatccgcccacctcggcctcccaaagtgctgagattacaggtgtgagccaccatgcccagccaacttttatctttaagtaacttgtgatgtttcaattgcaaaatcctatgcctttgtgacttcaagtgacccctttcataatccataagtgtttaatgaatgtctaccatatacctagccttgacatggaaacatttttaatacaaatgtctatttttattttccttttgtttggtgtagagaaaaaatagccagttcacaatattttataaaatagttatgaagagaatgtcagtatactctacacatatcttgtttcatcttatcaagtaacactaccaacaatgtatagaatttcttcaaactgagttttatttggcttgtttggggattttttttttttttttttttttttttttggctaaaaagtaggtcctgaaaggaggacctccagaatgtgctttgtgtcattgtgtcgagtctttcttttgaaggtttaatatttaactatttatttaatataagcttttcttttgctgttagactgcttttcaggaagccttggacgctgcaggtgataaacttgtagtagttgacttctcagccacgtggtgtgggccttgcaaaatgatcaagcctttctttcatgtgagtattaaacaatgtctgctttgtaagagatttgtgttttttgagttggtggtcacagtggtaggaaagaaagacagttaaaggattttggtttcggtggggggatttctttggctggatctttggtctaaaagtagtagtataacaaataatttaggtttgatacatgtagcccattgaaaacaaattttagaagttaattttgtcttaaatagttctttttttccccacattgaaacatgggccttatttgaaatcccagcctcagaatttgatatgccaagctgttttatactaagaaaaatttgatttagagaaaatttatgtctcttagatctatgtctccaaagatctaaatttttggatctttaattagtctctacttttattaagtttccatttaagaagcttgggtatgttgattgccattacctagttctaaatctttttggatttttcattttaaattttccagtccctctctgaaaagtattccaacgtgatattccttgaagtagatgtggatgactgtcaggtatgtagctggaaatatgagatactgctgagcttttcacattggcctttttctctgaattgcacagtgcttttttccataaatatgtcaaataattctagaactgtaatcctatctaaaaagttctatctcagaagagcaggcaagttaggagcttaatcctagctatcgggagctgtatatcacatcctaaagtaaacaaaaataaatgagtgagacttctgaatcttatcggccacccacctttctaaaaccctacattctactttacactctgagatgtgcaataaatggagattgaatttagctatgatcattacatccataggcttgatggagtcaccaaattatgagaccgcttgtagggctctttgtgaacttgcagtagcatgagaacctgcatttgcaagcctattctagtcttggttgattttagtcaattagaaaccacaaatgttttaacaaataaacaccaaggtacctgagagaataatttggaagaaattccagggttggttgtatttaacaaatacttgttttgcactaggtatataccaggcactgttctgggtggtttttaagtatcagttcatttaatcctgagtgctgttatcatccccattttatagatgagaaaactgaaacacagaggttgttcatgaagtttcagtgagtatgtggctgaactaggatttaaaatgaagtggtctggcttcccagcccttgaccttaagcactacccatcggaggatgctctgtcttgtgggtgtagatcgggtgcttagcacatgaccacagacctaggagagcgggttgaggaggtatcacttcggggccctttacagatatgtgagcattttcacttagccctagtggagaaggaaaggcgatgggggaagggtgcagtgtggcaacagaggcgctggacctggcttccagtcctggctcactagcatctgcttaggccagtcactcctcttccttgagccttaagacctgccccatcaacctcccaaggttgcttattcattgagcaaacatggaatatccaataaagggtgaagggtcacttaaaacaggcatatggcagtgctctctaaacatgggagggcgcaacaaccccagattgtgtattcttagccagtttttgactctgtgccttgggcaacccctgccttggcttgtgctgtcttctccatctggcctgtcctttcctttcctacctgactaactccttgtcatgagcttcaccccttctccacttaccgccttgtgtgccctaagtacccagtgaatcttggcaattattataatgatctttatgtctgtcctttaccattagtctcagtagattcctaggatcagagaccctgtcttaattcacgttggttgccccttcacctagcacacctgccttgcatgtagtataggtgtggaatgaatgaatgatgaatgtgatatggttgttaagttactattctagatgtgtcccagagttgtttttttttttttaaaaagagtgtaattgcatttttgtgaaaaatccttatcccttgttttaatcaaacttagtcttattaaggtcaatttagctaggggaaaattgcacctggaatagagaaattctaactgccactgatcctatcagatagcaacttgattttttttttttttttttttttttttttttttttgagatggagttcactctgtcacctggggtggagtgcagtggcatgatctcggctcactgcaacctctgcctcccgggtttaagcaatcctctgtctcagcctcctgggtagctgggattacaggcatgcaccaccatgcctggctaattttgtatttttacaaaattaaaaccccagtagagacggggtttcaccatgttggtcaggctggtctcgaactcctgacttcaggtgatccacccacctcggcctcccaaagtgctgggattatccaccacgcccggccttgatttttatttgaaagcaataataggtgccagatgccatgataagccctttgcatgcactatgtcatttaatcctcacgataactatacgagtattttttattagcaccctcattgaacaggtaatggcactgcagcacagaaggtaaagtcagtctcttgaggcagaccaatgcaccatactgtactgaggacaggtcttcttactgcctttaggaagtacagtcatgcatcacttaatgatgaggatactttctgagaaatgttaggcaattttgttgtgcacacatagagtgtacttacacaacctagatggcatagcctcctgtacacctaggctatgtggtaaagcctgttgctcctaggccacaaacaggtaaggcatgttactgtactgaatactgtaggcagttataacacaacagtaagtatttgtgtatctaaacatagaaaaggtatggtgaaaacatgatatgaaagattaaaaaatggtatgcctttataaggtacttgccataaacgggacttgcaggactgagaggtgctctgggcgagtcagtgagtgggtggtgagtgaatgtgaaggcctagaacctgtagacgttataaacactgtatgcttacaaattttatttttaaaatttcttttttcagcaataaatttattgtaacttttttactttatagtttttttatttttttaactctttaactcttgtaataacacttagcttaaaacacgaatgcattgtacagctctacaaaaatattttctttatatccttagtctataagctttttttaaaaagactttttaaactttttgttacaaactaagattcaaacacatacattagcctagaccaacacagggtcaggatcatcagtatcactgtctcccatccccacatcttgtctcacagaaaggtcttcagggacagtaacatgcatggacctttcatctcctatgataacagtgccttctcctggaatgcttcctgaagggcctgcctgagcctgttgtatagtaactgtctttttaaaaaaataagtaggagtacactctaaattaataatgaaattaaagtaaatacaaaaaccagtaacgtgggtgtttattatcaagtagtatatactgtccataattgtagtgatatgcttttttaagtgaaagcaagtttattaagaaagtaaaggaacaaaagaatggctattccgcaggtaaagcagtctgtagtggtatactttgtatgtaattgcagcgcagatttgtttgcaccagctaatgcgatgggctatgacattaacccatcactaggtgagaggaatttttcaacttcattataatcttatgggaccaccacatatatgcaatctgttgtcgatctaaatgttatatggtgcattactataggtgtgcaaagcactcgaggacttccgtatgacagagctcctccttcatgtctgcttggtgcaccctgatcaccctgaatgtatcttttttttttttttttttgagacagagtctcactctgtcacccaggctggagtgcagtggtaccatctctgctcactgcaacctccacctcccgggttcaagcgattcttctgcctcagcctcctgagtagctgggactacaggcagccgctaccacaccaggctaaatttcaactttttagtagagacagcattttgccatgttggccaggctggtctcgaactcctcacctcaagtgatccacccgtcttggcctcccaaagtgctgggattagaggcatgagctaccgtgcctggcctgaaagtgtcttttaaaaccttgaagtgaccctctgacaaactgaggaactttaactttgcctccatagattgatagaaaagtatgagtagtagcccttttgaaaatgatagaccaaccttatttctctgacagccaacagggttatgatacttattttataaatggtaacctccctctgacccttacttggagtgagttttcaatagtatgcattcaataaacattcaccatttttattccagccattactgtccttgtgcctcttactggaacctgtactttcatgctcagcaggtgtccagcattaaaagaaaaagtaaagattacctagaaagaactcctcaacagtagtgccacccaccatcctagaggtcgtcatagtgtttgtagctggcctttcttccccttgagaattctccgttggtttccgtgatttggttatcaacagtcctgcctgctcgcttgctgtcctgtgtagcttttgctgcttaggtgctgagtggttctatatttctttcccagtcctcttttgagtgcctggctgacattttcaatctctattgggctccaaaccaaaccagtttcgtggtattgtcctccaaaccttgccctcttatagcatgaacaatgtgttgagcatggggtattataagagttctcatttagcattccacagttgaggaatgtgtgttacttcaattacctttgagctgtagaaaaatctttagctgtggtaacagccacttctaggagaggagaaaatacggatcaactagcccaatttgcgatgttaggaatttgtcgattttcttagtaggatggctttcaaaggttagagcatcagagtcacctgaagcccgactttaactgtaatggtttaagatggggttgatggggaaacttgtagtacccctcaggtaattctgatactgcagcaaggtttgagaattcacaaagtctttttatttttcctcccgagatagtctcattctgtcgcccaggctggaatacagtggcatgatctcagctcactgcaacctccgcctcccaggttcaagcaattgtcctgtctcaacctcctgagtagctgggatgacagatgtgtgccaccacacctggctaatttttgtatttttagtagagatggggtttctccgtgttagccaggctagtctcgaactcctgacctcaggtgacccaccggccttggcctcacaaatcagtttttaattaaaaataagcaggaggctgagtgtggtggctcacacctgtaatcctagcactttgggagcccgaggaaggtggatcacttgagctcatgagtttgagaccagcctgggcaacatggagagaccttgtccctataaaaaaaaaaaaaaaaaaatatatatatatatatatatatatatatatatatatagtgtgtcagataacatatatttccacaaatttttaaattatctgcttcaaatttaatgacagtttgctctacatttgttcataattttatattacttttcttcttaataaattgcaagattaatattcttgcatgaagaacgaggtttcaaaaacaggaaaacactccgaatgtaatcaccattatattatcatcttttttgaggaaagaagatatatataagcctggtcccagactgcatatacctatcatatgataattcttgtactgcatggtcagaaaataatgagacatgcaaaacatttaacagaaaagtggcgatgagatggccaaataggaacagctccagtctacagctcccagcgtgagcgacgcagaagacgggtgatttctgcatttccaactgaggtaccgggttcatctcactggggagtgccagacagtgggtgcagtgcactgtgcacaagccannnnnnnnnnnnnnnnnnnncaggtgtggtggcgtgtgcctgtagtcccagctactggggaggctgaggagggaggatggcttgagtctgggaagtggagattgcagtgagctgagactatgcccctgcattccatccagcctgggtgacacagccagaccctgtctcaaaaataataataatcagtaaacccagtgtggggttattcctttagattactattattttgttcttgaacaattgatttttatttttttagactttttagcctttatataatcattctgtgtactctgccttcataataaaactggaaaaattatgagcaagaaataagaggtactagttctgaggaatagttaagattatcatactgagtccaattgtagcagaattttttgttgcttctttgtatgatacttaaaatagttgaaaatttgattggattaaagagcatattggatcgctggagtatctgatgctagtaacattctgaacattctgcctgttaatgtgcccgtcaaaggaagtaaatattaataaaacttcttcattgagaatataaccggtttggcttttgtactgccattatattcattatattaattttcatatgctgaaaaatgtcctcatgcggaaatgtggggtacatgacagggaaaagtttctggttttggattacttctgtcaaagctcagtactcgcagtcttgtatttaatcctctccctttgctactttccctaccaggatgttgcttcagagtgtgaagtcaaatgcatgccaacattccagttttttaagaagggacaaaaggtacgtacatctgacctttaaaactctaactgggcaataggaaacccagtataagtgaataaatcactggagtgatgttccctttaaagattgaggcatatcaccaagttctgcttttaagaatttttaaatatgccaaaattcattggcttaagtacataatgtgacagctaactgaaaatcaatctttcctagaactagtcctatttatatcataaagcacatagaatttcttagacttgggcagttcatttgttgttaagtattgtgtaaaagaaaatttgtacttgagccttttgacttttctcttgatattttttctttgtttataacttaaatgaactgtatgttattcagggaagtttactttaaataagattatacttctttttccctccacccctattcttccttcattctatgctgaatacatatttatacatatgtatatatatacatatgtatatgtatatatatacatatgtatatgtatatatataaatacatatttatacatattttatgtataaaacagtgctacagtgctacgtctaatgtcaattcaatattctcttaacaggtgggtgaattttctggagccaataaggaaaagcttgaagccaccattaatgaattagtctaatcatgttttctgaaaatataaccagccattggctatttaaaacttgtaatttttttaatttacaaaaatataaaatatgaagacataaacccagttgccatctgcgtgacaataaaacattaatgctaacactttttaaaaccgtctcatgtctgaatagctttcaaaataaatgtgaaatggtcatttaatgtattttcctatattctcaatcactttttagtaaccttgtaggccactgattattttaagattttaaaaattattattgctaccttaatgtattgctacaaaaatctcttgttgggggcaatgcaggtaataaagtagtatgttgttatttgttatcttttgacagagaaaatagcattctctgttttagcaggtgaatcctctatgctctccaaaagatcagcatgaccaaaattgatgtccactcatgaaggacttgttcgttttgtttgtttgttttgccacgaggatcggatcttgattctcctcgaagtatctgagaaagtctagttgtataggccagacataggttctgtcttgagtggtaaaagttgtgggaaattattacttatatcattcaaagaacattgtttcttgtgttctaagcacagtaaggggttgggggtttgaagaaactttttgagtttacataataatgaagagcagaattatcatatgccaggtatcatctttctattaattcacttaatctttgtaacaatcctattagatatagacactataatccccatttacctgtgaggaaacagacaaagggtggtaatttccccagcatcacaactagtcattggaggagctgggatttgaaccaaagaagtctggtaccagaatatgtgcctttaactactacattgccctcagtgcaacaatctgagtaagcaggaaaatgatgggcccttagttgagtttctttcctcatgtgaaattaggatgccaaacttagatgatctctcaaaatactaatggaatgcctgttatgtgccaggcatcatgctaggcttgggataaagctgtgactaagacaccctcatcctcatacagcttacattctagaagcagagacaaacaggtgaataatagactggtatattctacaaggcaaaaccaaaaactgggcgcagtaatgagaagaataggggaaccagctgtgcatcaggtggttggacctgggttctttgaggtgactgtaaacagagctgttggataaaaagtactccaacctgctgagagccagggaatcagctttcaagcagagagaatgacagacacaaaggcttgagtcaagaaagagcttggtaccttgtagaatcatcagaggagcatgaaataaagctcgatagagtggcagggccaggtcagccagggcgttatttgttctagaacggatgagaaaccatcgaagggtaagtcagggtacatgctttgttaacaagttattttggcacctgtatagaaaacggaaactaaaaagtggaaaaccagttaggcttttttgtttgttttttgagatggagtttcgctcttgtcagccaggctggagtgcaatggcgcaatctcagctcactgcaacctccgcctcccagggtcaagccattctcctgcctcagcctcctgagtagctgggattacaggcacccgccaccatgcccagctaatttttgtatttttagtagagatgaggtttcaccatgttgaccaagatggtctcgaactcctgacctcaggtgatccacccacctcagcctcccaaagtgctgggattacaggcgtgagccactgtgcccggccccagttaggcttttgcaattacctagatcagagataatgatagctgtgactaggaggacagtggggaagtgacagagatggaacaaagcctaagggcctgtgagaggaagacccaggagtgaatctcaggtttctggcagaagccctgggtgtcggggtatgatgtgatgtcatgagtgaggtgaggatgggagggagaaaggggtggtggtgagggagtcagtctctggcccttctgagttgggtgcttctgaggtgcacatcccactgaaggtgctgtgcaggctgttgggtacctagttgagagctccaaggacaggtctggactgggatagaaatttgcaagacattgtcatgtagatggcacttataaacaaacatgacatcacccaggaagagtccagagtgaagagggctcaagatagcctgaaggactcaatatttggagatcaagtagaataggaaccaacaaaggagactgaagggtggccagaggggaaagacaaaaaccagaagagggttttatcctggaagaacagaggagaacatttcaaaaaggaaggagtatcatttaccaaattcccttggagctaagaaaggtaaggttgagaaaacaaaatggaggttggtgattgcaacacaaaattcctatggagtgatggggaaggaagccagattggagggaacagaaatcacacttctcatatctgtcaagcaatccggccacctctgcctcccaaagtgctgggattataggcatgagccactgtgcctggcccaaacttgtagttataaaatgaataagttctggggagctaatgtgcgccatggttactatagttaataataccgtattgttcacttgaaatttgctaagagtaggtcttaagtgtgctcaccccaccctccacacacacagacacaaatggtaactgtggtgatagatatgttaagtaatgtgattactacacagtgcattcatatatcaaataattacattgtacaccttaaatataagcaattattgtcaattatgcctcaataaagctagaagttagaaaaaaaaaaaaaaaagaatagattcagaccacaataggagagattggtgttggttatgtctttcctccaccataaccagtgggatgaaagtgagcgcaaggttagagagcattgtcgatttagggatgggaagatggcatttccatctgatagtttctgttttccaagcaggcagttttgaggagaaggtatgaaattgttatcttcacagtggcaaagcaaagcatggtttctgggcgtagttgagtgtctgcatgaggtttgttaggacctcagagccctgctgtgtgtgcaggcaactgaaggtggagagttgaagccggagcaggattgggtctttgtagttgagtccagtagtgagtggggatgcagagaagctgacagtacttttgagggattgattatactgatgcagtatagaatcaaggctggagaagtagagaggagaagccaagaagaggctggtgagccacagaaaaaggagtgtctaaggattagaggtcttgacaaggtcaaagaaggctggcagtgggagtgactgagcaagcaaactttaagaagatgagaggtggtaagcagagtgagatttaaaaaacagatttgagaaacaaatttccagagaagacaaagactagggtgaccatgagaaggaggtgaagtggggtagaggaagattggaactcagcaggtcaaggatttgaggccaggaacatacatgggtttcagggaaagaaaatgggaatagggatggaaagagaagtctgtgaggtgaaccatctttagtgagtgaggaggttgatagcagatggcagcagtaaggaaggtaggaagttggtacaacttcatgaatgagtttcagagtagtaggagattttgcaagaaggagaagtggtttggaaggggccttaggtggggaggcaagcaaaaaatccagtcacctcctgacttgggtatgtggagtgtaaagtgtaggggagggggagcccttaggatgtttctgttaaggaaggagttgatgttccaagaacacattaaagatacagaaacggttcctgatccaaagcaaacttccagcagttactgtgaaagggatggggagggagggtttgttcaggttaagggcatgggtctaaattttggcagcacttagaatcaactagggagctttccaaaaacaaaagtgatgttgggattccagtcccagagattttgctgtaaatgggcttgggtgttgcctggacactatctgatgtgcattcaaagttgagaaccagcagtttaagggatatacaatatagccaggagatgatgggtgaccagctgatcacccatctctggcagtgattgtggtcaacacaatgaaattcattgatagtctcttagcatgagatggcaaacatcctaattgttgcagaaggtagttaacagatgctttttatttcttgattcgaaagcagtttaagagacgaacataaatatcatggtgtttcttctcattcatatcgtttcatagctgtttactgccaacctccaaaaaattcacagatgctaaactttgttgctttgttatggaacaagtgtttagagtagatgctttataacttgaatatattattacctatttaaaatagtaaagatattagagttaactaaagatcatactttataaaaaaaatctcagtaactgcacagcacaattcaatgtcacataaattctattgtccccaaagtggattacttatattaataaatctagaaatattagtgagcactttttacttgtcaatacataaagtaatgaaggtaaatataggatttatagttccgtagaatatagactaactagtcattaaaataaggcaaatattggctgggtgtggtggctcacacctgtaatcccagcactttagggggccaaggcggggagatcacctgaggtcaggagttcgagaccagcctgaccaacatggtgaaaccctgtctctactaaaaatacaaaaattagccgggcttggtggtgggcacctgtaatcccagctactcaggaggctgaggcaaaagaactgcttgaacccaggaggcggaggttgcagtgagccgagaccgagattgcaccactgcacttcagcctaggcgacagagtgagactctgtctcaaaaagaagagaagagaagagacaaggaaggaaggggaggcaaggggaggggaggggaggggagggcagggcacagcaatggaggggaggggagaggaggggcaaaaagagtattctgttacatgaatactgcaaaatgtatggtatagcacactaccctagagttgttcatggtcatccagaagaagcatgagcttaatggcatggcagttactttggaggaaggccaggaatccaacagctagaatttgaagcagagcaccagatgaagctgcaacggaaggttggagccttgaacgccttggaaataatgtggtctcttgttccctgcatcgcaatgtgttttatgtcatggcacacaaagaaaacaatatttgaaccccccactgggttacagtggaaaggatttgggaacatctgtatgtggcttagtgaaaaaatgacatttttactttaaaccattttaacacaaaaaccaaatggaaactattacagagactgttaactcctgaatttgtataaaacttccacaaaaatatcttacctaattttttagtgtgaaacttcaaggtcattttcatgaatgtaacttctctaaaaatgtttaattgtgaaatacagaagaatatataaaacacatgcacaattttagaaatatcaacaaaatggctagctgtgtagtgatcgcccaggttatgaaacagaacattgccaatatcttaaaagtccccagtgtatacctatcataccttcttcctccacctgcccagagataaccccatatggctcttgtgataattatacccttgcttcttgcttttttctttctttcttttatttttttcctggagacggagttgcactcctgtcgcccaggctgaaatgcaatggcacgatctcggctcaccacaacctctgcctcctgaattcaagcgattctcctgcctcagcctcctgaatagctgggattacaggcatgtgccaccatgcccagctaattttgtatttttagtacagacagggtttcatcatgttggtcaggctggtctcgaactcctgacctcaggtgatccacctgccttggcctcccaaagtgctggaattacaggcgtgagccaccacacctggcccatatttgtgtatcctaaacaagacaattcacctggttttgaatgctatgtaagtggtatcgtcctgtgatctgcttcttgcactcaacaccatgcttgtgagtgtcactgtgttaatgtgcataattgtagttcatttgttttcccgatccagagtattccattatatagctacaccacaatttgtttgtccattctgctgctaatagactggagttagcctcagtttttatttacaaaaaaaaaaatgctgccacaaacatacttgatcacatcactggaatacgtgtgaaagagcttctttaaggtatgtgtttggagtaaaatctctgggtcatggggcggtgcttctcaaacattaacatgtgcatgacattctgatttagcaggtctgaggcagggcctgagattccacattttttatttacttacttacttatttatttattttattttatttttgagacagtctctctgttgcccaggctggagtgcagtgacgcgatctcagctcactgcaacctccacctcccaggttcagctgcctcagcttcccgagtagctgggactacaggcccacaattccaatgctgctggtccaggaaccacatacggtgagtagagtacaaatttgaccaatgttactagataatgccacttttcccaagtacttataggaatgagtccctgctattctacatactccatagtatcattagacttaaatttaaatgaaataaaatcaaatttagcagatgtgtaattatgtttcctggttttatcttgcatttctttctttttttatttttatttttttgagacagtctcactgtgtcacctaggctggagtgcagtggtgcaatcttggttcactgcaatctccacctcccaggttcaagtgattctcatgcctcagcctcccgagtagctcagattacaggcatgcaccaccattgtggctttttttttttttttttttttttttggtattcttagtagagacagagtttcatgtgttggccaggcttgtctaaaactcctggcctcaagtgatcctcctgccttggcctcccaaagtgctgggattacagacacgagccactgtgtccagcctaattttgcatttctgtaactactagtgatgctgaacattttcaatatgctattatgtagattttctcttttgtgatctgtttaagtctttgtccccactttcctattgaattgtccattctttactaagtgatttgtaggcattctttatccattgtagataccagttcttcatggactttttggttgcaaatatattctcagtgtggcacttgtcttttcacccactttgtggagttaagtaaacagaagttctgaattttgatattgttgaaactttgaggtcagggagataattgcttttaacattgaaaacactttttatgataatcattttttatgatagcttatgccagacacaattcctaatcaagctttaaaattttatctttgtattttcactaataaccaataaaagaaaactttaatccagctactcgcaaggctgaggcaggagaatcacttgaacctgggaggctgaggttgtagtgagctgagatcataccattgcactccagcctaggcaagagagtgagaccctgtctcaaaaaaagttaaaataaataaataataatttaatttttgtttgtttgtttttgagagagtctcactctgttgcccaagctgaagtgcaatggcgcgatctcagctccctgcaacctctgcctcccgggttcaaacaattctcctgcctcagcctcccaagtagctggggctacaggcatatgccaccatgcccggcaagatttttttgtatttttagtagagacggggtttcactgtgttggccaggctgctctcaaactcctgaactcgtgatcggcctcccaaagtgctgggattacaggcgtgagccactgcacctagcctaataataattttttaaaaaagaaaagtttaatcacacaaataggtgacaaaaatttaaaacactttgacagccagcatctgattgttaaaccaacatctaggaaaaagccaagatggctgaataggaacagctccagtctacagctcccagcatgagcgacacagaagacgggtgatttctgcatttccatctgaggtactaggttcatctcactggggagtgtcggacagtgggtgcaggacagtgggtgcagcataccgagtgtgacctgaagcagggcaaggcattgcctcacccgggaagcgcaaggggtcagggaattccctttcctagtcaaagaaaggggtgacagagggcacctggaaaatcgggtcactcccaccctaataccgtgcttttccaatggtcttagcaaacggcacaccaggagattatatcccgtgcgtggctcagagggtcctacgcccacggagcctcactcattgctagcacagcaatctgaggtcaaactgcaaggcagcagcgaggctggaggaggcgcgcctgccattgccgaggcttgagtaggtaaacaaagcggccaggaagctcgaactggctggagcccactgcagctcaaggaggcctgcctgcctctgcagactccacctctgggggcagggcatagccaaacaaaaggcagcagaaacctctgcagacttaaatgtccctgtctgacagctttgaagacagtagtggttctcccagcacgcaacttgagatctgagaacggacagactgcctcctcaagtggatccctgacccccgagtagcctaactgggaggcaccccccagtaggggcagactgacacctcacatggccgggtattcctctgagacaaaacttccagaggaatgatcaggcagcaacatttgctgttcaccaatatccactgttctgcaccctctgctgctgatacccaggcaaacagggtctggagtggacttccagcaaactccaacagacctgcagctgagggttctgactgttagaaggaaaactaacaaacagataggacatgcacaccaaaaccccaactgtacgtcaccatcatcaaagaccaaaggtagataaaaccacaaagatgtggaaaaaacagagcagaaaaactggaaactctaaaaatcagagcacctctccttctccaaaggaacgcagctcctcaccagcaacggaacaaagctggacggggaatgactttgacgagttgagagaagaaggcttcagaccatgaaactactccgagctaaaggaggaagttcgaacccatggcaaagaagttaaaaaccttgaaaaaaaattagatgagtggctaacgagaataaccgatgcagagaagtccttaaaggacaagatggagctgaaaaccaaggcacgagaactacgtgatgaatgcacaagcctcagtagcccatgcgatcaactggaagaaagggtatcagtgatggaagatcaaatgaatgaaatgaagcaagagaagtttagagaaaaaagaataaaaagaaatgaacaaagcctccaagaaatatcggactatgtgaaaagaccaaatctatatctgattgatgtacctgaaagtgacggggagaatggaaccaagttggaaaacactctgcaggatattatcctggagaacttccccaatctagcaaggcaggccaacattcaaattcaggaaatacagagaatgccaaaaagatactcttcgagcagagcaactccaggacacataattgtcagattcaccaaagttgaaatgaaggaaaaaatgttaagggcagccagagagaaaagtcgggttacccacaaagggaagcccagcacactaacagctgatctctcagcagaaactctacaagccagaagagagtgggggccaatattcgacattcttaaagaaaagaattttcaatccagaatttcatatccagccaaact

SEQ ID NO: 1313 - DNA, 507 bp, Homo sapiens
ggtgctttggatccatttccatcggtccttacagccgctcgtcagactccagcagccaagatggtgaagcagatcgagagcaagactgcttttcaggaagccttggacgctgcaggtgataaacttgtagtagttgacttctcagccacgtggtgtgggccttgcaaaatgatcaagcctttctttcattccctctctgaaaagtattccaacgtgatattccttgaagtagatgtggatgactgtcaggatgttgcttcagagtgtgaagtcaaatgcatgccaacattccagttttttaagaagggacaaaaggtgggtgaattttctggagccaataaggaaaagcttgaagccaccattaatgaattagtctaatcatgttttctgaaaatataaccagccattggctatttaaaacttgtaatttttttaatttacaaaaatataaaatatgaagacataaacccagttgccatctgcgtgacaataaaacattaatgctaa

SEQ ID NO: 1314 - protein, 125 aa, Homo sapiens
GALDPFPSVLTAARQTPAAKMVKQIESKTAFQEALDAAGDKLVVVDFSATWCGPCKMIKPFFHSLSEKYSNVIFLEVDVDDCQDVASECEVKCMPTFQFFKKGQKVGEFSGANKEKLEATINELV

SEQ ID NO: 1315 - DNA, 59589 bp, Mus musculus
  misc_feature (1)...(59589): n = A,T,C or G
atcatatacccagttaaaatgcattgtactaataccagctacgtgggaggctgaggcaggagaatcacaagttcaagaccagcatagtctgcagagcgagctcagtcagttttgagtaatttagtgaggtgctgtaacaaattttaaaataacagtcacaataatggaagggttaaggaggaactcctgggtagaacacttgcctagcacgtgcaaggccctgggtcctattcttagcaccacaaaatcaaatgaatcagtaagtaattatatagaaacctttaaacatagaaagtgcttgtgggatagcatggaacgttagaagttgactatcacattgcatactggttggtttttgttaacttgacaccaaacttaggttcctgtcttgagttcttgctctgacttttcttagagacggaatttgtttttgttttttgtttttaaggatttatttatttattttatgtgagtgcactgtcactcccctcagacacaccagaagagggtgttgggtcccattacagattgtgagccaacatgtggttgctgggaattgaactcaggacctctggaatagcagtcggtgctcttaaccactgggccacctctccagtccagagatggagttttgagttgtaataaacccttccctccccaagttgtttttttttgtttgtttggttggttggttggctgggtttttttggtcatagtattttattgcagcactagacaccctaaccaggacacattcattgcatatacatacactgtctgggctcagctacattaaatattcatttctgttacctctttttttctttgagttttgctatacagatgtcccatgtttagctttaggtggcacatatctttaacttcaacctgagggaggagaggcagggggatttcactgattcgaaaccacttttgtctatatagtggaccagccaggattacccagtgagatcttgtgtaaaagaataaaaaaggcagtcatttgtttagaatccttgaggtttttacagactcagtagcgagcgccagcccatatctgagttttaaagaagccccaataacaggtcacatcggcacctacaaggctcttgctctttccctgcctagccctggagcctgaccaaggccgctagcattgcctcaggcaggaaagcaactgccctcccatcctgggccgactagggaggggccaggctcctctgaaggggactaaagtccttcttggtgtgaatggccttttagggaacagagggagggcccgcggtgacatcacagtctccagtcccgagactcctaaggaatttgtcccggctgagccagtgtgagcactggaatctgtctagagaaagaggcgattctgactgcggactcccggaggtgcgtgcactgggcttttgctctgggtagggtaagacacatctgatgaccagttggtctcatggtcctttgctttctgttctgaaaggagaaagttctctcaaggccagagcctcctctgaggagggagtcagggtctggatttattgcagagagttggaggcctctcctgttgcgtggtgggcagctgagcacttactacggctctctttttttttttttcttactgtgaatcttgtcaagctcccagccttggtgctaagaggcagaggaaatactgcagatacagaccgaagctgcgtgtgtgacagaaaatgccttaaagacactgtctgagtctgtgagaatttgcatgtcccttttgcacttcagaaagctgcctaggcgggacccagggactctggtaacttgttctctagttgtcttgtatctgttcaaagagctccctgatgaattctacagtgggctaacggtttccatggtgtggagctcacggcattcaataggcgacttggggctttgttcctggatgtgccgtggcatgtcaggataccctcctcaggctcatctctgtgcacagaaagttagacttccctactccgggcacagttttcttttctctgagttccactgtagtctcaacttttcttcctgtcatcatgaccctaggctaggcaggaacccagagttcggaactacctaagagcaagagagctgcagcgaagttgggaagaacttaaattaggtttgtttgtgcctgctgaatttattcctcagaaagtccttttgctttactccagggtatggggacttccttccaagcagccttagtgagaaggctcgagagaaccttattctctcattcatgggaatcttgagctaacagccagtctcgggtgttcctctagggaacctccaaaggttctcagaaagaagggacccttagctcagcaaggaagtgcacacctatcacccaagcacatataagctgaggccagatagcaggttagaggctggactgagctagacagagtgagaccctgtctccaaagaagagaggggagaaaaagaaagaaatagcagctttttaagcaagggactcagccaagcaacaacttctttccttcctttcggccctgcccactcctcctcactcgacacacacacacacacacacacacacacacacacacacacacacacctgtctccagtttctttcagagaaagccccagctgtaaatgtgttaaacatcaccttaacattttccagatgtcagatatgcagcgcggcaaagtgagcctggtcttccagcctggctagaagtggaagggtcggtcgttattaacaggaaaagcttgtggtccagaaactcccttaccctaaaagttcttcattcgaatgtgagccaagacacaggtgactttgttccctgtccacgccttctagaagtgtttttatccagtcttagagccccccttgaggcacgcaccaaacctactatgctctgctcaggccaagcccaccgaagctctcagggggaaaaaaaaaagtttgggactattcaatggggctggaactccttgccaccaaagggttggagtttcatgttaagaaccgagccccaccccgccccaggtcactctaagcagtgatggtttcctggcaagatgtctcagggaggacagaagctcaggcattgttagtatcagcccctttcaggggtcaaagccatgacttgagctttcctggtctatatttagcctgcagctgcctgagaaaggtttggggtctgtagtctggctgcctgccttccttcagctgggagctggaagagctgacctccgtcaggagtggtttgtctcggtttcccacagtcaacactaggaccggccggaagcctctctgcagggaggtggaagaggaaaggccattcaggcctggaatgcggcccctctgctgtacttccctgaagtagaattaacaaagaaagccagtatttctgttctgtgccttcgagggagggtgaactgggctgcccagtcctagcgtaaactgtactctaccatctgcaaacacactggggcgcaggagctgcaagctacctgctcgggaccttgcaggggctcagctttctttatgaactctttgaggccagcatcattgcccttagaaggctgtgcaaagcttcctggggttgctaaggtctcattaccattgccttgggcctcttgttcttatcatgtgattggggaccccatctccctgaagctatcagatccctttttgggagagttggccatcctccttcagagctgtggggacaacaagcctcaagcaaagatatgtcaccctgggggagtctcaggcttgacttctggaatggcagcagtttaatgagataatacttaagctcttcagctgctgtccccatcagaccccactgttttcctctgtgtagacagtctctcaaaggtctgtctgcctcctctagggctggtgatgccgctggtaaggggtcctaggccacagcaatagccaggttgtgtcagcctgaattgacattttgtggtggaggcacctgagttcagaaagttaaaaagagtccagaaacaaccatcctagagggtagccacgcatggcctgaagagccagttctttgctatgtagcaactgtgccctgcttactaaacatgtgacttatgcaagccagggagggctaagaaaagggacagcgatgtcctttgatttcccagctatgaggaagttttattctctaaccatgcctctgatcctaggccagcagtgagtgcatatttttgatggaacttaaaaataactggattaaaggatcaggtcacctattacctggggaaaagcatttctaatttaactatagtagctgcaacaggaagtaatctgggttattcagaactgagaaacctggccatgcagcccacacctggcttgatcaatttgggtcatgctgcactgaggctaggagcatgggaggtgatggcgggccagacacttatcaagaggggacgtaaatacctgtgggcagtaagaaaatggtgtcatcatgaacagagcagacatgtgaagtgttggaatttaaacaactactccttaaaaaaaatgacgtactcttttcattttatgtgtatttgtgtattgcatgttttgtgtgtgtgtgtgtgtgtagtagcccttgcagccagaagagggtgttgtatcccctgaaactggacttctagatgtctgtgagctggagacccaactaggtcctctctgtaaaaatgacaatgttctcaactgcctagctgtctttccagcccttctttttttagtatttaattttttactcatgtgtatatggagaaggtcttgtgcatgggagtacagatgtcccaggagcccagaagagggtgttggtttctctggagctggggttacaagtagttatgagcctcttggcataggtgcaaggaactcaactcaagttctctgaaagagcagtatacactcttaccaatgagccatttttccaacccctcctccttctctggagaggtttatttcggcccgggctttgaaaggatctcgtctatcttgatggcaggatcgactttattatttacagcatcctgggtctgaagttgcccgattatttctgggcatatgacgcagagtaaagggctagaaaaatggctcagaggttaagagcacttgttgctcttgcagaggacctgggcttggtacccagagcctatatgggagttcacaaccatccctgagtccattgctagggcacccaaggctttttttttttttttttttaaagcttttccagcacttcatgtacatagagcacatatatactgaaggcaaacactcatacacataaaataaatacatcttcctcctcctcttcttccttttccttcccttctcctcctnnnnnnnnnnnnnnnnnnnnnnnnnnnnnnnnnntgtggatgcccatctggcttttcgtcatttttaacagaatcatcaatttttcttgtccttgttgtgaagcacatctttctggtgtgacctgatgaggaaagatacttctagttcttctggtattgattggtgtgctcagctgcaggcccagacagaaagagcgtgctgccatccactggtccagctggtctagggtcagctaccatcttttatgggaactaggcaggcttctagaatcgtttgtgtgccgttgactgtggtatgggtaggagttgtggttatcttatccttaggaagctgtcagcaggggcagagactctagtttagagcccaaagtgcagacgcccagactgcagtgttgcatctccatctggagggcccagcacacagtgctccgcagcagaagcagcagaagcagcagaagctacctctccagggagtctgccttcgccccagtctggataaggaaggaagacactgacttaaggctaaagtatgagtctaatttgaccgaaggaggttcaagttagcaaggatcaagggcaaaggaagacactctctcagcctgccatccgttcttcatgacctttcccatgttgttctggaagcttcctgtcatattttggaagaagaccttctgacacattgcgatacaatgaagagcggtgacatttatgactagccagttgtgatcttaggggaaaagtctcctctgtttctctaagcctcttaattccaaagtcatgaaatagtaaaatctgtctttcctccaacctctaacagagaggccttggtcttccgggtgtcagctgagagctcacatggggatagctgaggctcgtcaggaccaaaggctgatgcgaattcagtgggatgtggcactgagtgtgcccacagaacgggcactgagtgtgcccctagcacagacagacttgctgtagtgcctggtttgtgccgacatttccacggctatgtaagtactgaggactggtgggctgcatctcatacgagtgatccttgcacagcttttctgtgtaccaggcacccaccgggagctttctgtgtgctgtattctgccacagagctacctccccagcaaatctaaatctagtgcatctttaggatttggcctttctgaaaataataatgataataataattctgttatttttgttttgagacagatgtggtaatgagtgtcctcgaactcactacgtaggccatgctagctccaaactcaccaagatccacctgcctctgctcacaaatgctgagtattaattttgtttttattaattatgtatatttaagtgtgtggatatgtgcatgtgagtgtaggtgccgatggtggcaggaagagggcatcaggtcccctagagatagactcacagggcattgtgagccacctcacttgggtgctggggcctggactaggggtctcaagagcagtaagtgcccctaactgctgagccatcgctccagcacctagaatttgatttttaagggcattttataaaattcttcttctggctttagcaacaaataacattcccaactgtgtttagcttcacactaaaataaacataaaaggctctgaggtgggaaagggtagggagaatagaagtacttttgatgtgacatttctggattggtcactttagccacttttgctctgaaaatactgatccagtgccattctcttctcaagaaagtctcccacaagaaagctgttaatattggttagttgcactttggtgcaaatttgcttaaaaatatactttttttttacacttatacattaaccgttttgcaattttcataatgcattttaaatttccttgcataggaaggattttgttaccacattaaacagtctatgttctctgaacccagtgttggaaaataaacttttagttctcagacctcaaagaatagcaaccctgagattctgcaaactggaaccaagctggggctcaccctcctcatgaaagagttacaggtgtaggctccagtccacaggtgtaggctccagtccacaggtgtaggctgcagtccacaggtgtaggctgcagtccacagatataggctccagtccacaggtgtaggctgcagtccacaggtggaggttccagtccacaggtgaaggctgcagtccacaggtggaggccccagtccacaggtggaggctgcagtccacaggtgtaggctccagtccacaggtgtagggtccagtccacaggtgtagggtccagtccacaggtggaggctccagtccacaggtgtaggttgcagtccacaggtggaggctccatgcacagatggagtttccacccacttcacctatttctagcattcattatgctaatagaaaagccactaatttcactaatggaagcccatttctcattttaattacgccaattagcaaagcttctggagtctggaggggttaaaggaagctggaagtagctatccttggagtcccagtagactactcctaaagtttccctcctcctgtctgtccagatggctgtctgcctctggaatgcaatttaaatgtgtttcagaagcaaacagcagcattatagtacattgcctttgcccaagaattccagagtaaattgcagacatcctcaccagctgctggctattctgggaagccagtgggagggcaggtattatgtaccatggtattaagactctacctgggggggttgtgttggcaggctaaaaatcacccacaagccctttgcttgttttgttttcttttttcgtttgttttgtttttgtttttttgttttgagacagggtttctctgtatagccctgactgtcctggaactcactttgtagaccaggctggccttgaactcagatatccacctgcctctgtctgagtgctgggactaaagtcgtgcgccaccacgcctggcaaccacaagccctttgcatcctactttttctttgactccagaaaacatcacttggtggtttctcccatctcttcattatgttagaggagatcagtactgaaaggaatttccagtcaatgtcatgagcgcatttgatctgaatctggatttcggttcaccttatctgacacccggagaaaattctggttcttcacttatcttcaaagggagcagtaggccttggctggtttaaacaagacatcatttaatgatgtcaagcccagactcctgcgacccagattccttagccctttccccttaacccgctggagtttctggtggctttgattttatcaggcctggggtgtgaaggtttattcctcccgctgagagccaagcccgcagtttgcttttgttacaacagtttccttacgttctgctgctgggctctgaatggttaatgcagctttcttgtctcttgagcttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtttatgcccaatctagtatgcagtttgggggagtaggaggggtagtgatcttttcaaactatgctgacagctatataagcttagatttgttttcctagacagaatctctccatgtagccctggctgtgctggaactcactctgtagaccaagctggcctggaactcagaaatccgcctgcttctgcctcccaagtgctgggattaaaggcgtgcgccaccactgcccggccccattttcttattaaccacagattgtgaaaacattttagaaactggagaggctgtgcagttggccactagctcttcagagcaccaggtagttccttagcattgtgttacgccattatggagaactgaactgtgcagtttagtggccttagttatggtgttggtaatgtatatagtcaagtatagcatgtcagcggggacctgtagcttgtgagcagccagtaagggatctaccagtacatattatgaattgttgctaacgtttcttgtcttcagaatggttgcattacatttggccaagaatcatatgtctttaagaagaaaaatagttctgcagaaagacctttgtatacttgtgggtgcctagaaatagtctcatcagaagcctgtgataatctgtagtggctgcatattaactatgtaatgtcatttactttagttttcacttcttttacatttgtattttgcacatgtgtgtgtgtgtatgcgctggcacgaatgcatgcatgcatgtttgtacatgcatacctcactgtgtatgtggaggtcagaggacaagccatgaaagttagttctctctttccactatgtgaatgccatgcatacctctgtcctcaggcttgatggtggggtccttttacagatggttgtaagctaccatgtggttgctagtatttgaactcaggacctctggaagagcagtcagtgctcttaactgctgagccatctctccagccccccccccccatgcaactctttttttttttttaaagatttatttatttattatatgtaagtacactgtagctgtcttcagacactccagaagagggcgtcagatcttgttacagatggttgtgagccaccatgtggttgctgggatttgaactccggaccttcggaagagcagtcgggtgctcttacccactgagccatctcaccagcccaccatgcaactcttataaggacaacatttaattggggtcggcttacaagtcagaggttccgtccattattataaaggcaggagcatggcagcatccaggcaggcctggtgcaggaggagctgacggttctacatcttcatctgaaggctgctcgtggaaaactggcttccaggcagctgggatgagggtcttaaagcccacgcccacagtgacacacctactccaacctgaggccatacctccaaatagtgcaactccctgggccaagcatattcaaaccatgacaggatctatattcagaatgtgcatttaacctttatttgtgttttttctttattctagaagcctccccagctttctgaggatgctaaccagctgagaagcaagcaagacaactgtggtgacagtcgcctggagcctgccgccagctctctctccccagatcacaaaaacatggaaattggggtgtccgtggcagaatgtaaaagtgtacctggagtcacctctaccccccattccaaggaccactcctcccctttctattcgccctcacacaatggcctcctcgctgatcaccacgagtctttagacaacgatgtcgccagagagatccagtacctagatgaagtgctggaggccaactgctgtgattcctctgtggatggaacttacaacggaatctcctccccagagcctggtgcagccatactggtaagcagcttaggctcgcctgcccactcagtcaccgaggcagaacccactgagaaagcatccggtaggcaggtgcctcctcacatcgagctcagtagaagcccctccgacagaatggctgaaggagaaagagccaatggacactccactgaccagccccaagacctgctggggaacagcctgcaggcacctgccagccccagttcctctaccagctcccactgctcctcccgagatggggagttcacactcaccacactgaagaaggaggccaagtttgagctgcgtgccttccacgaggacaagaagccctccaagctctttgaggaggacgagcgcgagaaggagcagttctgcgtccggaaagtgaggccctccgaggagatgatagagctggagaaagagcggagggagctcatccggagtcaggctgtgaagaagaatcctggcatcgccgccaagtggtggaatcctccccaggagaaaactattgaggagcagctggacgaggaacatctggagtcgcacagaaagtacaaggagcgcaaagagaaaagggcccagcaggagcagctacagttgcaacagcagcagcagcaacagctgcaacagcaacagctacaacaacaacagctgcaacagcaacagctgcaacaacagctgcaacagcagcagctgtccacgtcccagccctgcacagccccagctgctcacaaacacctagatggcattgaacacacaaaggaggatgtggtcactgagcagattgacttctcggctgcacgcaagcagttccagctgatggagaattccaggcagacactggccaagggccagagcacaccaaggctgttctctatcaagccttactacaaacctcttggatccatccattcggacaagccaccgaccatcttgagaccagctactgtcgggggaactctggaagacggcggcacacaggcagccaaggagcagaaagctccctgtgtatctgagagccagtctgcaggagccggtccagctaacgctgccactcagggaaaggaagggccatacagtgagccttcgaaacgcgggcccttatctaaactgtgggcagaggatggagagttcacaagtgcccgggccgtcctaactgtagtcaaagatgaagatcatgggattttggaccaattttcaagatcggtcaatgtatctttgactcaggaggagctggactcagggttagatgagttgtcagtgaggtcacaggataccactgtcctggagactctgtccaatgacttcagcatggacaacataagtgacagtggagcttctaacgagacacccagtgcccttcaggaaaactcgctggctgatttctctctgcctcagaccccccaaacagacaacccctccgagggccgagaaggggtctctaagtcattcagtgaccatggtttctattctccttcctccacattgggagattctccgtccgttgatgaccccttggaatatcaggctgggctcctggtgcagaatgccattcaacaagccatagccgagcaggtggataaggctgaggcgcacaccagcaaggaaggatcagaacagcaggagcctgaagcaacggtagaggaagctggaagccagacacctggctctgagaagccccagggcatgtttgcaccacctcaggtgtcctctcctgttcaagagaaaagggatatattaccaaagaacctccctgcggaggacagggcactcagggaaaaggggccctcccagccacccacggctgcgcagcccagcggtccagtcaacatggaagagaccaggcctgaaggagggtacttcagcaagtattcagaggcagctgagctgagaagcacagcctccctcctggcgactcaagagtctgatgtcatggttgggcccttcaaactgaggtcaaggaagcagcggactttgtccatgatcgaagaagagatccgggcagcccaggaaagggaggaggagctaaagcggcagagacaagtgaggcaaagcaccccaagccccagggccaagaacgccccatcgctgccttctaggaccacctgctacaagactgctccaggtgagtagcagctacatcctgcatccaggtgtctgggaaagtgactccgttcacggttccatgcggagcctccgctatgcttttggcaagaggagttcgacagcagaggtgttagggtgtcgtctgggtcatggttgctgttctcagtggatatgagggctccttgcctctcagtcagccttgtcttgatttatttattgtacaagcttcctcccttcacccctcggagggctgcatcttggccaagtgaggcacagaccttggcagagtggggctgttgtgctttctgtgtcttcagatcagtaactggaccttcaaaagctatagttaaattaaacccatcaaatttgggggatgtgttgtgttctactaacccctttcagggtgccggctttcttcctagccgggatggtcttaactcagggttgcaggctgcagatactctgtccattttcctttcagttgggtttgacttcctttatgtgatcacaaaaccagttacactcatgtgatgatagaccatctttatggttgggatcccttgagataactacccggtgcaatcatcgccatcttggattctaagtctgctctgtgatgttcgcaccatgagactgcctagcagtgccttcctcagatgttatcttagaatgtttccccaacctcagcctatacatgtgtctgctctggacatttccattcattcttgtccatttcgaaaagtgaagctactacaggcagaagggccatattgaatctccttctattgtctgggcagcccctttcttgaattgtgggtatagacggcaatgccgtgaatgccactgtggctaacagtgtgaccagaagcttttgtttcccgtgtggatatgatagcacctggggctctgttcatcttgtctcagagatgagctcctcagagtgggctcagaactgggccatgcattgtattgttcacaccgagataagtgcgggctttagaagaaagcattgtaggtagaacattggatatcatcctgaaacccaagtgtgggatcatgtgttttactgtagactcgtggggaagctgatccttcatcaaagataatttaagaagcattaccgtaaagggtaaccatcactgtttaacttggttcatttacatattaatcccttcatgttgacccttgacctccatcaaatctacaatggcacagactcattctttattattaacttttaagattcgagataatcgcaagcctaaagaaaagctctcgaggacagtgtgtttctattctagactgcttgagaatcactgggcaccgtgatgctctactgcctgagttttataacacacccctcacattgggtctttgggatgcttttgtgtgattacatctcacttttgctaggggaaagcacagccaaattgatgctgcgtcctcacagtgtctaagcaagtagcacgtggtattagctcgttctgggatagacagatcttagttttgaccattcaatatcaacttccgatcacttgattaaggagtgtttgaaaggcttctcacagagaagctacattttccttttgaaatgaatacatattttgtttagacacacctgactctggactctttatcccactccttatcagactggaagtctaggatttctttatatcaatatggtctcatggaatcccattacattcaataactagttttcattcgtcttgttatttttatcctcattttatttagtcatggtatgaaaatcccttccagatctcttttgtgtctttttgagaagcagttctttcagcatttccctctgctttgttattgcatggtgttctattttagctcgtacttatcagtcttatctccaaagagcaaagagcggttattctcttacagtggaatgggatgtatacatcaagatcagcatgtgcgtcaatgttggattgtccactaaggcaggcttaacgaacatatttggagattaagcatatctacatttatgtctatcttatctatgtttttctatctatctatctatctatctatctatctatctatctatctatctatctatctatgaaatcaagagttcatgcagagatcttttccaaaagttagtggcatgggagtggtgaaaggagagggagactgtgagtgtccatgtcatggtgtggacttggaggtcagcagacaccttttaggaatcagttctcaccttccatcttgttgagcaggctcttgtctctgcacctgtgctgtgtagcccaggctagccaatcttcagacttctctgtaattctcccatctctgcctccagtctctcactgtgggggtgctgggaatacagatgtgcaccaaccatctagcttttccctgaggttcttgggagtcaagctcagactgtcaggggtgcatggtaagcaattctactcagtcggggatcttttaattctgctttaatagacttattcacatttgtcataaaaatttcttccctggggagacaattttcaccccatctttataaactcccaaagtcaaaccaaagtatattttttccaaaggtcatcctaggggaccattgagcttattgaacttatttatagagcactggtaaaggattgcttacaggagtgtattgaccccaaagctttaagtctttacctagcttggatgatggcttccccgtagctgcataaatgtagcttcccccattggttaaccttccctagtctatgtgttctagagacccctgagacctggaggctgtgtgcagaattacatagattgtggctgggaggggcaagagagagtactgggaatctcgggtaagggtccagggaccctcccccatctgcgcttcctatgagggaacagacatgctggtgatggtcttatgtaagcaggtgcagcttgtctgatgcagatggcggcagttttgctcagaggccagtgttctaggaaacgctcctgccctttccatatttgcagcttactccttgatatcctcagtgtggtatttgtttggcccttctacccacaccatttaaccaagctcctattttcttcattaaattatgaaccagtattcatttctagatgatcgcctccccttcctgcattccatttacctctgtcactgctgtcccttgtccaccttgctctgactccacagtcctccataggccactgcgttctcctcccaggccctctgctggcatcatggtttttagccccagctaatgactcttggaccgagctgttcaggaaggaaagggaagggtgggctgtggaggaggaagagctcggagacttcctcgatgggtttttaatgccttcgggtcacaggccagagccagctaagtgcttaaggcaagaaaactatcagggaaagttttctccagtggttagccacaagaacttggctttccccaacaagtcttactggtccagttctccttggaattgttttggctggagctggtttggcacggagatggaggttaagcatcctgtcctggagaaaagtctttgtaccatgtgattgcagccccagcttgggagctactgcacaggccagtgatggtgctccccagaagttggaagcctaactgatggagaaacattctgtgagcttcttggctcctgcttgcatggaagccatggtttgcctgcgtcaactgcattacttcattgtggaaccttctggaagtccatgtagctgatgggcaaattggactatttgattcactatgacaaaatacttggggctgagtcatttataaacaatagaaattattgaaatttctcggagttgtagagattgggatgtccaagattaaggtcccagcaaggacccatatcctagattatagagggaaccccttcttgatgtactcatgtggtgggaaggcaactaaatagatccctgtgtcttctttcataatgacattaatactatccatgttgcctctgaccccatggtctgatcaccttcccaaagtcccccctaatagcatacaatcgtaactacatttcaatgtatctgtgaggttcccggaacaccagaccatagcagggggtatttcgaattctccactcagtctcttaatggaatccgtccccatattgctccagctttacttctgccatgtaaacaattgttaggtgtaaggagatgctgctgcctagtctggttcccccagctggtgtgcctgtcaggcttcctgcctcccctacaaggattgaatttactgtacaagatgcccgagtgccagggttggctcactgacctccagttacccggtcccagcgaccttagaacctaacctcccactttaggaatgtgaatctccctccctgtgtcttagtcacactgtgctcgttttcatccttgtaagaagacattaactgcttgatgcttctctaatcacagcattcaggaggcaagaggcaggcagatccagttcgagaccagcctggttcacatagtgagtttcaggatagccaaggctatgctatgtgtagagagatattgtcttgaaaaaccaaaccaaaccaaaccaaaccaaaccaaaccaaaccaaatcaccaccaccaccccccccaaaaaaaaagaagaaagaaagaaagaaagaaagaaagaaagaaagaaagaaagaaagagaaataatctgagtttatgttctgtcctggttttcttattacgttgaacacagtcatagtcatagtgtgatgtggacagactccactccttcgtatttacattcagaatatgtagaaaagatacaatgtggggtgtcctaggatcgcagcatggagagaggaaccaaaattaaagtgaatacaaattcaggcttctttctttccgagcctggaaacctctggagtgttgcttggccagccggcctcttacttagtttgcgatcccggaggaagtttgacacattactccggcaatttgtgggttggaacttctggctccaacatgggtctcatgaatgaaatattgctagggtttcctctgcaccgcttcatgtttcctgccagaagtgactcagtaggttttgtgtgattcagatcagattaatgatattaggtgatgaaagataatgtctgagctccttatctagtagaaatcatgctggccacatgctggatcctaaacagtaagcagacaaagtctgctgagagcgagggtgctgtgacctaaaaacccccattccctggatattgaaaagacatttggatggtgttcctcactccctccttttacaagagtggggtgaaggcccataattcctgcctggggggctgagggagggggtgttcgaagcccgtctaggctagagttagctgggagccagtttaggcaacttgacaagattctttctcaaaataaaataagagggaaagagctggaagagttcaacagtagagcactagcctagcatgcgcaagtgggttcaatccctagtgtttcaaaaaggagagaaagaaagggggaaaagaagtcccttgacagatttatgagccgaattaatgggaaacacatatattagggtaaaattcccttgagagaatggggttggggggttacccaaacatccttttaaactcacgtgagaattacgaacttaattaagagcttcccagtctttgcatattgtggacaccagcagacacttctcagtgtgtgtatctattgttaggaactcgagtttcacttccaggccaagtccagctggctgtgtgaagtagcataagctttgtgtggaaggtcccacaggtggttggtgtccaccgctgtttccggaacattctttgctgatgtaaatctaagccatgctagctgaaacttaacacaagaccttaaagctgtgtatagtactagctacttcatgggttcccatttgtcacctactccttccaaaagcccttcaaaataatggtcaaaatgataggaacacatgaggctatgtgcacagatgcctacacacaaacatgcacatacatgagtgcgtacacacacacacaaacttttttttttgagacaaagttttactctatagcccaggcatcactggatctacctacctgtctatctatctatctatctatctatctatctatctatctatctacctatcatctatctatctctatctatccctccatttatccattcatctatccatgtatctatgtagcttttgcaaaggaaaaccatattgccattctcctgagaattagactcccagctatcctctgtgacaagcctgtgtatggtaatgactttcagaaaaagcaaagcatctcacttcaattcatatcatatcatatcatatcatatcatatcatatcaattctctctctctctctctctctctccctctctctctctctctctctctctctctctctctgtgtgtgtgtgtgtgtgtgtgtgtgtgtgtctgtgtgtgtgtgtgtgtttctgggggaaggggggctgcagaagtgtagcaaagctaccctggtaatctgcatggctccttgatgttttaatgcctcagttacaaataagctaaattgctggtacttgccaaatatttaggctaagggggtgtactgggtagttttgtgtcaacttgacacagctggagttatcacagagaaaggagcttcagttaaggaaatgcctccatgagatccaactgtaaggcattttctcaattagtgatcaagggaggaggtccccttgtggatgggaccatctctgggctggtagtcttgggttctgtaagagagcaggctgagcaagccaggggaggcaagccagtaaagaccatccctcaatggcctctgtatcagctcctgcaccttgccctgcttgagatgcagtccagacttcctttggtgatgaacagcagagtggaagtgtaagctgaataaaccctttcctccccaatttgcttcttggtcatgtaggaatagaaaccctgactaagacaaattggtaccagcagagtggggtattcctgtgacaacctgaccatgttttggggaggactgtggaaggacttggaactttgggctagaagatccatttggtgttaagagctctgtcacctgttgtgtaggagcttggaagataatgttgagaacagtgcagaagatggaggcctggcttgtgaaatttcagagggaaaattaaagactcttttaagggccagtgctattttggagtttgattattctgtggttctggttagctgggctggagaatcagctgtgattaacaagataccagaactactaaagcaaaacctatgcagtactgggactattgatactggttagctggagctaagaaaattagcggtgattaagaagagaccagcatcgttgaggtgacatcttctgggaagtgttttctgaaagcacaaagaggctgtgttccagagatagccaaggttgtactcttgctgcagcaggacttggtaatatgtaagggtcacccaggtggtactggttttgaaggcatgaaggggtcatgcagagcagctgaggctcagcactgtgagaggccatggaaggccattggtgaaggtgcagcctcagttgcaattgatggcccaggactacaggggtcatgcagtgttttagagttgccagtaccatgagatgaccaccaagagcagcagcagtggaggagcccagaagatcgtgagttggatcccagacactggatggttggaggttggttttagcttttgattgtgactgtgccctggtatttttcccctcttgaaggaagtttttttagtgaagcccacaattaagagacttttaattgtaaagactttggattttaagagagattgaaattttaagaatttgtaaagactgtgggacttttaaagttatttagatcttggggatgaataagaaactaagggttgaggcttactagtgatgtgtttgtgtgtcaagttgacaaggggtcaattgtactggctggttttgtgtcaacttgacacagctggagttattacagagaaaggagcttcagttgaggaaatgcctgcatgagatccaactgcaaggcattttctcaattagtgatcaagggggaaaggtctcttgtgggtgggaccatccctgggctggtagtcttgggttctgtaagagagcaggctgagcaagccaggtgaggcaagccagtgagtaacatccctccatggcttctgcatctgctcctgcttcctgacctgcttgagttccagtcctgacttcctttggtgatgaacagcagtatggaagtgtaagctgaataaaccctttcctccccaatttgcttcttggtcatgcaggattagaaaccctgactacgacagggggtaagttagctcttcaggctggttgtcttgttggttttctctgccttttcattttccaggaggaagcttagccattcgtttcagagttgcattcattccctgaaatctacaaatgaactaggctaatctgaatatgagcagggattagtaatcactctgttgactgagtgaagtatctttggtgtcatgagatcacagtcagtgacacttgatcatcatggagcatcacttgccttctatctctgttcctttgagctgtcctgtatttcattgatctgaagccagcaaatgcctttctttgtaaagtacccaccatttcaataggaaaataagaaaagcctgcatgaatgcattgttctttttggacatcactctcaaaaggttttgcaagggaaaccatcatgcgcaaacctgccattctctctcctgaggattagactccaggtgatcctccgtgacaagcctgtgtgtggtcatgactttcagataacatcattttagaaaaagcaaaccatctcgcttcagttcaattccctcccttggaagccaggtctaccatattcaaattgtgctggcttttatgttgcctcctggttgtgctcacacctgtgggaggcaccatgtgaggtcctcattactaacatgcatagctattccatgctctgggaataactttcccaggaatcagactcagccacgtacaaggaaagtctacagttttaatcttaacaaagaggaagtgaatcaaaaggcctaattcttgcaggatccctgttgagaaatgtgagctaatcaaagccagcttgggagtaggatgtcccaactcgtgactgctggagcctggacaggatgtgactttgactcttaagcactaggctgtgtacttcccaaggagattggcatttgatctttgtgaataagcctctactgagggcttggaaggggactggatgagggagggagaccaggggagggagcagggaatgagctagtcagactatgagagcctcagagaatccctctgtagtttatataatgctctttggcttcttgtagccttgaagataaatatggacttgtatgcatctcacagcaagtctctttgacagtaccaacctcattcttatttcccattatccaaccataaattcatatataaaagagtcagtcaaggaagacaggtgcttaagagagccagtaacttctccggaaccacattccaaggtcagctccttgctcgctgtataaatagttcatttcacctctataaacctgtttcctcagcagtaaaaatgggaataaaacagtaataacaatatcgttggtccttttgagagtctcatatagcccaggctggcttcgaactcctggttctcctgttttcacctctcaagtgccagaattacaaaggtgttcattccatcacactcaccttggaaataattatgttaaatacaattagtccatgtagagataaaggggtcgtctgctccctttaatcttcactcactcgcctggtcctcaaggtcctgccccttttccatattcccagtcatcatcacacactcaagaagctaagaatgctgacacaactgcaggatggtgagaagggcggtagactttccctttgagctagccgaggctgtctcccacgaagagagcaaagacaaggaaggagtctgaatctgcattttctatctgtgtgccagaaatagttaaaactatttccagtccatgcttggttacactgtgggattccccttgggcaggctgtgattacagggggcagagaaaagaatcttcaattcctcccactcacagagtgcagagaaggctgtgtgtactcggacagagccctgtcattcctgacaactcgagtcttccttctgcggggtcatccttggctcctagtaaccctcggatgcaggctccggaggtttagacagttttctacgggcatgtaaaccaaaagtttgaatctgggtgattattatgctctgtgtctgtggagtcataactcaaagattctttgtttctaacatttctcaggagagagagagaaaaaaaaaagctatcacccacttgaattaaaaaaaaaaaaaccaaaccgaactgaacaaaaacacccaccagatgacgtgccttggcccgctcttctgtcaatagcctcttttcttcacacagcttgggggtgagacggccagcatctactctcgtccccagagagcagagcccagagctgcagtttcccacttcctttctttggcctgaatgagagcaacctgctcagccccaccctcaaggacttgggcttgtgcagttcctgctgtgaccccgccccccccaccggagcccaccttcctcctttacccccctccccgccccccacgagcccgccttcctcctttgcctcttcctttgaaggtcccaggtgggagaatgagatgctgggaccctttagatcataatacctagtcaggaatgagaaacacccttgagagtggactaagtccgaggaactgacagatgtggttgcttcagtgtaagttggagctggggtgatgaggtgctgatgctgggtctaccttgtgggccttactggaaggagctaaaaacctaggaaggaggagctctgttttgcgattattagagagtcagtagttcaaggccagcctgggctacataagaatctaaaaaaaataaaaaataaaaaacgatctggtttattttatattttaaaattattttgtgctgaggcagatgcacctggggaggctgaggcaggaggagcaccatgaatggatgaaagaaaaatgaggacatgactgctccgaggtatggttgaggagaggggttttactgtagatctgagggagagaacagccagagacaagagtccagactgaatgtggtcatcagaccaaactgggcttgtggggtgtgtgtgtgtgtgtgtgtggggggggggggggttagtgagaggaatagaagagagggcaagcagaccaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttcctattggccttcatcctgtggtggaggtactcgagtctaggctgtctgaggatggatggagctcagggattgtacttgcttaagcaagcaactgctctgcatacccagctctctctctttctttctctctcttttttttccttttggttaaattctcacttgattagtctaattagttcaggctggccttgaactcgaggtcttcctgcttcactataatataatataatataatataatataatataatagtttaccactacacccaacttactttttttttcattgattttaatttctattgttttaacatatataaaaaaataaatgtaataagccaaatacatggacaaaaatacaagaatcatatgatcatctcaatggaaggaaaaagaaaagaaacgaaacggaaaagtctttgaaaagatttaaaatgcatttttaaaaaagatatattttatgtatgtgagtacactgttgctctcttcagacacaccagaagaagagcatcagatcccattgcagatggttgtgagctaccatgtggttgctgggaattgaactcaagacctctggaagaacaagagcagtaagtgctcttaaccattgagccatctttccagcccctcaacaagcattcttaataaaagccctagaacaagtagaactgtgtaggaagcatattcaagcataaaaaaggttatgaatgacaaactcgtgggcaatatcaacctaaatgaatagaaccattaataagccccataaaaatcaggaatagaagaggactgcccactgtccctactactcatccataatgcgattgaaacattagctggagcaataaggcaagagaagggatacaaatgggaagtattaagtcaaattattttccattgaagattatattatcttatacccaatgttcccaaaatttgactagaaaaaattgtagacattctcaataatttcagcaaagtgttatgatacataattgacttgcaaaatttaccagtcaatatatacgagtatcaagcatgctgagaaagagatcatgggagctggagagagggctcagctcagagatggttaagagcactgactgctcttccgaaggtcctgagttcaattcccagcaaccacatggtgggtcacaaccatctataatgagatctggcgcccacttctggagtgtccgaaggcagctacagtgtacttacatataataaataaataaatcttaaaaagaaaacgaaagaaagaaagaaagaaagagagaggagagagagagagagagagagagagagagagagagagagagagagagagagagagaaagaaagaaggaaagagatcatggacacgctcctcttcctagtttctcaaataaaatatttagaatacatataacaaaagaggtaaaaaacctctacaatgaaaactttaaatgtgtaaagaaagagattaagaaacatactagaagccggggtgtggcggctcacgcctttaatcccagcactcgggaggcagaggcaggcggatttctgagttcgaggccagcctgttacaaagtgagttccaggacagccagggctatacagagaaaccctgtctcgaacaacaacaacaaaaacaaaacaaaaaaaaaaaaacaaaacaaacaagaaacatactagaatttgaagaccacctaagtgtatagcttggtagaattaacattgtgaaaaatgactttcccaccaaaacaatttactgattcaatgaagtcacaatcaacatcctcatctcattcttcacataaatagaaagaaaatcctcaattttatgtggaaccacaagagacccagaatagccaactggtcctagataagtgttggtttctatgcattctgcttgttttaagtgctaagtgcatctgtctaagaccccaacttttatacatctgtttctattgagccaattttgttcgatattagaatggctactccagcttgtttcttgggatcatttgattggaaaattgtttttcaaccttttttactctgaggtagtgtctgtctgtgtctctgaggaacatttcctgtatgcagcaaaatgctgggtccttattacatatccagtctgttagtctatgtctttctactgggagttgagtccattgatgttaagagatattaaagaaaagtgattgttgctccctattatttttgttgttagaggtggaagtgtgcttgtgtggctatcttattttgggtttgctgaaagattactttcttgctttttctagggtgtagtttccctcctacatgtgcttgaagtttccatctattatcctttgtagggctggatttgtagaaagatattgtgtacatttggttttgttatggaatatcttgttttctatggtaattgagagttttgctgggtaaagtagcctgggctggcatttgtgttctcttagggtctgtttgatgtctgcccaggatcttctggcttttatagtctctggtgagaagtctggtgtaattctgatagatctgcctttatgtggtacttgacctttttcccttactgcttttaatattctttctttgttttgtgcatttggtgttttgattattatgtgataggaggaatttcttttctgttctaatctatttggcgttctgtgggcttcttgtatattcatgggcatctccttctttaggttagggaagttttcttctataattttgttgaagatatttactggccctttaagttgggactcttcactctattctatacctattatccttaggtttggtcttctcattgtgtcctgaatttcctggatgttttgggttaggatcctttttttttttttttttaatttgcattttctttgattgtgtgtcaatgttttctatggtatcttctgcacctgagattctctcttttatctcttgtattctgttggtgatgcttgcatctatgactcatgatctctttcctaggttttctaactccagggctgtctccctttatgatttctttattgtttctgtttccaattttagatcttggatggttttgttcatttcctttgcttgtttgattgtgttttcttgtaattctttaagggatttgtgtgtttcctctttaagggctcctagctgtttgcctgtgttctcctgtatttttaaagggagttatttatgtccttcttaaagtcctgtattatcatcatgagaagtgattttagatccaaaatcttgtttttctggtgtgatggtatatccaggacttgctatgttaagagaattggggtctgatgatgccaagtaaccttggtttctgttgcttatattcttacacttacctcctgccatcttgttctcgatagtgctacctgccctcactatatctgactggggcctgtccttcctgtgatcctggttgtgtcagaactcctcagagtccagctgtctctgtgatcctctgggatcctgagatcctgggtgtaccagagctcctgggagtaaagctacctctgggacctagagatcctggtgtgaccaagcccctgggctcctgggctcctgggctcctgggctcctgggctcctgggctcctgggctcttgggctcttggagttagagcatctgggagtggagcttcctatgagtgttgtgggacttgctgcagagttcgggcccaaggtctgctcagggctctgtgccactggtcaggccaacttaaacacttttaaatcaactttggggaactgctttttctcatttccccttaaatattcctctaaattccagaggttaaaacatgattgatagtggctaaataatactctatcactaaatgtgacaagtctaactcttctcccataggcagagaagtcggtttaaatatgaaaaagaaaatgaggaaattctggtatatagctttgtgcctttgtttagatattggctgaatgtgtgtcatgtcttttcttgggagttggtcaggcagagtatacattagacaattgattttttgaaccattttccttgtgatattaatgggaattccatgaaacagacttctcctgttaaatgaatttgagggatctacaaccccactcatgtattcgaggctcacaaccacactgaaaccaggagtcttctcctgagggttctcccacacaccagcacacctcttaaattactgactttatttatttatttatttgcacatatatgtatatactgtcttaggttactattgctataaagagacaccatcaccaaaacaactcttttttttttttgaacaaaagcacttcaaacacatttttttccattttttattaggtatttagctcatttacatttccaatgctataccaaaagtcccccatatccacccaaccccactcccctgcccacccactccccctttatggccctggtgttcccctgtactggggcatataaagtttgcaagtccaatgggcctctctttccagtgatggccgactaggccatcttttgatatatatgcagctagagtcaagagctccggggtactggttagttcataatgttgttccacctatagggttgcagatccctttagctccttggctactttctctagctcctccattgggagccctatgatccatccattagctgactgtgagcatccacttctgtgtttgctaggccccggcatagtctcacaagagacagctacatctgggtcctttcaataaaatcttgctagtgtatgcaatggtgtcagcgtttggatgctgattatggggtggatccctggatatggcagtctctacatggtccatcctttcatctcagctccaaactttgtctctgtaatttcttccatgggtgttttgttcccaaatctaaggaggggcatagtgtccacacttcagtcttcattcttcttgagtttcatgtgtttagcaaattatatcttatatcttgggtatcctaggtttggggctaatatccacttatcagtgagtacatattgtgtgagtttctttgtgaatgtgttacctcactcaggatgataccctccaggtccatccatttggctaggaatttcataaattcattctttttaatagctgagtagtactccattgtgtagatgtaccacattttctgtatccattcctctgttgaggggcatctaggttctttccagcttctggctattataaataaggctgccatgaacatagtggagcatgtgtccttcttaccagttggggcatcttctggatatatgcccaggagaggtattgctggatcctccggtagtactatgtccagttttctgaggaaccgccagactgatttccagagtggttgtacaagcctgcactcccaccaacaatggaggagtgttcctttttctccacatccacgccagcatctgctgtcacctgaatttttgatcttaggcattctgactggtgtgaggtggaatctcagggttgttttgatttgcatttccctgatgattaaggatgttgaacattttttcaggtgcttctctgccattcggtattcctcaggtgagaattctttgttcagttctgagccccattttttaatggggttatttgattttctgaagtccaccttcttgagttctttatatatgttggatattagtcccctatctgatttaggataggtaaagatcctttcccaatctgttggtggtctttttgtcttattgacggtgtcttttgccttgcagaaactttggagtttcattaggtcccatttgtcaattctcgatcttacagcacaagccattgctgttctgttcaggaatttttcccctgtgcccatatcttcaaggcttttccccactttctcctctataagtttcagtgtctctggttttatgtgaagttccttgatccacttagatttgaccttagtacaaggagataagtatggatcgattcgcattcttctacacgataacaaccagttgtgccagcaccaattgttgaaaatgctgtctttcttccactggatggttttagctcccttgtcgaagatcaagtgaccataggtgtgtgggttcatttctgggtcttcaattctattccattggtctacttgtctgtctctataccagtaccatgcagtttttatcacaattgctctgtagtaaagctttaggtctggcatggtgattccgccagaagttcttttatccttgagaagactttgtgctatcctaggttttttgttattccagacaaatttgcaaattgctccttccaattcgttgaagaattgagttggaattttgatggggattgcattgaatctgtagattgcttttggcaagatagccatttttacaatgttgatcctgccaatccatgagcatgggagatctttccatcttctgagatcttccttaatttctttcttcagagatttgaagtttttatcatacagatctttcacttccttagttagagtcacgccaagatattttatattatttgtgactattgagaagggtgttgtttccctaatttctttctcagcctgtttattctttgtatagagaaaggccattgacttgtttgagtttattttatatccagctacttcaccgaagctgtttatcaggtttaggagttctctggtagaatttttagggtcacttatatatactatcatatcatctgcaaaaagtgatattttgacttcctcttttccaatttgtatccccttgatctccttttgttgtcgaattgctctggctaatacttcaagtactatgttgaaaaggtagggagagagtgggcagccttgtctagtccctgattttagtgggattgcttccagcttctctccatttactttgatgttggctactggtttgctgtagattgcttttatcatgtttaggtatgggccttgaattcctgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgatagaactctgcactaaacccatctggtcctgggctttttttggttgggagactattaataactgcttctatttctttaggtgatatgggactgtttagatgatcaacttgatcctgattcaactttggtacctggtatctgtccagaaatttgtccatttcgtccaggttttccagttttgttgagtgtagccttttgtagaaggatctgatggtgttttggatttcttcaggatctgttgttatgtctcccttttcatttctgattttgttaattaggattttgtccctgtgccctttagtgagtctagctaagggtttatctatcttgttgattttctcaaagaaccaactcctcatttggttaattctttgaatagttcttcttgtttccacttggttgatttcacccctgagtttgattatttcctgctgtctactcctcttgggtgaatttgcttcctttttttctagggcttttagatgtgttgtcaagctgctagtatgtgctgtctcctgtttcttcttggaggcactcagagctgagtttccctcttagaaatgctttcattgtgtcccataggtttgggtacgttgtggcttcattttcattaaactctaaaaagtctttaatttctttctttattccttccttgaccaaggtatcattgagaagagtgttattcagtttccacgtgaatgttggctttccattatttatgttgttattgaagatcagtcttaggccatggtggtctgataggatacatgggacaatttctatatttttgtatctattgaggcctgttttgtgaccaattatatggtcaattttggagaaggtcccgtgaggtgctgagaagaaggtatatccttttgttttaggataaaatgttctgtagatatctgtcaggtccatttgtttcataacttctgttagtttcactgtgtccctgtttagtttctgtttccacgatctgtcctttgaagaaagtggtgtgttgaagtctcccactattattgtgtgaggtgcaatgtatgctttgagctttactaaagtgtctctaatgaatgtggctgcccttgcatttggtgtgtagatattcagaattgagagttcctcttggaggattttacctttgatgagtatgaagtgtccctccttgtcttttttgataactttgggttggaagtcgattttatccgatattaaaatggctactccagcttgtttcttcagtccatttgcttggaaaattgttttccagcctttcactctgaggtagtgtctgtctttttccctgagatgggtttcctgtaagcagcagaatgttgggtcctgtttgtgtagccagtctgtaaaaatatggaatgcttcacgaatttgcgtgtcatccttgcacaggggccatgctaatcttctctgtatcgttccaattttagtatatgtgctgccgaagcgagcaccaaaacattttatttttaccaaaaacaaacaaaagaacagtaatcaaaaaccatgaacaagttataataaaaaggaaaattttaattttaaaaagtctctgtgtgaaaaagtaaagataaaaattttaaattaataatatagctaaatttatttcttaaaaaataagcatagggccagcaagatgactcagctggtaaaatcgttccacacccatgtagtcacacatgcacgcacacacaaaagtaaagggtttctttctttcttttttcttcttcacattttggtacatcttatttgttagggaccatcacagacataaaaagtaatgttgtgggctagcaagatggctcagtgggtaagagcactgactgctcttctgaaggtcctgagttcaaatcccagcaaccacatcatggctacaaccacctgtaatgagatctgacaccctcttctggtgtgtgtgaagacagcaatagtgcacttatttataataataaataaatctttcaaaaaaaaaagtaattttgctacagtgagctcccagcttcccggtcttaagtcctggttcaacagctgggtgagttttagaatgcttcatctgtccctttcttcccctcaaagcaaatctcccaaggaacatttaagatgtgtcgctttaaaacacggacattttctcacctaacccggttccccactgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgtagccttggctgtcctggaactcactttggagaccaggctggccccgaactcagagatccacctgcctctgcctcccaagtgctgggattaaaggtgtgcgccaccacgcccagccacatttcattcttataatgaccccatgaactgctgtgttggggaaataccacacgtttcccataatcctatgagaagtctttgactctgaactcaggaccctgaggaaggagtcaggtgtggaacagttcccattcttcagctttccagtgacttgtgtgattcctaagatggggcatggagttctaagacatgacttgtaccatactgtagggaggatgcttggtggtcttaaggcccaggatagagagctgaccaagttagcaagtttgtagaacagaaccagtttctcctttgtctctgaggcctgcgaccttccttccttggggttgaatatccaaagtctcttctgccaccaatcacctctttggaggctcctcctccagcccagctaagacagccttgctttctgcgacctctactggccgtcgctggcattactttctgttctaggttttccataggttttcttctgttaggcaggcattgtctttttctaatggcctacttgcttctctatgggaactttctcattccatcatattggaattggccaaaattccgaactaactctgactattgttctcagatgtgatgctggctggaatcagcattgggctttcatgatccgagccataattatccactctgtctagccatcatgcatgtaagaattaaatgtcatgagggtcgtgaaggacttgccgtaagaacaaccttaggatcattccagagcattgagtcctgcagtctgaatcccagagtttgtttgtgtatgtttgtgttttttcacttgcgtttgactacagaatcactctgtaatccaggctggtatggaatttattgtgtagcacaggctgctttgaactcatgatgatgctcctgcctctgacttccaagtgttgggaggggacctctttcctgggattctctggtggtgggggagtgttgatcccagtgttttctaaagtggttgtatgcattctataataaacatattggcttattaagtacatactgactcttaccttgtcccttattctgctgggatccaggagtcaggacagatagaaaccccactgtgacaggttcctcactgaaatgagtgaaaaggatttatagacgattggaatgatctgtgtcttcctgtgattttttacagtttacagatgacagtcacttcagtatccagagatgataaacagtatagtaagaaaacggctttcacagaccttaaaataaagtcttatttggcaaagacatcagtgtgaaaaccagaagctaagtgtagacagtttactctgcttcctagacatttactgttggaagaagggttgatgggagatggtctggacatttgagagggtggccagcaacagtcaccaacctgacagtgtgtgaaacaacgtttctggctttccagacttgcacagatcgtatgtagaatgcccaagggattacacagtctcaccccacggttgtattatttcttcagattccggtcaaatagcagctacagtcattggatgctttctgttctggatattaacctttaccagtgttaacttagtctttatagcaactatgtaatattaagagtaaggaactggcccagagctatttgactgatggctggtaagtagtgggttcaaactccagcatactggctctagactcgagatctagagcatgcatgcttaccactctcatgtactgtttctcaaagtttcatttaaaagaccattgtgagtctggggttgtggcccagttggtagaggcttgcctggcatacatgaggcccagagtttggtccccagtacaacctaaagttagatatagtggcatatgcctatatttccagcattcaaggagagtataagctcaagattatctttagctacatactgagttcaaggccagcataggctacagaagactatttcaaacttcccacctcctcttcaactctgctctctctgtgtagatctggctgtcctggaactcacagaaatctgtctacctctgtcgctgactcccaagtgctaggattaaagatgtataagaaaactgttcactattgctccatctcagagatgcaattgagtctctgtagcactaaaatccacccacgcatgccttgatgatctagaagtgaaggctggggatttaccacctgtgagaagtgggtctctaggagctaagggctctgttggtagagcgcttgcttggattcagtcaccagcaaggcataaagcaggcatcgtggctgagcttgtaaccctagcgcctgggaggaagaagcagaagtgagttttgaagtcagtctgggctatgtgagttcaaggccatccttcacatcgtgagatactgtcttaagaaacatgaatctccaaggtgccaactcctcttgacagcctactgttgtgatctgtgaatgaacacgtgtccctgtatatttggaaccagtgtctatctgcctggcatatgttcgaaggatgctgagtatgcctagaggccccacaccattgctcaaatctccccacctggcaactcttgaggggcgatctcaagagctcaatcttacctttccacctctattgtcactcattccagaaagtctaggaccttagcaaaaggtctttgggactctagcaggtaagataaatgaaagaagttagctaattaagcctggtgtctcctgagaagctggagtcttattctcattcaaagacttctctataccagggcaggtcaactagtaattgattacccctgatgcagggggcaaaggatgctgggagtgctggggacaaactttggctcaagtggcctttgtagattctcagcttccttacctgtgagaagttggtttctacagtgctacaacctctgacagctttatgatactatctgagagaattcgtctccacaatcttggagctaatgtctgtctgtctgtctgtctttctgcctgcctgcctgacatgttgcaaagtgcctgccattcccatttgagtgaactttagctctggtgtcactgtggtgtgtgttgaacaggtttgcacttcgttctcttaatgaaaccctttgacttaaccatgactccgctctgctcttgagtttgcaagtgtgtgcgagtgcccgagagacagttttttttttttcttccttctacaagcagtgcctgctgagcagatgagcttagaaagggtgttctcttcgtgttgtttcagggaaaatagagaaagtcaaacctcctccatcccccacaactgaaggtcccagcttacagcctgacttagcccctgaagaggctgccggaacccagcggcccaagaacctgatgcagaccctcatggaagactatgagacccacaaatataaaaggcgcgagagaatggatgatagtagtgtaagtttttcctcctttcctttctcttttctgaaggtgaccttgagtgtggcatgcctgtatcttggatgtgtgtgcaatttatgtgcttctcttgcttgcctcatgattctgaaacctattttcaaatgagtggtttaatgtgcctcgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgggcgaggctggtccatgagtatggtggggtggaggaagatgatgtgcctgggcaatacatcgaagaaggatgcagtctctctggatgtgctctcaggcttcaaaagctgcattgtgatctatcctcgtatatgtcgcacactgctcaagagactaggtctgtttggggttctttgtgtgtgtagttggacaggaaagagacattttaaatgactgctaaaaaccacacaactacccctctcccttcaaccttcccaactctgtacatgttggatgtgtgccctatgaaaggaagtcatctgcactgtggtttccttgtccagtaagagatttaagaggtctttctgaagggttccccacaagcctaggaggggcagccccaggttatgtataaacaccctagagtctcaatcttatatctttcaccaaagtactcctcccacccccggaaacccccccctcctccattatactgaggtcacaagtagcttggattgataaaccacctagtgtctacctgttgacctgtgtgtttatgaacaacatcccctttcactcttccaagtttggatgagctatgcagttaccctcaacttgaatgctctgaggttcacagtaggaagtccctgccaactcaatgactttcatctcctggctggataatcccaagttagagagtttccgggatgaatgccagatgctgaaggccccttttcagctagagggataaagaagagatacacacacacacacacacacacacacacacacacacacacacacccctcttcttaatcacgaaggaatatctctgctgtgaggccaagaggctcctctgtggatggagccctggcttaggtagcagctgcagacagttctaccgcatttcactggacaggtgccagcagcttactgtctactcaaccatgttagcagcccctttgggtgtagagtccttctttaggtgtttttagttgccgactgaagtgcagtcttagaagcatatggtttcttccctccacctgattcaacagtgtacagcagcagctttgctgaccatgagctgaagagccctgggccattcagtcatgacccacgtaaacgctttctcagtgcattctgtgttgattgtgtgtgcttttttttgcactggagtgctgatgttaagtggaggaaagtgatccccaggcctggtgcacaggcctgtaaccccagacattggaaatgggaagtaggaagataacatggtcagggtctgcctgggacatagtggaaagaggtacttatgtcacaggcagaacactagaccccccacccgcacccctttctggtaaactctgatactcaggaacccacatcaggtgccaatggggcccagttttctccaattgctaatggcttcctgtctctatctcacccaagtaaaggaacatgttggctaaggcagaaacctacgagtgaatcaatttatttttatttttatttgagggctgggtgttttgagcttttttcctcgaatcaccctagaacaaaatctgtcaattgttgaaaagttttagggataggacaaattccaatccccatatccctacttgtgccttttaatgaagactcaaatctcaaaaacacatactcaaattgcttcttgaaaaattatatgggtgtcagcctgaattgatttccaagtcacctgctagcctgtctctcagccctttcaatgtagggcacctttctacgcctctgtatagagaaaagcaagcttcatttccccaagttggtccctagccctgtctccattttcccggtttctggaaaggatgggtggcttggtagaggttatggagttggccttcctgtccctaaaagctagaggtgattgtctttagggccatataattctgtcctcctgagccattcaaacacatgtttttagggtgacacatggcctcttggatttctgcctccttaagtgcctcacgtggttcatgctgtcaccttcatttgtcaaatgactcagtgacaaaagaacagaacaaaaactcacttttcaaaaggttcccctgcctccctgcttagaacttgggcaaactgctctctgtcctctttactgatcttcacccacctggaccagctaccttgtcctgtgttatctctggtgagtgtctctaggaactaacagaacactccatttcctaggtacccacactagtcctaaataataatcccaaaagattatccaaggaccgtcccaagcttggaatctcatctagacccacaggttcctctttcactgacagtgccatccttaggtttgttttagagaaactaccccgaaaacctggcccttcctcccttcctccttccccattccctccctccctttcccttcatgtcccccctcttcattctactcttggggtcttactgtaataatgcaatggggtacaggactgtttaaggttcagagaaaccctcaggaaaagaaaaggacatttggttatagaatccatcaaatccagaatggccatctaggtcctcgctggtgggcagctggttagacaatggggaagacgaaatcctgttaattcaacagaaaaatgcaaacaagaccttgaattaacaaacctcggcttatctgatatttttattaatgagtattagagtatctacttgcctcaagagatacaggcgtttaaataaacaaatatcagatgaatcaatacttgagaggttgtataatgatcctccccctccccccaagcctcttccctcttactcacttctggcatggtgccagagcccagccgctgggggcgggggagtctgtgagtgtgcctctgccgtgtactaaccctggtcttttccctctctgccagtacacctctaagttactgtcttgcaaggtgacttccgaggtacttttcaaacttgtctgtctgcgtcctgatgcatgcttgatcttggtgcacgcggttgtggtttgctgtctcatgctgtgttcaataagaatgtcaagaaaaagcctcctctccatgtgtgttttctgcctgacctttctgaattggggaactgacttaaatattggtgtccagatgataatgaacaccgctgtgctgtgctgtgctgtgctgtgctgtgctgtgctgggacgtggggttggagaagaccttggtcacccaagggtctggaagatgttgaacttgagggcaactattgacagactgtgtggattcttgtagtttcttcaggcacaggtagcaaatgagttctagtctggttagcaagcagtgccacccgtacaggccaatcttgtgatttttgactagtcctttattaaccttaccacaattcccagagagctctgcactatggactgaggacaacttatttcaaaggcaaaccatcccagtccctcttccctcctccctccctccagtcttaggacctgtatttctgttctggaagctcagctaagcagcggtctttccccaaacctcctctttccccatacaagttccattaacatagatttcacaaatatatgtgctctgagaatgcaatacttgtgtggctggagagatggctccgcagttaaaaattcttcatgttcctgccaaggactaggggagtttgattcctggcaccaaaaacatctggtgtgtcacaatcacctgtaacattagctccaaaggttctgatggcctcttctggcctcggtaggagtacctaggtagataggtactctcacacacccacacacatggattggatccagggcatatacatatatatttgaaaaaaaattttttttaaatgtaaagccaagcatggtgtcacatgattataatcccagtgcttaaaagacacaggcaggaggatccctgtgagttcaaggtcagcctggtctacatagtgagttcttagacaaccagagctgcacagagaaacctcgtctttccccaacaccaaattaaacatgtaaagtattgtatgtctacacacataaatgcatgcacacatacatatagacacacatacatatatacacacatacatgtatacacatatacacatacacatgtgtgcctaggactgaatccagggaaatgtcgggcaagcactgtctagatagttttagttctatttttattccttttcttaaaaaagtttttttttttttttttctggggttggggatttagctcagtggtagaacacttgcttagcaagcgtaaggccctgggtttggtcctcagctctggaaaaaaaaaaaagtttttttctttttttcaacgttgtttttttctgtaagaaagcacaacactttatatttttatttctgctgtactgaatttgtatttcagaagaactgtttcaagtgtacagaattgtacagaaaactgttcatctacacagttcatagtttatggagaatcaggcctgcatcaggcactatagcagagttgagaaggcagcaggcacacgcgctcctgaaggcatggagcccagcctgcaggttcccctgccttaggatggcagcatctgcccctctcactgccccattcctgtaattccatagcattcaagggatgtttctccgagaattgaatgtggcagatccaattcaagccctcttgtcacttctcccagttcccactcctctgtgtatcactctttatctcctctgagggggggtctcaattaatgcagtggcatttgtgtttgtgcatgtttttatatgaatacatattatatatgtatagtactccatatatatacatatatatacacacacatatatatgtggaaaaactgggttttttgcatgttttaaaatttttataaactgtaagtcacatggtagtatcctctttatgtattgcttatatttatttattttaaattttattttattttttattttatgtgtgtgatatttgggctgcttgtatgtctgtgcaccatgtacatgtagtgcccttggaggccagaagaaggcgttggcctagaactggagttacaagtgcctgtaagctgccatgtgggtattgggaattgaacctgggtcctctgcaaagcagccagttctctgaaccactgagccacctctccagctcctgttttactgtttgtagatgcattctatagtgtatttgttagaattgctaagcagcgttctgttgaatgaataaaatctttctttggtcactttcctgtattggagatggagagcgagttgtttctggtggacgtttcttttggggtttgcttgtccctttgctttatggtgttggagattgtactcaggtcctcttgcacgctaggcaagcaccaatgagcactgccacacatttccccaggtatccatgaagcggttcctgtgcctacagctgggcatacttaatttatttcccagctcttgcaaattgttctccacatgggttgtgccaacctccagcatcatatgtattttgaacatggctcattatcagcaaaataactatactttatagctgtagatttaatctatcgattgctgatgtctataggatttaaagtgaatgttaagagtaccatggtgtggactgtcctcattgcttgtctctggcctcatttaggaagtagctcctggagagtcaggcccctctcccatatcctcactgaggtttcgaacagagaaactctggtcaagatgtgcaaggaagatagtgctgggcccagtcaatttctagtgaagaagaagcaggaggatcacatgccagcatggatattaatggagtcagtcaaagtttaacccatttgccctttgcttcatagtccttcttttttttttttttttaagatttattttatttatatgagtacactgtagctgtcttcagacacaccagaagagggcatcagatcccattacagatgtttgtgagccaccatgtggttactgggaattgaactcaggacctttggaagagcagtcagtgctcttaaccatctctgagctgagccatctctccagcccgcttcacaccccttatttgactactaccacttacaatttgagcagctagctagaggtctccaagcattggaaagacagtgtttttgaagagattgttcgaatagaattgatagtttttcttccatcagacctcagactgagttaattggtggaaacaataacaattgtgaagggtacttactgctcctggtgtaccacaggtattgagcagccacgaggcttgatggcggcaggcagtgactccaccccaggagagctgagtttaagtcttggcttttcttctactgactgagaagttctggtcaagctactcgccctcccctgtgccccagttgtagtgcctgggattgaaaggatgcactctggcccggaacaggctttagaaagtaaagcaaatgtgtaataatagacgtattatgtacagagtttactagtgacttagacacgcccacaccagaatgctccgtagaatgaacaagctccctcataccttcccggagggtttgcccttcaaatcttcccaaggctaattgctggactttactccaagagagtccccagtcctaaacttctgaagcccaagggcagctgtcactgaggttcccatccatctcaataatggttccttcattttcttctctgtgtcttcaccgagggatttcgatgtcatcagaaattcgggatcatggggaaaagatccaaattaaagggactgtgctaagagctcaatattacatatggagttatttgagctcttgatcaattaaacccaagctatgctaaatgtttctatgattacaaatatatctaattttcctgcctgctacaccttttatgactgaattccgaggaaagaaactctcatgttcccccgctccccactgtgtccatgacttgtttggaacccagtcaatgctggtaagatgagcagatagatgaattttaacatgggcttctgaagactagaacaaggaaaattggctgagatttattaatcattaaaatgagacttaaagccagcgaggcacccacatgccgttactcttagtactttgagggctaaggtaggtggattgtgagttcttcggtagcctgagctacatgacaagaccttgcctcaaaagaaaaagaaaagggaacactggagagatggcacagtggttaagagcagtggttcctctttcagaggacctggtttcagttctcagcacccacccacatggtggcttacaactgtctgtaacttcagttcctgtggtatctaataccctcttcttgcaaggctctgcatgtactggacatgcaagtggaacacgaacatttatgaaggcaaaacactcattctcataaaaataaataaatgttttaaagagagggaaagggaggtaataaaaaagtttaacagcaagacaaaaaccatgataataattaattttaataataattattattattttaaagaaacccttttcagagccttggctttatgttcatactcctgagaatttcttagtttatttctaaaaggcaaacacgagcaatttacacaaaacatagttccttatagaatccatgtttgtatcctgctccagggtctgtaaccctttcagatgctgggaagaattatttgaggacagccctatgcacctagaaccgtttgtcctggaggcagaccatatgctgtggctttcattattgcccatttgactcggagatgccaggcactggagtgtgtgacgtatgcaaggtcacactgtcacaacaatttaaaacttagatctcgttgtgcttcggaggccatactggctcccgagaaagccatggtgttaggacagagcaaaggtgaacaagagacagacctgaggcgtagggctcgaatcacaaccatgcagtatagcaagcattcctgtgctatcacacattggccagaaaactcctgcagttcccaggtctggcaacatgcattcgtgggtagtatatgtccacgatgtacatggggctagactcaacataggtatagttctttaacagtgtgtcattcacacagcaaaggtgactgattgcatgctgcctgcagtcctcacagttgacagagaagcagaaagcatgctgggctggacctcagtcccttcgtctaacccggcacaagcttccacgtgtcatcttcctgcctttctggagttgccaatgtcactgccccttgcctaaataatcatttttttagaagaagcagagtgttcagttgtggctcagaaaaaaaccaaccaggacttttctttgaagtcagagactctgcatcctaagtgaacaccagggtgcctggggtgcatgagcttgcacttgttgcagtggtctgacctggtctgttccctagatccagcctctcccatgcctttcatctggatccatcctagccaaatgaaaactggagcaggtggcctgacatcctctctcaggagcccacagatgattctaatagacaggagggagggagcgagcctccttggcctcaacgctgtcacctttaatttcttttattagtagtgtccataacctcgatgatgctcacaccagaatgacaatgaaattttactgcccttaaagcgtccctgtcccctcacttcatagccatttgtgtttagctctgccatagtagattcttgtggtataaatattttcttagtgtcttgtgggttggcagatctgctgcatcgtcagatccacactggcccattgttagacacacctcccccatctttagttacagggaagctaagagggtctgtagttgcgctgttcaaaatggtggttgctagcctggcggtgggggtggcgtggggtgggggagctatttaaatttaaatttaaattcactaaaatgtttcatctctcagctgtctgactgtacttgaaaggcctactggccacatgtggatagcagctgccgctgcggatggcacagaggaacagtttcaataaagcataaaggtctatgcacagcaggaccaggcggcttgtacagagagagttactttagactgttcagctccgggatacagggagagctcagcagtagagtgtttgtccagcatgctcagtgctccgggttcaacctccagcacagcaaagccaaaaccaaagaaacctggggcagagtcaagtctagtttaaagaaacccgtgaatctgtgagaaaaggacattggaaatcgtgcaccaggtagtacgtggattttggctttgaaatgaagtcacctgccccgtccgtccccttgtccagtctctgctgctcgtcacctaccccagcagtaccagatctggtgtcgccttctgtcatgggaacatgatgtcgaatgagcaaatggaatggagggaagaaaaggaagacattggtttatgtgaactctgtgctaatttttttccccatctcttttcaggtcctggaggccacacgggttaatcggaggaagagtgctctggccttgcgctgggaggcagggatttacgctaaccaggaagaggaggacaacgaataaactgccttcagcccaggaaacttctctgctgaaggaatttctgcagagaaaccaggaaattattgaatcagaagcattttaatagactacttattaaagtgcatacaaactcaacaaccctcatgtagaccagaagctgcaatacaccatgataaaaaaacaaaaaacaaaataaaaacaaaaaaacaaagaagcaaagcgaagcaaacaggatgttcacccatcaaactgagaccaggggcagaagagaaaggatatctttgtgactcaaagaagcccctggctttggactattccacaactgatccaaagggacacagatgtgacaaaggagtcaatatagttgctgcaggcagaactgaaggcagccttggatgggtgttgcagaggagcaggcagtgacatggccattccaaggcaacccgcagggtccagcctggtgcacccgctgcgctccggctatcctccacatcagcttcccatcccggtctcacctgaggcatcagaagtgttgggttgactccattttctccagcagccataaaaatgaatggtgtttctttccataattgccccaaagaggggaagtggggattcaatcgctcttacatgtagtcatttgaagttggggacacctaatggtcacaatatataaagtccgtatttttaaggcaatatctcttcatgttgcagatgcaatcaattctacagcaggaggttgagaacagtgggggattgtggggggcgggggggggggggagagccaaaccaaaagggttattagctttaggactttgtctgcttttattgttgacttatcagcttagggaaacacactttcacgattacgtttcttcatatgaaaagtatatttagtgagcaatgactatttttatgatgagacgggggaacaggaacacagatgaaacctgtacacatttgaacagcttggttcaggatggtaggggtatttttagaatggcaataattgaaaataaaaaggggagcagactcagccttagaaaggtagatggtcagaaataaggtgtttataactattttctattttaaagtgagccttagaggtggttgtggcataggatgagttgttttggatctgagagaggaaaccttaaacacatggggatagaaagagaaaggggtgagagggacaaagaaagaaaggaaggaagggggggagattatttttgcttgaacaaccagtgtttttcaggatgacaaagagaaaaatatagaaatttaagtgcaaacgtggaatcagctacaaatcctaaagatggtgtgtatgcctttgtgtgcttgtataaagcatgtgtgttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcatgctttgtgtccctgcctcgtgtttcacagaggataccagcttcactcttcctgtcacttcagggaatatgatagggacgctcactaattaggtgccccgagtttctgaatgagaaaatgtttcatttctggtggggaaggggaggcgggaggagggggagaaggcgtgggaaggggaaggaggaagaaaaaagaactaaccagccttcattatttttcctttattttaaagctatttcttacaagcaataattaaatccgaccttgctaaaattcatttttgtttttatgttattatgtcataagttctaatatgttattctaataagtatcgactccacaatatttatatgtacactccacacgctatctttgctttgcttttgtttttgtattaaactagtattgactttggggaaaagcttattcactgataagtagtgggcacaaaataaaaagatggagttgtcttatggttaataaggatgcaaaactccaaggcagatactgcagttgctagccaaaatcgtacgttggaagtgcacaccgtcttagatggttcattcttttaaccataaaatgctagccactgaggacagaaagcaaaggctgcagggagtgtgctttatagtgagggaggcgggcccagaagcaaatgtctcagattagaagtcccactaggtagatgggcccactggagaaggatcgtctttgtctaaggatttccagttggaggccccagatgcccggcctgtttacacagtgagatgaaagttccttccctaggggaacacagggattaggatgcatggggcgggggaggtagctaccttctctaggggcctccccacctcaaagacaacagtggcagagcccatggagagcaggctagtactaggagcggtacaagaaagcaaacaagctatgccatgtcttctggtgtctgctagagaccgtggaagcatcatgacttccttaaatttcttgtcctgtttagaagggaaatgtggacctttgtggaggccacactgaggaaagaattggcagccggtgcccacactccgtggagttacttctgtggcagatgaagtggtcttttggcggcagtagattgagtgggaagttctgaagtttgagggaatagactccattagtaggtgagacaccctgtctcttcccgctcacagggcttttatcgctggcctctccatttcccagttgtgctcttttctctgaactgccctccaaagatggccatctgtttcctagctttcctccctgacagttctagtgcattctattaagatggaaagcacagttccatcagagagccagcttttctctgtgttctttgagggtattttaaaaaaattttttgaggggcgggtgtttgttttttctcattcaggaaacatttgagccattgctttggacatatcactgtgctaggctctaggatcccacgtgggccccagtcactttcccaggatggagctgatccctggaggaaagtcttccttccctgccccttaaccctgagatgaagaggctcgacattagtccagcctcggatgctcggctctaccctgcatcagcacatacgctgcttagtctcagctgtaagaaatatttagcttctgtagatgttaaaaaccttcctgaaggaactccacactgcagtgtttatactccagagcactttcctccagagcctgtgacttgacagcctggcctttctcctctagagatgagggatgcagggtctgtcggtggcagaggctgggtggcactgggactacatggtgcatgtcccttcctcttacccatgcatgctgcccaccctaggcaatggcatagaagcagtatatagatcagtatccactcacacacacttatacacatacacactcggtgtgcttgcacacacacacacacacacacatacacacacacacacacacgaacaaggaacaccaaaacagtgttgattgttgtgtttaaagacatgtttttttttcacctgaaagaatggacttaaactatgtatttaaaaaaaaatagcctcagtgttagagatggtgaatgtatccagtttcagttacaaaaacaatttcctgaattttaagcattcagtgagctgccaattttgattttgtgttgctttttatccaaatggctttctcttttcttttacttttttcttttttctttgtaaattggaggaagtggggggcggggagcagcaatattgtgtttgaaaaattatactctgtacctggctttcctgtgttatgttaaccacttcaatgtttttattctgctttggttttatagtgtctgtgaggcattcgatgcaactatacagttattttctcattaaaactcaacgtgtatagtgtttttcttttttttttttcttttttccttttttctttcttttttcttgattgaaggattgctctttgttttactgtgaaaggaggttgggagattggttgtcagtctctgaggggcatgccagtggccttgatccctgcctctgcctccccacgtactgaaccgactgaaccggaagaagcaatagtatctggcaaaataaccctacgatgctatgttcattgtccagccgccctgcgtcaggacccacagaaatgacgcaggtgtctgctggtgaagtagctggacttcagagtggccattgagaaaacagaacgaccccttaagccatgcctcaggcatagcctgtagctggagtacgtgcacattcctgtgtatgtgaaggctggaggtcagcctccgttgttgaacctcaggcgctattttacgaggcagggtcactcactgactggaactggttaagtagtcgaagctgccctggtccatctcactgccactgggttcctgtgtgtatgccaccatgtcagtctttatttctgtgggttctgggaattgaacccaagtccttagagttgcccaacaagcactttaccaactgagcaaattccctagcacttggtgctaatccttcttatactcccagcatgcatctgtatttggctctcctttaggaaggactgtgaatagcagacttgaagaaagcatgggagttcttcagaaagcctccttcctattccatattcacctgtcctcctcccttctcttcacccagcccctgcactccctgaaccctgttcaccagtttcctgtgcctccctatccctacctcttcctcatgcttttcagctgcccctctcctttctctcgtgggactcttcagcctcttggtccctgccagatccttatattctgaatatctgggggtctcttgtggtacccagtcacggatagcatctccccagctttatgtgttgagagttctgagtttgtctgggaatgtggctgagtgatacaggacttgcttactgtcttgttcaggttttactgctgtgaacagacaccatgaccaaggcaactctcataaggacaacatttaattgggactgacttataggttcagaggttcagtccattatcgtcaaggcaggagcatggcagcgtccaggcaggcatggtacaggcagatccgaaagttcaacatcttcatctgaaggctgctagtggaagactgacttccaggcagctagggtgagggccttaaacccctcagtgacaaacctactccaaaggctacaccttctaatagtgccaccccctgggccaagcatatacaaaccaccacacttagtgtggtaaggacctgttccaagtctcagcactgcaaaaacaaacaacaaaataagcccattaaggctgtgcctggtatcactcaggagacacaggcaggaggattgccacacggtcaaggcagcctggtcagcatgttccaagccagacaaggttatatccaacctatttcaaaaaagcaacactacaaaacaaacaaacaaacaaaaaactaaaaatcatgggtgatagcagatacctacatggaacaggaggagcaagagttcaaggccagccttggctacataataagtttgagatcaatctaggctacatgagatcatgtttcaaatcacagtacaaacaatatttaaaaaaaaataaaaactggggtgctgacttctgatatgtgtgctgaaggtacagtggttcggggagctttaaatatccctgggagcttttgtgcatggtcctaacctctgtgagatcaccatctatgtgccttggtaaagcagctttgagatgccacctggattctcaagtgaagtgcctctagccaaagacagaagattaaaaaggaaagaaaaaaaaaaggaagataattatatacatatatgttcagattttaatttcaggacaagataaaggaatttgttcaaacaggaaatttttattgtgtagaacagtagcaacgttggctggcttaatataaaaatctaacagtggggattggagagatggctcagcagttaagagcactgactgctcttccagaggtgctgagttcaaatcccagcgcccacatggaggttcacaaccatctctatacagggatccgatgccctcttctggcattcagcagagcagtcatatataaacaaacaaacaaaaatcttaaaaaaaaagaaaagaaaagaaaagaaaaaagtcaacagtgggctgaaaagatggctcagtggttaggagggcaggctgctcttacagaagacccaagttcagttcctaaaagcaaaatcagacagctcacaattgtctgtaacttcagctccagggtttgcctgttctggcctgtgtgaacacctgcacacatgtgtacttacacacacgcacgcgcgcgcacacacacacacacacacacacatgcatatacacatatgtgtgtaattttcaaacttgaaaaagttttttaataaaaaatataaattatttttttctctcccaacagagttttgatgcccagtatagatataacatttaggtcttcatgtgggactcctaactgagtgcttggaccaaattctgaccccacttctttaatatcttgtcttttaaaataaccagattgaagactgtttcattttttggcattactgtgaatttggtgtctcaggaagagagcccagtcattgtacgtagtcaggcaggcagacactgacgataacagcctggggaattaatgatgtttgtacctgagagtcagtcacagcactgaaaggcctcccggggcaattaaaagcaaccgtgcaagcccaatttagtgtgcatttgtgtctccagcctcttgggaggctgaggcaggaggacagatcgaaagccagcttgggcaacttagtaagaccctgtctcaaaaagccatcagagggctagggatatatctcagtggtattccattggtgtagcacagaaaccccttaacccaggggttctcaacctgtgagtcgtgacccctttggggatcgggcaaccttttcacagggtcacctaagaccattggaaaacagagacttacatcatgactcataacagtagctaaattacagttattaaataacagtagaaataagttttatttttttattttttaattaattaatcaacttacatcctgaccgcagcttcccctccctcctctccttcccacctactcttaccacccccccaattccctttctcttcagaaaaggggaggcttccatggatatcaaccaggattggcatagcaggttgcagaagactcaataaacttctcctattgaggttagcaagaggcagttcagtcaagggagaggatcccaaaggcaggcaacagagtcagagacagccgctgcccctgctgttaggagtccaacatgagacctagagatagatgcacaactgtgtagatggtccattcccatgcatgttctctggttggtggttcagtctctgagatcctctgtgggcccaggttagttgattctgtagtttttttttttttttttttttgtgtgtgtgtgtgtgtgtgtgtgtgtgtgtgtgatgttcttcacccttctggttcctacaatcaatccttcctccccgtcttctgcaggattccccaagttctgcccaatgtttggctgtgggtctctgggtggagttgctgggtgaagcctctctgatgatgcctatattagaatcctgtctgaaagcatggcagattatcattaacagtgtcaggggtagactccctctcatggcatgggtctcaagctagaccagtcattggttggtcaatccttaatttctgctctgtctttacccctgcacatcttgtaggcaggataaattgtgggtctaaggctttttcggctgggatggtgtcccacaccttccattggacatcttgcctagttataggagatggccacctcaggctctatatctcccattgctgtgactcttagctaactagggtcaccttcacagattcttgggagtttccaatgtcctaggtttctagcttgtcccagagatgaccccgcactccagttgtctctcccagtactctttccctccctcctctccccacctgataactcctgctcctacccccacctcctctcccaggcagttccccccagccccatccactatttctcttctcagtgagattcaaggatcctcacctgagctgtccttgttactaagcttctgcaatccacagacacagtgaaaataattttctggtcagaggtcaccacaacacgagggactgcatgtattaaagggtggaagcattaggaagatagagaaagattgccttaaatgataacagaaagggtggggttttgttggtttgggttaacgaggctcgtgtttgcctgcgagtggccacatggtggcagtggtgctaaaggaaaggcaggccctagcctagagtcttccctaggggttccgacccttcagaatagacaggaattcttcaaaaacctcaatgaaaaaccactctcaactaggtgtggtcactcaataatcccaggactcaacttgagtggcagaaacagaagagtggacacaagtccaaacccaacctggcctacatagtgagttgcagggtagcctgggctacatagacactgtctcagaaacaaaacaaggtgttggaaagatggctcagcagttatgagctcttactcctcttaaagaggcttaaagactgatattctttagtctaaaatatttctccacaactaatgagcatttttcttctgtctttgtcaaagtactaagggacactactaccacatgtttagcttaaagtgacttaaaatctagcagacatgaccaatctatactgatcacacatcgaagccggcatagactgcgttccagacactgggtctctgcagcccagcctagccttgaacttgcggtcttcttgcctcagcctcggaactgtcagaacaattaaacctctaccaccatggccagccatagtggttcttacctgagcttgtctcagagcaccttagaaggcttgctgaggcagacggctggatctcaactcgcagagcttttagagtgtgtaggtgtggaagaaacttggagaattttccattcccaggaaaaggtggtagaacacaactcagagggaccaagcacgctgtactctaggatgcaagatggagatccgttggcgactccaatccactctgaagctaatcactctgagccactaaaatatcccttggccgcccctcttcatcgctggctgagcacggcaggcaggctttcaggagtttccagtcagtgccttccaggcttccgtgacgtcctcctcgtgttatttctcagcactcttcgacctctacacacttctagtgcactggataacaatgctgaagctggactagaatctcagcaatccaaggcgctgaggcaggaggatgaagaagtctgaggtcagtgtgtgctacatagcaagagcccgtttcaaaacacggcggcgataacaaacactggtagtggcagtgaaaacgtcttccaacacaccgcattctcagtgtgcttctagaaggcttttacgacagacaaggtggcctcaatgaggaaattcagggatttttctagttctcttactgcaccacaaaaagaaagcccactgaaatgggtccctaaagcaaagcaggggctcccatcaagacctacgggttggtgggaggagcttaagcctctttggcttttgtcaagagtctcctgtggaccacttcctgttctgttctgcctacagagccgacatgacgaaatatgatagaggttgttccccaaaaaggagcctcctcacccttggaaacccaggtcaatgaaagtgagacccgaaggtccatggaggccctgacaagatgtcaccaaccttgggtttcacctccagcacagaataaatcagatgtgtacatacctgtaatcccagcacccaggaggtagagacacaaagatcagaagttccgcgttatccttagcttcattgcaagttcaaggtcagcctgggtttcatgagaccttgtcccaaaaaataagaccaacacaaaataccgccgtgctcaagtgaagccaatccaggcaggcagcatataacaagaatcaactcaagcctggcagagagagcatgactataatatcagagctccagacgcagaggcagggcaatcagtagttcaaggctcgcctgggctacatagtgaggttttttgttttttgttttttgttttttttgttttttgttttttgttttcgagacagggtttctctgtgtagccccggctgtcctggaactcactctgtgagtttttttgtttgtttgttttcaacaacaagaaaagagattagaaatgtcctctaatgtataggttgggtagcagaagccacagctttttcccacaaccagtattttcttcctcttgtttctcagctgggaccgagggtcctggtaagctattggccttgattatgaacctcagtttagggaattcagggggaggatttaaatgtagccaggtgagggagtcaccaggatacagataaaggagagatgaaaggatgaatggtacctggtagatgaatcatctttgtggatggaagctctcactgagcagaggcacagccagagtaatgtcatgggcgtttatctctgcccacggctctctccatctctcac

SEQ ID NO: 1316 - DNA, 3702 bp, Mus musculus
aactccggaccttcggaagagcagtcgggtgctcttacccactgagccatctcaccagcccaccatgcaactcttataaggacaacatttaattggggtcggcttacaagtcagaggttccgtccattattataaaggcaggagcatggcagcatccaggcaggcctggtgcaggaggagctgacggttctacatcttcatctgaaggctgctcgtggaaaactggcttccaggcagctgggatgagggtcttaaagcccacgcccacagtgacacacctactccaacctgaggccatacctccaaatagtgcaactccctgggccaagcatattcaaaccatgacaggatctatattcagaatgtgcatttaacctttatttgtgttttttctttattctagaagcctccccagctttctgaggatgctaaccagctgagaagcaagcaagacaactgtggtgacagtcgcctggagcctgccgccagctctctctccccagatcacaaaaacatggaaattggggtgtccgtggcagaatgtaaaagtgtacctggagtcacctctaccccccattccaaggaccactcctcccctttctattcgccctcacacaatggcctcctcgctgatcaccacgagtctttagacaacgatgtcgccagagagatccagtacctagatgaagtgctggaggccaactgctgtgattcctctgtggatggaacttacaacggaatctcctccccagagcctggtgcagccatactggtaagcagcttaggctcgcctgcccactcagtcaccgaggcagaacccactgagaaagcatccggtaggcaggtgcctcctcacatcgagctcagtagaagcccctccgacagaatggctgaaggagaaagagccaatggacactccactgaccagccccaagacctgctggggaacagcctgcaggcacctgccagccccagttcctctaccagctcccactgctcctcccgagatggggagttcacactcaccacactgaagaaggaggccaagtttgagctgcgtgccttccacgaggacaagaagccctccaagctctttgaggaggacgagcgcgagaaggagcagttctgcgtccggaaagtgaggccctccgaggagatgatagagctggagaaagagcggagggagctcatccggagtcaggctgtgaagaagaatcctggcatcgccgccaagtggtggaatcctccccaggagaaaactattgaggagcagctggacgaggaacatctggagtcgcacagaaagtacaaggagcgcaaagagaaaagggcccagcaggagcagctacagttgcaacagcagcagcagcaacagctgcaacagcaacagctacaacaacaacagctgcaacagcaacagctgcaacaacagctgcaacagcagcagctgtccacgtcccagccctgcacagccccagctgctcacaaacacctagatggcattgaacacacaaaggaggatgtggtcactgagcagattgacttctcggctgcacgcaagcagttccagctgatggagaattccaggcagacactggccaagggccagagcacaccaaggctgttctctatcaagccttactacaaacctcttggatccatccattcggacaagccaccgaccatcttgagaccagctactgtcgggggaactctggaagacggcggcacacaggcagccaaggagcagaaagctccctgtgtatctgagagccagtctgcaggagccggtccagctaacgctgccactcagggaaaggaagggccatacagtgagccttcgaaacgcgggcccttatctaaactgtgggcagaggatggagagttcacaagtgcccgggccgtcctaactgtagtcaaagatgaagatcatgggattttggaccaattttcaagatcggtcaatgtatctttgactcaggaggagctggactcagggttagatgagttgtcagtgaggtcacaggataccactgtcctggagactctgtccaatgacttcagcatggacaacataagtgacagtggagcttctaacgagacacccagtgcccttcaggaaaactcgctggctgatttctctctgcctcagaccccccaaacagacaacccctccgagggccgagaaggggtctctaagtcattcagtgaccatggtttctattctccttcctccacattgggagattctccgtccgttgatgaccccttggaatatcaggctgggctcctggtgcagaatgccattcaacaagccatagccgagcaggtggataaggctgaggcgcacaccagcaaggaaggatcagaacagcaggagcctgaagcaacggtagaggaagctggaagccagacacctggctctgagaagccccagggcatgtttgcaccacctcaggtgtcctctcctgttcaagagaaaagggatatattaccaaagaacctccctgcggaggacagggcactcagggaaaaggggccctcccagccacccacggctgcgcagcccagcggtccagtcaacatggaagagaccaggcctgaaggagggtacttcagcaagtattcagaggcagctgagctgagaagcacagcctccctcctggcgactcaagagtctgatgtcatggttgggcccttcaaactgaggtcaaggaagcagcggactttgtccatgatcgaagaagagatccgggcagcccaggaaagggaggaggagctaaagcggcagagacaagtgaggcaaagcaccccaagccccagggccaagaacgccccatcgctgccttctaggaccacctgctacaagactgctccaggtcctggaggccacacgggttaatcggaggaagagtgctctggccttgcgctgggaggcagggatttacgctaaccaggaagaggaggacaacgaataaactgccttcagcccaggaaacttctctgctgaaggaatttctgcagagaaaccaggaaattattgaatcagaagcattttaatagactacttattaaagtgcatacaaactcaacaaccctcatgtagaccagaagctgcaatacaccatgataaaaaaacaaaaaacaaaataaaaacaaaaaaacaaagaagcaaagcgaagcaaacaggatgttcacccatcaaactgagaccaggggcagaagagaaaggatatctttgtgactcaaagaagcccctggctttggactattccacaactgatccaaagggacacagatgtgacaaaggagtcaatatagttgctgcaggcagaactgaaggcagccttggatgggtgttgcagaggagcaggcagtgacatggccattccaaggcaacccgcagggtccagcctggtgcacccgctgcgctccggctatcctccacatcagcttcccatcccggtctcacctgaggcatcagaagtgttgggttgactccattttctccagcagccataaaaatgaatggtgtttctttccataattgccccaaagaggggaagtggggattcaatcgctcttacatgtagtcatttgaagttggggacacctaatggtcacaatatataaagtccgtatttttaaggcaatatctcttcatgttgcagatgcaatcaattctacagcaggaggttgaga

SEQ ID NO: 1317 - protein, 832 aa, Mus musculus
KPPQLSEDANQLRSKQDNCGDSRLEPAASSLSPDHKNMEIGVSVAECKSVPGVTSTPHSKDHSSPFYSPSHNGLLADHHESLDNDVAREIQYLDEVLEANCCDSSVDGTYNGISSPEPGAAILVSSLGSPAHSVTEAEPTEKASGRQVPPHIELSRSPSDRMAEGERANGHSTDQPQDLLGNSLQAPASPSSSTSSHCSSRDGEFTLTTLKKEAKFELRAFHEDKKPSKLFEEDEREKEQFCVRKVRPSEEMIELEKERRELIRSQAVKKNPGIAAKWWNPPQEKTIEEQLDEEHLESHRKYKERKEKRAQQEQLQLQQQQQQQLQQQQLQQQQLQQQQLQQQLQQQQLSTSQPCTAPAAHKHLDGIEHTKEDVVTEQIDFSAARKQFQLMENSRQTLAKGQSTPRLFSIKPYYKPLGSIHSDKPPTILRPATVGGTLEDGGTQAAKEQKAPCVSESQSAGAGPANAATQGKEGPYSEPSKRGPLSKLWAEDGEFTSARAVLTVVKDEDHGILDQFSRSVNVSLTQEELDSGLDELSVRSQDTTVLETLSNDFSMDNISDSGASNETPSALQENSLADFSLPQTPQTDNPSEGREGVSKSFSDHGFYSPSSTLGDSPSVDDPLEYQAGLLVQNAIQQAIAEQVDKAEAHTSKEGSEQQEPEATVEEAGSQTPGSEKPQGMFAPPQVSSPVQEKRDILPKNLPAEDRALREKGPSQPPTAAQPSGPVNMEETRPEGGYFSKYSEAAELRSTASLLATQESDVMVGPFKLRSRKQRTLSMIEEEIRAAQEREEELKRQRQVRQSTPSPRAKNAPSLPSRTTCYKTAPGPGGHTG

SEQ ID NO: 1318 - DNA, 54081 bp, Homo sapiens
ctcttggaggtcccatgggtatggaaggagaccctcgccagctttgttcataggcacagaatcatctgtagacagagggttaaccacaaatgcatctggcactgttttctcttttcttggggctctgcctcaatatagtggattctgctggtccacagtggtgtttggcttttgatctctgccatgacctgctcaccaggcgtgaacccaagatctggaactatttttaaaccaagagggacacagcaaatttataaagaactgaaaaactaggcttgcttttgtctttagcagaatcggttaccctagaaatctcaccttgcaggagccagagttccctctgtggccttgagcttggtttattctggggtagggactaccttgcaaaataatctccagtgaaaagggcctttggtgagaagagcctccgagggctccttgatagggcgctcagtatccctcattgaggaaaacatgaaactcacatctctccttattcacgggaaacccggaagcctctcagtcactcctgtaagaagtgggtctccaagtaacggaaagaaacaaccctttcatcagctgctgcagaaaaggcaacagcagcttccttcctttcctcccctccccgctgctgacccccaccacacacactgtcttcagtttctttcacagaaagcccaagctgtaaatatattcatcaaataacaccttaacattttccagatgtgattggagccactgacttttcagcagggctaagaggaggattgttcataggctaagctatggtgctgggggagactccgttctatgagaaattgaccagtctccttcactaggaatgtgggtcaagacacagggaagccttgtttccagtgaaggggtggggagttccagaagtattttcatcccgtcttcagacctgtacctgaggcataagacagagagaatagcagaacagtgattactcttttgaccaataccgtagaagctctcagaaaaaaaggctggacctgcaggagcaggaacaggactcctggcctccaaagggttgagttttctttttagaactgccctagtcacattgagctgtaatggcttcatggcaggagatccatggaggcaaaccaagaagtgtttttagtatctgccccttttaaggcccacagcattgacccgagcctgccgggtccaaatttagcctgcgtttgccccaggagtgcttgaggtctggagtctggccggctgtcttccatcagccaggaggggaggctctagcctctttagggagtggcttagttcccagtttcccacaatcaacacgggcccctagttccacaggccggaagaagctctgctcgggggatggaagaggaaagcctgcacaggactggaatgtggcccaggttatcacccggggcctctcctctcctccacttcccgcttataggctcggcttagaggcccaagtctaaccctcgcagcaagcagttcccagactttcctgctgtcagtgccttcaggggagggtggaacggcccactcggagtcccagctccttctccttcctgtcgtcgttagcagggagggccagaggaggtgcagccagcctgcttagaaactttggtgcaccgcgctttcttcaattctttttgcccggcacagtttgcgccgttgaagagggctggaagtttatttccagctattgctgcagcacttccttctcctagtgctgttcgttcttcttatgggaactggtactcactccctccaagtctgtgagcgtcttgctggggatggcggatcaccttggagctctgaggacctcgcacggcccaggctgagagcatatagctctgcagggtcccaggatatgcttatggatccaaggtagtgttgacctgttcaacttctgttcccttccttatgcttcgggttccctcggtttggggagttagcctcccccagacctcctgactgcagctttgcctggtttgtccaaagctgatgaggttcagctgatgtgggcatcttttaggtttctgggcatcatccaccagccaggtgcacttccttccatcccaccctcaccccttctgcatttgccttcatgctggagacatcctgacttagccagaaagttaaaaatttaggaagaacctctctaaagatagccacacatagctcgtggaaccagttcttcatcatgattgtcattgcgtcctgcgcactgaaaacgtgacttacaaaagagaggcaggatgagaagggaaaacggagatactctctgatttcacagctatgaggaagttttgttttatagccatgcctctgttcctaggccaagagtgagtttatatttttggtggaacttataaataactggattaaaggatcgggtcacctattatctggagaaaagcatttctaatttaaatgtcatggctttagtaggaagtaatctgggttattcaaagcagagaaacctggttgtacagcctgatgtttgagtaatttggttcacactgtgcatttaggctaggagcctaggaggtcgagatgggttaggcacactgtcgagctttaacagcctgaggatggtggggcagaggggaggctgtgaacacagtgaacattgtccttgtggtgaaggacacctttctgctctccgcctgggctcaggcagacctgctaaggaaaatgcacttccttaaagttatttctgtccatgacatgcctagctgtaggcctaggtaccctgggcagaaagaacacatgggtgtctatgcccagtggggcagggatcagggccctgctgttgtgttttctgtgcaaatgtaaacaggcttctagaatctcacttgtggtgttggtgaagagttgcagccttttcccacagtgtccatcataatgacatggacatgggatcttaatattttacctctggcaagtggccagaggaaacagaaccccttcagagaccagcccagagggtgaaatccccagaccgtgcaagaagtcacatttctagctgacacgtagagcaacagatacgtctccagagagttaactctccagggagttcatctatttctgaccaagactgaataaagaaggtaaagggatcatcgacttttaaagctaaattgtgagtctcacatcatctgtagagattcaagcaagcaaaagatcaaccaaaaagccaagctaactctgttttgatccatccactcttcttaccatttcccatgtcattttaaaagcctcctaatattgagactccattttgatgtatcaggatagaatgagaagaacccaccttcaaatcctggctagggcacttactaggcaggtgatcttgggaaacgtccctctatttctctatacctcttattctgaagttttaagactgaaataaaattcatgcctttcccacttaacagagggccatttttcaagcatcagctgacatatgtatgtgcatgtactgtgaaatgataagctattagacatgtgtcaaccagaaaatggggatgccacacttacagcatgcccacaggacaggcttgtcagggctgtctcattcacttgtacatttacttggctagttgagttgtggagatggaccaggttctgttttaaccaatgtgtgacccctcctctgcttcccatgtgactggagccccaggtctgggtggttcttgactgctcattctacttactgcatttcaggacttaacttttaaggacattttgtgaaattactccctctgttgcagcacaactgtatcttcctagtcgtgttcagcttcaactaaaattcacatgtaaggatctggggttggggaaagattagggagattagagctgccatagattctgactttgagtctttcccgggccttttttctttcatcttttcttcttgatttcttttcttctaaaaatctcctgctcttttcccaaaagaaaatcagtctgctgccagaaagaatataatacctgtcatttaaacctcagtgtaaaatggcttaataatagtgaacatttgcattaaccgttttacagtttacatagtacttttaagtacattttctaacttaattctcaaaacagatttgggagatattattagtcctgcttatgaaggagttctgttctcagcagaattccataattacaaaaagtctggtaggacttttataggtagagccaagaaatgaccccagactctggtctttggacgctaaactctgaattaccacatttcctgcattctttaggtggagacataggcacctgtgttgtaaattaagccacgctaatttgctttgcaaaactattaaacactttttggtaaataaaggcgactttagttgcagcctggctaccaggttatgttaaacacaggtctctgggaccaaattctggcactcatacagacttgagttgaataaacatttataaaaaatgctatgaggaaatctcagctccctaaatttctagatgctccaaccccaccttgcctgaagacagatgtggcaactttatgaagacaggattctgttaccattttagtgggtggtaagcaaccgaagtcccctgagccaaaggctagaaacaagatcgtttagttttcaaacctcaaacaccatccctaagggtgtataaaccaaagggttcgctctattggcatatcccctttatgaaagggtgaggaagatctctaatccacaaatttgaacaccaccaatttcacggatttctaacattcattatgctaattgacaggccactaatttcactaatgaaaacctatttctcaccttaattatgccaattagcaaagcttcaggggttcttgggagttaaagggagctaagtactggaggaagccacctgtggggcgtgggatctctcattggatcctagatgaccatcccttgagtttatattcccatttaggatggttgtcagaccctggaatgtaatttaaactaattccagaagcacacagctgtattaaattgccccgatcaagtatgtgaaagtaaatggtaggcatcctaaccagctgttaactattctagaatttagtgggaagggcaggtttctgtgtcgtggtattagggctctacctggagggtgaactgggccgatctaaaaagctcccacagcccctttgcaccttagtttttctctgaccttagaaaacccagtttgatgattctttcatatcctcctgtttttgcattggggcatagttcatttcaaaaaggactttcctggtgattgaatgaatgtgcatcttatctgaatctggaatcacgttcgcctaatttgaagcatggagaaaattctggaccttcttatcttcaaagagagcaataagcatttgttggtttaaacaagacatcatctgatgataccaagcccagattcctgcctaatccggataggttagatttccagcccatttccatttacctggtgtagttgccagtggctttgattctatcaggccatcatgcatgaaggcaaattcttactgctgacagtggaactcaggaattcgctcttttgttatcattgttgtctaactttacaaaacctcaggacctctggtgcatgattgtgaatcagtaattcagagttgtttatctctttaaatacttccatgccaattagaggttaaacctgctgcttcctgagtagatggaattgagtgtcatgaagaattttctgaatttatggggaaagggggactggatgccatatagctcacaagaaggagggcctctttcctgtttacaccctccagtgtctagaggtttaaaaaaatgtatcggaaaggaatcatcccaaattacactggaacccccaaactttgacttttaacaagtaactagcgtgtgttgtgtgtgtgtgtgtgtgtgtgtgtgtgtgtgtgatggagtttcactcttattgaccaggctggagtgccgtggcatgatctcggctcactgcaacttcctcctcccaggttcaagcaattctcctgcctcggcctctcaagcagctgggattacagaggcacctgccaccacgcctggctaattttttgtattttcagtagagatggggtttcaccatgttggccaggctggtgtcgaactcctgacctcacctcaggtgatctgcctgccttagcctcccaaagtgctgggattacaggggtgagccaccgtgcgggcttcttttttttttttctttttgataccaagcctcacttcctcacccaggctggaatgctccaacttctgctctccgggttcaagagattctcttgccaaatagctaggattacaggtgtacaccaccatgcctggccaacttttgtatttttagtggagacagggtttcaccatgttggtcaggctggtctcaaactcctgacctcaagtgatccacccacattggcctcccaaaatgttgggattacaggcgtgagccaccacacccagccttttttgagacagtctcacttcctcacccagactggaatgcagtggcactatcttggctcacagcaacctccgctctccaggttgaagcgattctcatgccaagtagctgggattacaggtgtacaccaaccaccatgcctggctaacttttgtatgtttagtggagaggaggtttcaccatgttgatcaggctgttctcaaactcctgacctcaagtgatccacccaccttggcctctcaaagtgctgggattacaggcatgagctattattgcaccctgccaactaactagcatattttaaaatctcagtttgaccgatcacagaagacataactacttgtaaaataatttctgattcaaagataatggcagttttgtattttttttcaaacaattgcaaaagtatattgtcaaattgttgtcttagattttaaatatttggtaccaaaacaactatttctagttcaaaaagggtgccttggaaagagctgatacaatttttgaatcctaaaaagaaaacgtggaaagtcatctgctcattcatcatcgagcacttgaagtgtgaaacattcaacagaaagggataatgctgatgtgaggagcggaaaagtgttcttgggaaatggctttggagataagccccatcactccttcctctgtgattagcaacaagagacaaagagaagcaatttcttcacttgcctgattcagactaagaaaactctaatatagacttagggctttcttggaagtacagagaactcattttttttttaaagggtgttgtcttctggagcttattgttgctgctaatttcattatgaccctgcagaataacctcccctcatgtttaatgaacggattaattaattaaactatagaactaattatttgccttttagtttcctttactattacgttgcccttcttcctctcctcaggtattctaaagcatcttgtgtttcaggagagcagtgttttctaaccatatttcagtcctaccagcttcctactgatttcccactaccctccgcccaccccggcccccaagccaaaaaggatagaaggagagctctgttgttcccatgcagaatattagcagtgagtcattggccaaaagaagccaggggtgagggtgccataggtaatctgactcatcttagcagtaccgtgaatctctctttgtttgtcttcttatttcaataataattttccatggagtgggctaattttggcctaggtttacttgaaattgaatggcagccagtaagtttcagcattcaaattttgtgtaatgcttaatgatatatgagtagaagttactgacaatgtctcatccaacaaaaagtttagttaatagttttaaaagggctggccatgcagggtggctcatgcctgtaatcccagcactctgggaggccaaggctggactgcttgagtccaggagtttgagaccagcctgggcaacatagcgagactctatctctacaaaaaattttaaaaattagccaggcatggtaatgcccacctgtagtcctaagggagactgaggcaggaggatcccatgagctcaggagttcaaggttgcagtgagctatgatcacatcactgtgctccagcctgggcaacagagcaagagcctgtctcttaaaaaaaaaaaggaaggtggtggcaaaaactactatttaatgatggtcaaaaataaaaaataaagatattagcaattataaatattaattgtgttaagtatcactccttaacaaagaccagacctagactggaagaaaatcagagaatggaagatgttgacaaaagaggaacactcattatttgtgcctgttaatggagaagacatatacattacttgaataatttaagtctgaaaggaaatgtggaaagtgaagagtgaaggaaaccccccagttcatggataactcagagagtttttcaacattctgacagcagtgtagagcacttacgatgaactccagtgttttcttaggtctcaagaacaaatccataattatccacttttttgggaaggattttgaaattaatttcctgagaatcgtcctaaggtggtgttttaatattctaagcatttaaaattgttgaaaccttagataaatgaaaattacactctcttgcaattttgcattgtcctatgtcaataataccaggcacattataaacttgagacagggaaacaaagccaacctaggtgttgtaaggtccttgatggtaactcaaattaagtttatactttactggaattctttgagataagccagagtcctttgatatgaaaaagaaaatcatcttataatttgaaaattaatgtttctaatgccaaataacaaaattacataggctagataactggtagaaaaataagatggatgggttgggtgtggtggctcatgtctgtaatcccagcacttcgggaggctgaggcgggcagattacttgagtacaggagttcaagaccagcctgggagacatggaggaactctgtctctacaaaaaaaaaaaaatatataaatatatatatatatataaatcagccaggggtgatggcacacaccggtagtcccaggaggtagaggttgcaatgagccgagatggcacactgcactccagcctgggccacagagcaaaatcccatctcaaaaaaaaaaaaaaaaaaaaaaaaagccctcaagacaaaaaacctccttccttaaaaaaaaaaaaaaaagaaaaatatgatgggttttaaaacattaagaagatagggttttcttattgaatcacaaactgaagatatcacatataaagcagttaaaaaactggaggagaggtaccattggccattagtttttcaaagcagtgctgacttcttaactaaagagtattattttgatgcaatcccagaaaacagagctgtgcagtcagtggctttggtgatggtgttcataaggcacatggtcaattacagccatggcagtgaggcactgtagcctgtgtgctgccattaaagggatctactgttttccagtattttattctgcaaagattttccaaaaagtttcttgtctccagaataactgcattacatctggcagagagtcatatgttttaaagatctgttcatacaaaaggaccttctttttgcaatcctattaatagtcgtattgcacagcctgcaatcatttgccgcaaaatacttgggaagactctggtacaataatgatgtaatctcttccaccttagtagataaaatttaaaaatggcactagcatgtaaacaaaatggaatccataaattagagaggattgggcacctgttactacaagaaaatgaacatttaagggattattagaaaatatctattcaaaagaatttgtcactgtggtttccattttccttcctcttagttatgagtcagtttgtcagcattcacatccataagagatgcagtatttaaccctgacttttgtttactctttattccagaagcctccccagctttctgaggatgatatctggctaaaaagcgagggagacaactatagtgccaccctcctggagcctgctgccagctctctttccccagatcacaaaaacatggaaattgaggtgtctgttgcagaatgtaaaagtgttcctggaatcacctctaccccacatcccatggaccatccctccgctttctattcacccccgcataatggcctccttactgatcaccacgaatccctggataatgatgttgccagagagatccgctatctagatgaggtgctagaggccaactgctgtgattctgctgtggatggaacgtacaatggaacatcctccccagagcctggtgcagtggttctggtgggcggcctaagcccccctgtccacgaggcgacccagccagaacccactgaaagaacagctagccggcaggcacctcctcacatcgagctcagtaatagcagccctgaccccatggcagaggcagaaagaacaaatggccattcccccagccagcctagagatgcgctgggggacagcctgcaggtgcctgtcagccccagctccacaaccagctcacggtgttcttcccgagatggagagttcactctcaccacactgaaaaaggaggccaagtttgagctgcgtgccttccatgaggacaagaagccctccaagctctttgaggatgacgagcatgagaaagaacaatactgcattagaaaagtgaggccttcagaggagatgctggagctggaaaaggagaggagagagctcatccgcagccaggccgtcaagaagaatcctggcattgcagcaaaatggtggaatcccccgcaggaaaaaaccatcgaggagcagctggacgaggaacatctggagtcgcacaaaaagtacaaggagcgcaaagagagaagggcacagcaggaacagttgctgctgcagaagcagttacagcagcagcagcagcagcccccatcgcagctctgcacagcccctgcctcttctcatgaacgcgcaagcatgattgacaaagcaaaggaggacattgtcacagagcagatagatttctctgctgctcgcaaacaatttcagctgatggagaattccaggcaagcggtggccaagggccagagtacacccaggctgttctccatcaagcctttctacaggcctctggggtcagtcaactcagacaagccactgactaatccgagaccaccttctgtcgggggacctccagaagacagtggtgcctcagccgccaagggacagaaatcccccggtgccctggagaccccatcggcagcaggaagccagggcaacacagcctctcaggggaaggaagggccctacagcgagccttctaaacgtgggcccttatctaaactgtgggctgaggatggagaatttacgagcgcccgggctgtcctcactgtggtcaaggatgatgaccatgggattttggatcagttctcaagatctgtcaatgtctccttgacccaagaggagcttgactctggtctggacgaattgtcggtgaggtctcaggataccacagtcctggagaccctatccaatgatttcagcatggacaacatcagtgacagcggggcatccaatgagacaaccaatgccctccaggaaaattcactggctgatttttctctgccccagacaccacaaactgacaacccctcagagggccgaggagaaggcgtctccaagtcatttagtgatcatggtttctattccccttcctccacgctgggggactctccgttggttgatgaccccttggagtatcaggctggcctcctggtgcagaatgccattcaacaagccatagccgagcaggtggataaagctgtgtccaaaaccagcagggatggagcagagcaacagggacctgaagcgactgtagaggaagctgaagctgcggctttcggctcagaaaagcctcagagcatgtttgagccacctcaggtgtcttctcctgttcaagagaaaagggatgtattaccaaagattctgcctgctgaagacagggcgctcagggaaagggggcccccccagccactgccagctgtgcagcccagtggcccgattaacatggaggagaccaggcccgaaggaagctatttcagcaagtactcggaggcagctgagctgagaagcacagcctccctcctggccactcaagaatctgacgtgatggttgggcctttcaagctgaggtccaggaaacagcggactttgtccatgattgaggaagagatccgagcagctcaggaaagggaagaggagctgaagaggcagagacaagtcttgcagagtacgcagagccccaggacaaagaatgccccatcactgccctccagaacatgctacaaaactgctccaggtaagtgaggtgcctcacatgagagacagatgccacagcagtctgttgttgttgattccagctcatgggtttctatgtggagcctcctctgtgtgtgtctggaataagtgttggggggacactggcatgagaattccagcatacagggacatgcaacaaaagtgtcaagagtgtcctctagaagaaccctgagcttgcatggagtttgccactttccagaggatgcaatagctccttctttgttgttctgctttggccttggtttattataaagaattgttctcttttacttgaaagcctgcctcttgtctgaaggagaggctgtttgtggcatagaaccagagtggacccatgtgtggactatgttggaatcagtagcttgaccctcagtatctagttaaacccatctgatttgggagttgtcctctactaactaaccccttctgaatgctggtttccttcccagcaatgatagtcatggcatggcattgcagactggtccatgcaaaatgcttttgttcatcttccgtgtaactgggtttttcttcttaagtcaccacaaagcaactactttggaatcaggagtggacgcatctgttcttgtcatgtgacccatttggaaaagttgaattactcttcacaaaggcaggtctttaatcccttcatattgcctgggtggtcccttttttgaatactttgtatagatggttgatgttaattagagtgctaattattattgctaccatatggataacagtgtgaccagttgtttttattttccatgtgaatgtgatagcaatcagggatccacagatcttcaactatggaaaacgctgctcaaagcgtggtccaagctagtccaggaatcatttgctactggttcattctaagttcagacatcgagagtaagcatttgaaaactcctattgcaatgtgatattgtcctgaaatccaagcgtgggatttttgtattttacaaaactattgcttcataatggactggtggggaaaaactgatgcttcaccagagaaaatttaagaatcgttaccctaaaggataattgttgacacttatcttggtccatccatatcttaatcttatcttgacacttggcttccatcaaacctacaatgactcaaggtcactcttctcattaactttttaaaattggaaagaatctccaacctaaagaaaagttcccaagtacagtacaaatgtctttctgttttgaatcatttgagagtaaattgccaacatgatgccccatcacccccaattttgtagactgctccctaatgtgggtctctgatgttttcatatgatgattttcaggttgtgcatctttggtaggaataccaccaaattgatgctgtgttctcactgtatccaaacaggtagcacgtggtattagtttgtcccattatggtgacaggtgtcaactctgatcacttaatattgattatgatcactccattgagggagtgtctgccagccttctgcacagtagttacttttttcttttgtaattaatatacattttgtagggcaatactgtggtattctgcaattttcaccccatttcttatcaaacttcatttatttatgtcggtatgatctcatggattcctgtgatattcaatggattcctgtgatattcaatggattataatccatttcttttattatttttatccgcaacttgttcagttacagctcacgggagccctttctggctaacttgtatgtcctttggagatgtccccgttttcctttgaatgcttcctcaatttctggcatcgcaagatattccagtttcatcttatactttcccaaccctgaaatcggtcgtctctctgaagagcactagtttctgatgatggagaatggtatttagaaacaaagatctgagtgctagctgtgctcattgttattgcattgtcactagccccaggcactctcagtggacagaattagaaattacacacatctctcttgaaaaccatgagtttgccctgatgctttttaattcttatttaataaaaagttcattcatactttctccctttccatatttgtgaccaccttcttgacaaaagatacttagtttttattatctgtaatatgtttattatttaactagccctccttcccccacactccagtataaccagtctcctgttttcctcaccaaacttgggctccgacatcattttccaggtggccactgccacgacccttcaccaacaccctccttaccctccctgggctccaacactacagcaggtaccatcttattcagcctggcctagtgacttttggactgagttgtttgggaaggaaaggaaagggaggaagaagaggaagagtgcagtgactttcttaatatatgccatcaaattggtgataaagtttcaacaaatgaataatgggggggcgggcacaaacattcagaccgtagcatgagtattttcaggcttctctgtctctatctcttaatcgaacccctcaccatattacctccaactttatttctagcacataaacaactgtctaatataaagacatttcaatgctttctcctgattcccccaccggctgttgtccatcaggcttccccaccaggaccgaggttgccttaaacaagtcagcatcctaaggcttgccactggcatcccagcaacccagtatcaatctccccagtacttccctctatgctaatgctgatctcttctcccatatcccacccccataggattgatttctggtccctacaaggggatggtaattcatccgtgcaagtctgttccaatcttgatgtcgtattgagtacaatcatgataatgatatgcatacatgtcattccttcatgtttatctctagaacatttaaagcaggcacccgggcttcccagaattacaacatgagttgaaagaaacggaatgtaaaatacaattttcttcctgttcatgcctggaaatctttggagtattgcttggctggccaacctccaagttcatgatcggggagaaggctgacacatgactctgagcagccaaactagacaattcatggctagggtcagaactcctggcttcagtggttttgtgaatggaggtgttaccaagttcctgcggcacatttcatatttcatgccagaagaagtgactccactagtttgttgtgtgactcagattgatgattggatactaggtgatgaaaaatataatttttaacttctctggtagaaatcatgctggtggcatgctggaatcctaaaaccttaaagcaaataaaatccactgagagccaagatgtggtaaggaaggagaaatcttctaattctttccatacaaaagttatctagacagaaaccccatccccctggtgtggaaatgctatttgtttttgcttttagtgcttttgcttttaaaagatggacaatgaatgatagaagttctgttttgaaaaggatatagtcattgttaatgaccgggtatctagaaattatcttgttggttcttattttactttttttttttttttttttttgaggcagagtcttgctctgtctcccaggctggagtgcaatggggcaaactcggctcactgcaacctccacctcccaggttcaagtgattctcctgcctcagcctcctgaatagctgggattacaggtgtccatcaccatgcccagctaaattttttgtttgtttgttttttgtatttttagtagagacagagtttcatcatgttggccaggctggtctccaactcctgatccgcctcaggtgatccgcccgccttggcctcccaaagtgctaggattacaggcatgagccactgcgcctggcccttatttgacttttaaaggaagaagctccacttaaatagaatttgagtgacatttgtttatacagaggtgaataaaaatgtatagtccctgctctcagggaacttaatggttcagtaagagaaacaacattaaacaaatgaggcaattttatgacagagaagcacagagacctgtaggagcacaaacaaggaagaccatatcatttggaggataaagaaagtcttccttccttaggaaattactgtctaagctgagaactgaaggggtaaagttgggctcagggtgtaggggagaaggaagggcacctaagagaggctcaaaaggaatagagaacttggcacatttgagatatttaagagtaagttaatggaagagatttaaaacaaaacagaaatagatttggagccagacaaccaagagctctatcaatcatgttaagggttgtagactttagagtttaccctatggtcagtgagaagccagtgagagtttttaaaggagtaattatctgaacacaaccccaagctgtcctgccttcactgtgagttgatggactaaatgtcttcctattgtaatgcatccatttcataggcttggattgagctcttcctgcttatgagcacttccgaaggcaggcgccatcttggtgaacaccctgtatgttatgtgaggggccatgctcccaatagtgtgtgcatgtgtgccctctgctgatggcacttagaattagagactaaaaggaagaaggccaggggtggtggtgcatgcctgtaatcccagcacttttggaggtggaggcaagaggattgcttaagtttgagacaagcctgggcaacatagcaagtccccatctcttaaaaaaaaaaaaaaaaagaaaaattacctgagtgtggtgacacatgcctgttgtcccagctacttgggaagctgaggcaagaagtttgcttgagcccaggtgttcaaggctgcagtgagctgtgatcgaaccattgtactccaggctgggcagcaaagtgccaaaaaaaaaaaaaaaaaaaaaggagagagagagaataaaggaagcacctttgcaggtacatgagcctgatttgaaggggtaactcacacagtgctgtaaaacacccttgaggaaagaattagggggtgggatatccaaacattgtattgaagttgcagttcaagaccttttcaaatgtcttttcatattggggttgccaacagttctcactttagtatctgtgtctattattagatatcctggtttcacttccaagttctaagtatgccagagaaacccagttaggtgatgatttgtttggttttttgagagtttctgttttcatgccagatgttgaatttatttaccaagtcagatcattcaccccgtgagacctacattatggagagtggcaaaagagaaggtgtagtttgctattaagttccataacttggggtatctgttcatgtcttctaatttgtggaaagatgtgatagttataaatgttacttttgtaagctgtacaggaagtgttgacttctgctgctgtctgtttagataagattagacatgaggtgatcattacattattataaagattcttaactgggtctctgttctttccccttcattatctgcaaatatcacaaaggaaagtcttaggaaaaatatgtttgcgactgtccacacattcttcatgaagcagagcttggtggagtgtgccatgctaaattagagccacatgaggcacagtttcatttgaggtgccctcattgctccatgggggaagtccctgtgtcagcatctgacagaaggattgatgatgagagagctctccatcagtagtacacagtgcctctctttcctgcaaggcaggcaccaactgtgcagcttgtaggagcccttctggctgtgtgaagctagctaaagcttattgtggagtgtccacagatggttattgtccaccaccatatttctagaacattctctggttacaaaagtctaatcatggtagttacaatttatcaaggccttaaagctgcatataatactagttatttcacacttgtcatttcttattttctcactgaatcctcccaacagccctctaagatacaaattacctcaactcttgaggccggatatatttctagattcagactttttctgattttagagaatttataaagtatatactattatttagaaaagtaatacaatgaacatactattatttaacacaactggcaggttctgggtcaacaccctgtgatcaaattaaatttctactctaaaacttgagaagaagaattagttacattaagtgggtaaagactaggagaccttcatgtcagctcatgtcaggttttgctgccaaataagttatgaaaaatctttcttttcagagttttttggatttgggaattatatatgaagagttgtggacctgtaataatattctttttcaaagaattactactagagcccagagagattaagttgcccaaggtcactcagcttgaaaatgggagagcctggtttcaaactcaggctctcatttgtctccaaaatccatcttctttcccctaccttctccttcccatttgttgagcctgctctatgaggtatacagtaatagcttctctctccaacctgtagctcaggttccctctaccctttcccaatcttatgcccaacccctgcattttcctgggtccttcttgatcctccttttaggagccactgtggctctgcaatccttcttttgcggtggcctgggtgtataaatttgactctcaggggccatgaaacagtgcttccctagtgacccaggatgattcctttctgctttcagaactcaattccaatgccccaaattacagtaggcaaaagcactcgggctgtccaaagatctgagcggatagccaagggactaacttagtccacatcagccatctagcctagctgctcttgtgagttctttttgaaagttatttcccaggaagaagctctgccatttactccagaaacaggttcattccttgaaaacttcgaaagaactgggtactcaagcaaggaagaaatttttaaatttgaggatgagcagggataagtgttcattattctgttaactaaacatgaacatttttggtgtactagggtcaaagtcaactaagttagttgactggtgatcattgagcaccatgactacgtactgttctccttgccttttaaaaattgatctttctgccttggcccagacttccctgtgttctctttatctaaatccagcaagtatgttttcttgaaaaatgcatgccatttggaaaggaattggtaagaaaagactatgttgaagctatgtttggcaaggggtgaaggtgtgcaatgaaatcaggacttttcaaagtatagaattccacattctctttagatattacccttaaaggcttggaaaagacaactgccatggttaaacctgcctgtcagcctcactcttctttttttttttttttttttttttttgagatggagtctcgttctgtcgcccagtctggagtgcagtggcgctatctcggctcactgcaagctctgcctcccaggttcacgccattctcctgcctcagcctcccgagtagctgggactacaggtgcccaccaccgcgtccagctaattttttgtatttttagtagagatggggtttcaccgtgttagccaggatggtctcaatctcctgaccttgttatccacctgcctcggcctcccaaagtgctgggatttgggattacaggcgtgagccaccgcgtgcagcccagcctcactcttgagatcctatgggcccagaagtctttattctgtgacaagcctgcagttacagcttctgggcagcagaactttggaaaaagcagaacgttccccaccagctgaattccctggtacaagcaggttctgctgttcctgctgattgtgctgggtcttcagatagatccgtgtgtctgggttggctcctgctggtgctgggccaccatgtgatgtcctcattgcctacttctgcatggcctctccatgctgcaagttagttaggggagcatcttatgaggaatcagactcagccatgcacaaaaacagatgcatagttttcaggtgacagagaggaggtgaatcaaagaacctaattcttgcaagttccttggtaagaaataggaactaatcaaaaccaggcttgggagcaggatgtcctctgtgactgctggggttcagggcagaatatgactgtgtcttttaccagccatagttacttgctgtgtacttccctaaggagactggcatttcagatctatttgatctttgtgtgctacatacttatggggtggaaggctaggaggtgaggtggggcagggagagagtgtatggggcagacaattagagcaccaaagaatatatgtgtagttcttgtaacgagattttctttctcatggccttgaaggtaaacttaaaagggttcccaaaatgtgtgtgtatctaactcacaagtattaccagtctctcttttatttcccattactcaagtataaatctatgtgcgaggtggctcatgcctgtaatcccagcactttgggaggctgaggtcagcagatcacttgaggtcaggagttcgagaccagcctggtcaacacagtgaaaccccatgtctaccaaaaatataaaaatgagccaggcgtggtgtcacatgcctgtaatcccagctactcgggaggctgaggcaggagaatcgcctgaacctgggaggcggaggttgtagtgagctacaatccctactgcactccaacctgggcaacaaagcaagactctgtctcaaaaaaaaaaaaaaaaaaattatgtgtgatggtcagggagaatatatgctaaaatatgacagtcacttctctggattcatatctcaagcttcattcctgactaccacttgctagctttgtgaccaacttacttcacctctgtaaacctcagtaaaataggaataaagttataccaacctcataaaaatgttgagacagggcctggtacataaaaagctcccagtaagagttattattgttgttgtcattacaacattacaacattacagttgctcttttgttttaagaaaaagcttagaggctgatcgcttgagaccagaagttcaagaccaacctgggcaatatagtgagaccctgtttctacggggggaaaaaatagctgaatttagtggtgtgtacctttagtcctagctactcaggaggcgaggtgggaggattgcttgagcttgagttcaacgctgctgtgagctatggtcatgccgctgaactccagtctgagtgacaaagcaagaccctgtctctaaaaagaaagaaaaggccagaaagccttagtagaattatttgtgagttgctcttttgcagcagttgtgagcctgaaataaataaccgaacacacatgataaaattgctttctattcctagctgggatttttttcagttacttccttagaattaacatttctcttagaaacttgaggtcaggaataatgagttttcagtagtccactatgattcgaaaaactaaagagtaaaaagtccatcattaaatgtactgagtgaataaaattacatgtattaccataaaaatgttttccttctggggggaggtaatcttcacacagccaagcccaccatgctagtagaaatgtatttgaagagaggatcttggtggagaattactattcaccataattttcattcttactgttttaattaacttttttcctttttggccttaaactctgcttgccctgtaagagcagagttctttctttccttctagagttttcatcatcttccagttgtgttcataggtataaacccaatatcagcaactcatccaacaacttgacttacctttaagcaataatatttgacagtttctcagacttgtttgccaagcagtggtatttctcatttctgagctaagtttataatctgaagattcatatcatcacattctcccacccctggggccttcaaaggaggagatgaaagaagaagggaccagctcttggtgtgcgggtcacagctggaaccgcacaagtccgtgcactctggggctgacaagcaggatgttcccttgtactgagaggaaacgaaattgaaaatgcaagtctgagctcatttctttctggtgacttgtgggtcgcttcagatgtttgcaaccttatcccaatgctgtgtgaagaaaggaggtcattgaaggaggccctggcttaggcatgtcctctggtgagtgattttgttcggttcagtttggtttttaaatacgagtgggtgaaggctttttcttttattttgagaaatgtggaaacaaaggctctttgatttaagacctcagacttcatgcatagagagagtaataatcacccaaatcataatatctgaccaaaattttcaggacttttggaatccccattcctggctttttaaaagttagacctgaaatccagaaggaagatttggacagtcagggatgacaatagctgtattctgagtgcatgcagccttttctcgggttctttgggtgggaggaattgcagattcttttctctgcctcctgtcagcacggctcgccacagatgcccaagggaaatccatccggcctggaaaatccagaagcacagccaaggcatggcttgctttctctggaccacagagtggtataactatttatgataaataaacaggaaacaccaatttatgctttcccactcatgatgggactaaactagctagtttggagtgaaactctttgggcttccttgctgcttagtctaccttgcaatgctacagtcttgtgagcaccaccattgcagagatgaacagtttttttccttctgagctcctctgggtatgcaccgcctgggatgatggaagggcttgtggatctgcctagtccataaaagttaaagcaagcaggtttacctgcttttctcagcgtgggctaataatatttacaagaaaacttttctggtttgttttatattttaaaattaatttgtgctgattgtagaaaaaaatgtaaaaagaatcaaaagtgattcataatcctactcccccaggaataaccacctttctagattttctccatgcccataggttcatggaagccaatattgggttgatacttgcattcgtttctattgctgctatgacaaattaccacaaatatagtagcttaaaaaatatgcatttagccaggcacagtggctcatgcctgtaatgccagcactttgggaagctgaggctagagaatctcttgagcccaggagttcaagccctgggcaacatagtgagaccttgtctctaataataataatttttaaaaatacacatgcattatcttacagctttagaaggcagaagtctgaaattcatctgctatggatgactatctgaccaaaataattttcagaacttttggaatccccattcttggctttttaaaagttagacctgaaatccaaaaggaggattgagaccagcctggtctcaattgagacccctgtcccgcaaattcgtatactgaagtcttaaccctcagtgtggtggtgtttggaggtgggccctttgggatataattaggtttacatgaagtcacagagtggagccctcatgacaggatcaatgcccttgtaagaagagatatcagacagcttctctccccaccatgtgtggacacagcaagagggcagctgtctgcaatccagggagagagccttcagcagaaaccgaccattctggcacctcgatcttggacttccagactctaaagttgtgagaaaataagtgcgtgttgttcaaaccatccagtctatggtattttatggcagctcaaacaaacctaagactgggctaaaatcaaggtgtcagtgggtagtgttccttctagtggctctggggaagagttcactttcttccctctttcgttctgtatgctgcctacattccttggctcatggccccttcctccatcttcaaggccagcagtgcagcatcttcagatctctctctctctctcgctgaccctcctagttccctcctacaattacatcagacccaactggatatttcaggatagctttcccatctcaagtacctaaacttaatcacaactgcaaagttctttttacctctaaagcaacgtattacaggttttggggattaggacttggacattgttggtgaggccattgttctgcccaccacaggaggcaacatatagtgttcatcttatgctgattgagtgtctgccatgtgctatgcacttttgctttctttcacacagttaagaagtggtgaactaggatttgaacccaggcagtctggctctcccgcctgcactcttgaactcctgcaatatatctacttctgcagtctgctttttctcttaatatagtttgaatattttctcatgaccttaaccattcctctaagtttgagagtctaaaacatcatttataatggctaactaatacttcattgcctaaatgagccatagctaacttaaccattcttcaataggaagatatcttggtgtagttaaaaaaaacacagtgctgaacgttcttgtacatgagctgtgtgcccatacttacttattaaatgaacttgggccagaaaagttccctggaagctggttaactactgtacattagacaacagtatttcctaaactgtttttcttcttttttccccttctgtattcatttacttactttaaaatttttttccccttctgtattcatttacttacttttaaaatgaggtctcactatgttaaccaggctggtctcaaactcctgagctcaagtgatcctctgacctcagcctcctgaagtgctgggattacaggcatgagcctctgcacctggctttttttcttgaggcacttaatagattctatgaagtgaggttttctggttaactaaacttaagaaatgctgcactcccattcctgaattagagcttcacaatcatattagcactaaaaccagaagtcctctggtaaacaaatccctctctccctccttgttttctttaacccagagtttcccaagcttaatttgaccaaagatttttttctttgaggcatcaagtaactatcctacaaagctaaggtcacaggacacaatgttagaaacacatctttggagtcaaccaagtgaagccacttaccctcaaactccttcaaaggcttaagtctaaaattactccagatggaatagtttgaatatgatcacgtttatgaaataaacttaaacgtttcctatcctccactcggaatttcagtctaacattgttgtagtggttccttacgttccttatagaggtcacattatacctgttccctgctctgtaaatgtcagggctggccatcagccaagaccaatacggacctgccctgaggtctacatggcactgtgtgttcatgttgttgtttaaggatagtgaccgatgtccttcaagagagccgttctggccgggcacagtggctcatgcctgtaatcccagcactttgggtggctgagacagactgatcacttgaggtcaggagttcgagaccagcctggccaacatggtaaaaccctgtctctagtaaaaatacaaaaattagccaggcatagtggtgggtgcctgtaatcccagctactcaggaggctgaggcaggagaatcgcttgaacctgggaggcagaggttgcaatgaacccagatcactgcactccagcctgggcaacagagcaagactccatttcaaaaaaatgaaagaaaaaaaagtgttctatagagtgttcagtgcaggtgaggaactggatggcaggatgttctcattgaaaatggggcagatttcaggcatcacaagctattgaatcattacaggtgaataaaccaatagcagagcaaagtttgagggagtaagcaaagctggacctggggttactggggaagttctgggtgagatgcacactggatcagtgaaaaagaagcaccaaagataaccatcatggtttggggagtctaatggggcatgtcctcttggccaagggacttcaaggggccttatggggtcatgaaaaagaatgtgattgagctcccaggcctgtggcacagactatttgcatcacattcatttaatgatcttcaagacccaaacagtggtgctgtctgcagtgtccactattgggggaagagcatccggagtgctgtcaccgtcctaatggagaggacctctggctgcaaactctggacctctgaggaagttgtcaggtgtggaacaggtttctctccagccttttggcagcctgtgtgattcctaagatggcacccagaattctggtgcctggtttgaaccatacttggggaggatcatcagagatcacagggcccagcagaggagcctggctgagctagcttcccttgatactgaccagaatgatggccggaagtctggggatgaggcatagtgtcttctctctctggggacctgtgatagcctctcctaagggggtagatagaaccagaacatgggctcagttatccaaagcgaccattctcagcccccttgttcctggaagcccctgctccagaactgctaagccagcctttctttcctgctacttctctgacctctagtggctagaactggaaaaacttgctcaagggatgaaatcatcaataagcaggaaatgtctttgatgttaaatggctgtccacttctctatagtaatccttcaccctctttacaacattctttctgcatacatcccatcatttaattcagccatcatcaacactgggtttgggctccagactgtgactgtcactgtcttatgtaacttgggctggagttggcatctgagcctctgtggtcatgacatccaggtgtcacgacatccaccctaactacattccagggttgttgcaaggctcaaatgacatgaagcctacaaaagaagtggtatataaatccgcttgttactccaaagccattgagtctgtgattctgtaagcctaaaatgttttaattcatatattttggtgaaggcatttaagccctttcctctgattctctatgggagattctgtcccaatccataagcatttacttgtggttgttatatatatttcataatggacttactgattactcaacaaacatgaattgcctacctcgtgccatgtaccacagctactgctgggatctggcaatgatcagacaggcaaggctctaccctaatggagtttgcattcaaatgaattaaggggattcatagacaggtgaaacatacccccctgtcctcaggatgacattatagcttaattgagaagacaaaagcttcaatagccagataagatttaagtcagtatgtgaaaatggccttcacagaaatataaacaggagttccactgtgctgtgtgtgaaagggagaagctagaagcaatgaatataggctgtgctttctaggtgtttaactctggaagagtggctggtgggaagtgatctggacacttgagaggtcaactggaaaatgatgaaaattaacctggtaattggtgtctatttctggtcccagaagagatgcaaaaattttatgcagaatatgcatgaaattgttcatctcaccctatagtcacattattctttgagattccaattaagtggtagctagaatcattagatgctttctgttctgaatattaaccttataaatattaactttgtcctcataataactatctgagggtaggtacccttatcatcatacccattttactgatgaggaaactaagatatcaaaagagtaagtaacttgcccaaagtgatttggctgccaagtcatggattcaagcccaaaccggctggctccagagcttacacgctcaccactgtgctatattgtttcttaagccttcaattaaaaagtcaatcggaattttcagagatacatactaagtgtgcaggagtgaggtgacctgaggtctgggattggtttaaaataattcagcaagtctaaggaaggaaggaagagccaattatgctaaaatcttgataaatgtttactctgggtgatgtttataatgtttataggggtcattatagcattccctaatttccgtaataaaaaataggaactgtttctagtgaacttggagattttgaaatacttattattgtactgttaatatcaaaagacttttcagttatctgggtaatttagatcaaagcaacaaatttcactgttattaatgtaatgtggccatgaaatgcagtgcccttttctgtatattaaaacctattttccacctaatccccaagtgtaacagctaaataccttaaaaaaaatcaagaagggtgtatcctgccaaacatatttgatagaatagcaaaacgtttgagttagaagagaccacaaagataacttcttccaaaattcccatttaaccgctatggcagttaaagctaggagaatttaagtgatcagcccacgattgaaatgggaatatgaaacgatgatctatagtcagtcacgtagccaagtactggaagagcaggagttaaaaacctgggtttcctggactccaggcctttgtatctctcatcagaaggaggttgtgccagtaaagggctaagcagcccatatggaaatgtggacaccaggcttcacttgtgattcctgctacatcaggcagttgccaagttagaagcctgggatgtaagatgaagaaaggtgagtccccttcggcttggaactggaagaggtcaaatggccctttcccctcccaaacggagccatgcaagccccatttatcttgtgtgttttatccacattccttgttcacaggttttagccgcatcaaccacaaagggcataattggaaaaatcataattgttatacttgaagatacttctcagaagtgcatttggggctctgtgtcaataaacccaccccatgaagggccagaagccagggccaggcatttcttgggagggagggatggaaatggtcttggtgagggtgcgtagagtcaccacaccactgttgaattaatcactgacctcatctctccatcctgaggattcttggaggacattgcgagagctaaaatctcctcattcccaaggctggtgtgcaccttttccattgcctttgttggtgtacacttcttaaggtctgggaggcctcaaaccccaatgtttcaggaccccagcaggtgaggtaaatgaataaagctggccagtgtaagaccggggcaaactgagaagaacaaacttcatccttattcaaaggttttataacactgggctgtctgcacaaaaagcctgggcaggtcagcagacaattgacttcctctgctatagaggatagaccctggtgaggaaagcaggaggcctgggtaccatcactggctccctatgacttgagtacagccttcccttggcagagcctcaagcgctttcatctgttaagaagtgggtctgtgagtctccaaggtgccaccacctctgacagtctaattctgtgatctgtgatagaatacatatctcaaaacaactggagccactgtcggtctgtccaacatatatttgcaaaatgcgtgctgtgcctgtttgatctaactgactttttggaacttggtgtccttgagatctttggatgggtttgtgcattaaccttaagtgctttgatccctgtaatataataaaatggcctacacttaaccatcattctggtaccactctctgtgtcagaggttgttgctcttttatttgccagttttctttctaaaagcagtcatgagcagacaagcttagaaagggtattttcttcgtgttgtttcagggaaaatagagaaagtcaaacctcctccatcccccaccactgaaggccccagcttgcagcctgacttagcccctgaagaggctgccggaacccagcggcccaagaatctgatgcagaccctcatggaagactatgagacacacaaatctaaaaggcgcgagagaatggatgatagtagtgtaagtttttcctcctttcctctttcacttctctgagcgcggccatcggtgtggcgtgtggcattccagttcaggcacaaatgtgtatgtcgttgtctggtcagcattagggttccagtatcagttttcatatatgtggtttcacatgcctggaactgggtttgggtttttgcctgtttcaaaaaaaaattgttgatcttgcagggagctggtcctttgctgccaagtatagctggagtcgaccagcaaggctagtgtgtaagatgtttggtgcatagaaagacagcatgcaagggccacgcagggagaaggttgcaagtgccctgaaatcatccctatgcacctgggagctgatttctaccattgcccagtagagattttatttctctagaaaaggatgaagatgctgttccttcaaagccgacactctaggcaatccctaacaatgttacagtgcttaaaagactgagtgtgtttggggctgttaacaagcccatgtgcatagcttgaaagcaaagagccagtgaaaatgacagttgaaaaccacatggctactctgctacacccaagccctcggaactttgcacataacgttcaaattaactgtgaaggaagtcacatgctctgtggtttctttctccggttagagacataggaactgttgctctacacagtcccaggagcctggagatcagcctcagggttcatgccaacctcctgtgggtcttctggcaccagtctcttagcacatattgaagtcatcacctcctcccctgactgcacttaagtcacagatagcttgggttggttgaggatcctactgagtttacctgagacagtcctggcttatgcctgttgtggtgttgtggttattaatatccccttcaactcttttgttgttgttgttgttgttgttgttgagacagggtctgtctctgtcacccaggctggaatgcattgatgtaatcatggctcattgcagcctcgacctcctgggttcaggcaatcctcccgcctcagcctcctgaatagctgggaccacacgcgtatgccaccatacctggcttattttttaacttttttgtagaaaggaggtctcattatgttgctcagactgttcttcaactcctgagctcaagggatactcccaccccagcctcctaaagtgctgggattacagacatgagccactgcacccagcctgcctttcactcttgaaagtgtcccagtttgggtgataaaccatctggtcaccttaaacttgaatgctatgaagttcacagtaagaattccctgctgttttattgccttttatatcctagctggctaagttaaaggatttctggagttgaagcccagatgctgaaagttgctttcaaaatatatggcggtaaagaaaggaagaaagcaaatggatatctggcagcctggcttctcacttggcatctcccaggctttcccttttgtttacacctgaactgcgtggagcactggctcagctgctgtattaggctgcagctattctactgggctcttcactgtattagacagtgggatgatgcccggccctgggtagctgctgcagacatttccactgctgaacctcactgtaggggagccagcagctcctttcgtgagcctgcaggatttttccctggctactcagtcactttcaccagcccttctttgaagccccacttcaaaggataaagtttgccttaagaattttctgaaagttaaatcattttgaaacttggtgctctaggtgtctggtttcttttctcccagtgactctgctctatacatcagcagttttggtagaatttagccaagtgggtgccccacactctgatgtggatggggaagaacaagtagaaccacttagcatgtgacccacgcgagtgtttgctgaacacactctacttgtcacttgtgtatgtcttttgtgttggagtgcagatgatagggaaaaatactccatacagaagggtagaggcagttctcactcatttcgtaaaggcagagggctggaagctcttttgtgcacacgctgacactctggcagccacctaacaaatgccaaccaggttgagtttttcctctgcatgaatgaagctgcttggaatcagcgttttaatatgctgattgcccttcacttacaaatcaaagaggcagcctcctgtctctatattttccagtaaataaacattttgaaaaagaaagagacctaactaattaagctgttaatatccctggatcttggattcaaagccaaatgttttgcactgttattgctattacaacagaaccaagtttgctgttgttgaaaattcttaggatcaggacaaaatctaccaatccactatatgctcatttaagagacccaaatctaaaacaacaaattcagattgcttctaaagcaaagatatgatcatcagtcaggcttcaaatgagagccttctcctagcccttccaatttaggggaccttttctcctgtatctgtgtcaatcactggtgaatgtgttgaagtttacctgtagggatgaacaaacattcatttttttcctaaccaatctgtggccccttttccattttttctttttctttaataccagaaggatagtaatagagagcagatggattgctggggggatgagttgtgtaactggcttacctatccgtagaagcataaagttaattctcttaaaggtaaagtaattctggtctctagcctccatttacatacactattctcacagagaaacatggcttcttagactctccaccctctaagcacctcagtggctcacacctacacacccagcatctccccatgttatgcagcatcacccctggcacctccatttgccaatattttttccagtaagccacttggcagcattttggcatgccgttttggagatgataaaccacacctgagaatcaatgcctgtcgcgtgattagaacacaaccatgtgtttgcccatcgaaagtaacagttatttgtgaattgagcaaaaataattcttattttttattctttttaaggagaaggcagagttaaaaacaagacaggcgctgatcattggaatgtgtataaagtgtgatatgttagacacaatggtatcgaggagagtgaaagacagaaggagaaagatagaatgtagctacggctgaagttttgctgagtgagaaaaactgatctttgccatcaaaacaagttcagtgtcccccgagcccccatcaggggtgtggtggcctctggggtcctgtccacagggactcagctcagggccctgctctctccagttttccactttataaaaagtcatatgcagagaggcccctggcttatgggagtcagggagtggtgttatccaaaggttgtccccaaccagccatatttgttactagctcagaacttgagcaaagtactccctttagttgccacagtcttcacccacctgggctgatttctttgtcctgtatattggagtcaccaatgagtatctccagcctcacttattaatggacctcttggctaattctgagggcaggaggattaccatccccacccctacccacttacccaaggctgtttaccaacctatgcaaggcctttgtgtgaattaggaaaaaaaaccacccttgttcctctatgaagatatgaagatgcagccctgcaccagccacacatttggggggtagagtaggggactgggctttagtaccattcatccctttagtctgatgcttttgtgcagtgcacacaacacacacccagatgcagcaatcctattcatattgtgggtttctcttatctggaaatgttctcttatgtggaaatgtccacttatctgggtctcataccatttctgctcagtcatgcaattcataatggactagtgaatcctagtttcctaaagggcttcttgatgccttgcaaagcgactgcctccaaggtggggttgcccactcatggacctggaagacatttggatcagtgggcacaaatgatgggctatttggatgtttttccttcaggcatgaagaacccctctaggaaactctgattcattagtccatcctgagtgacatgactgtatttaggcaaacagtatttttccagccaattgtttccctaacctgacctgagcctcagaaagtgaagatgatgggtcattgagtcaatgatgctcatgaacatctcgagggtttgctttgcctttctcagttgaagggatgctgaccagagtccaaatcacagcctcctggatgttcagccccatctttacttttagcgcaggatctgccctcagtggggttttccagtgtgctctctctctctttctcatcccatgacttcattactgagaggtcatccaaccactctgtctcatcttagaacaagagaagacctcgtcggttttcctgggctacgtcaaagctgagagttcctggcacacattacccttccagaccaggacatgcattgagagttgtggccatactctcgctcagtgtgtgaaggaagcctatctgcctcctgtttccccagacgctacaggaagctcagtgatgccttgtgcttccctaactctctcttacgttctcactcgtaccctagtgaagatgcaaaggagagagaagagctcctgacttgtcagctcccagccattagcccaatcatgacagaactataattcctaagtgctacatataagaagcagtcagcaatcacagatgtgtgatcccacctaactagtctatggctatcaatgccccaaaccaataaatgctttaaatgccccaagcagtgtaaatgtacgctcattaccataattctggagagggatgtcccaaattggtcctgccatctcattttccatagtcaggccatttttttctgtactttgagtaagacttttagtcccctataggaactaaaggatcatttcagttcctaagtgctcatactaataatcctatataatcaccagaaattgctatcaaaggatgatcccactctcaggaacttacccaggcccccagggttctgacgagggaggctgtgtggtctccctaggcaagactacccttaggccggtttcagagaatctgcctccacaaaccaactgctgtgattaggatcttcttttaatggaacaacaggttacaagacggctttggggttcagagaagcctacgggaagagaaaaggctatttggctacagactctagcaaatccaaaatggcccccaacgaccttgctggtgggcagctgattgtgtacagaggggaaggaatcttgttaattcaaagtacagaaactgaaagcaacgttttgaattaacaaagtacggcttatctgatatttttattagtgaacaatagggtatctagttgctgcaaagaatagacttataaataaactaatatcagatggagaaagttttggcatgggtgtagaatggcctcctggtattacttcccctcccatcctcttctggtgtggtgcctgttcccggctagggggtgttctgtaagtgtgtcactgccatgtactaaccctggtcttttccctctctgccagtacacttctaagttactgtcttgcaaggtgacttccgaggtacttttcaatttgtttgtcttggtcttactgaatgcatgatccaggtgcatgctgttgtggtttgccatttcctgatgagttaaacgaaaatggcaagaaaaatgacttgtctccatatgtatttttttgtgcctgttctgaaatatgggactgcctcgaaatgttggagtccatgcaacagtgatatacaatggtgtggtttgctgtgctgtgctgtgggggcgagtgggagggtactggggaagaccttgcctgctcacgaatcttgaagacgtttggaccagaggacacaagtgatgggctattttggtttttaaagtttctttaggcattaatagcaagtatacttggcctggttggaaaacagtgcagctcatgcagattgagctatggattttcacccattctttgtttaccttaacataaagctagaaagctccattctatagatttaagatgaaccatcctaatctacagatttatcaaatgtaaaccatcctagacctccctccctccaatctttaaacgtgtatttttattttagaaactctaagccttgatttctccaaaagcctccttgtttaagagacaaggtcttactctgttgcccagggtggagtacagtggtgcaatcatagctcactgtagccttaacctcctgggctcaagcgatcctcctatctcagcctcccaaagagctggaactactggtgtgtgccactatgcccagctaatttatttttttatattttttttgtagggacgggggtctcgctatgttgcccaggctggtctcaaactcctggcctcaagtgatcctcctgcctcagcctcccaaagcattgaggttacaggtgtgagccactgttctcggtccccaaaagtcttctttccttttacacagatttcacaaatatatgtgctataaatatgtgtgctatgagaaggcataatatttttctcttttaatttttttctattttgtccattttttctttttgctgagaaagcacaatatttttcatatttttatttctgtattttattttgattttaaaagaattatttcaaatatacagaattctagagagaatcattcgttcattcatttaacaattttcaaggctctactatgtgtcaggcattgttctaggttccaagaatacagcagtcaacaaaacaagttcctgatatcatggaactggcattcagaataatataagataataaaataataaaacccacctacccagctttgtccattcttatcatttcatgatatttaatatttttaaaagaaattagtattgcaaatacaatttaagccctctcgtacttctcccagttccctcctcccttacaatctcgcagaggtaactatttttgagcttgttgttcatcatttccatgcatggttttatacttatactacaaatgtgtatatacataaacaacaccttatttttgcatgtttgaagacattctataagcggtaaatcatgttgcagtatcttctgctcctgactttgttctgtctgcattgttttgagatgtgtccttgttgatcactgtggctctggttcattctttataactgctgtatggtattccattgaatgaatatatcactatttattcaatcttctgttatggaaatgtagactatttccagtttttcttaccgttagaaataatgcttttatgaatgttattatacatgtctctttatgtacctatggaagaacctgtctctatatttaggagtagaagcactggctagtagcctgatacatcctaacatttactagatattgtaaattatttttcaagttggttgcattaacctgtagcataataagttttttggtctctctatttagccaaagaattatatttaaatatagagctgacctgctgattatcagtaattttctttcataagatatcaaatgaatactgagaatatcattctgtaccttctttaacgtctaattgtggttctcatctggaggatggcagtttgagaattaggactaagcccgtctcccctttgagtccatttaaaacaatgaaaatctggtcaaatatatccaaggaagatagagttgggcccactctgtcttcaatttaaaagcaggttggaagatgaaatataaatattaatatgaatagggtgatattatttaacatatctgtcttttgtttcatatgtccaaattaaaattttctatattgattgctttcaaagttaagcaattcacttgaattccctaagcattagagagaaaaattaatattaaagggttgttgagagataattgttttttattccctaccagacctgaatgtgaatttgtgaaaacaataaaactttgtttatttatttagtttacttttttttttttttttttttgagacaccgtctcactctgtcacccaggctgaagtacagtggtgcgatctcagctcactgcagcctctgcctcccatgctcaggcgagtctcatgcctcaacctcctaagtagctgggactacaggtggcagccaccatgcccagctaatttttgtatttttagtagagacaggttttcactatgttggccaggctggtctcgaacacctagtctcaagcaatctgcctgccttggcctcccaaactgctgggattacaggcttgagccactgcacccagccacaataaaactttaaatcagatcgttttttgttttcccttttccatttccatggggagtgttgattgctcttctctggtgtgtctccttctggactccttacagccattgggcagccagatagtctggtggcctcaagcatcaactctgcacccagagtgcagagttcaaatcttggttttgccttctgctaactgggtaattctgggcaagttacttaacctccctgtgcttcaggttcttcatataaaaaatgggagtaataacagcataaatgtcatagactagtagtgaggattcaaacagtaacatcgtacttaggacatgagtatgacattattagagccccagagacatatgcctttttgcccagaaaataaaggaatgaactttagaaagtgaagttaatatgcagtaataaacaagtaataaaagctctaaatttgctagagattcacacacacacacacacacacacacacacacacacacacacacacgtctgaattaattacagaacagatactcattcaaataccttgatttttgaatcttctgaagaccagttgtggtgcagctttactcccagacacccctgggtcataagccttatgaacccaaagacagctttatatcaagattgccaggtatttcagtaaggatgtttattttcttgtctgtgccattactagaggctttagatttcactagaaatttattgtatggccatggtaagtgattgtatgaccatggtaaatgggcatacatactaggggaatgaattaagaaaagagagctcattgttggtataagtgaattactggggctcttgacaagtagatgtccaaacccaagctatactaaacgtttccataattatgagtattatttttctgcccattatacttttcgtcactaaactccatgagggaagggactattctatcctcaacacgaagcactgtgccttatacttggtaggaaactaataaatatgtgtaaattggattgatagatggcttgtaacaagagttcctaaagagcagagcaaactcaatttgctcaagttgtttgagaattaaaatagggtttaaataacaagacaaagaacattccaagaggatggggaccatagtttttagaactttagatttatttttagctttgatgtaaacctttctgtttgtatctgcaatctgaaaggcaaagagatgatccttttatacaatgtagagttctttataaaacgccctatttgtatgccacttcataatttatatatccctttcacatgatgatagaaataattattccatcatagtttgagagcttactatgtgctgggaactatactttacatacattgcctcattgatttatccgtccaactttatgctgtagtttttatgatccccattttacatggggatactgaagcacaggggtaagtgacttttccaaggtcatgaggatttgaagtagacctgcctggacttctgagtccacagtgccttctgagaaagcctgtgaagtggggtagctgtgttctccatgttatagataagaaatgtgagataaaagatgaacaacaaaggacaaaactggaaatagagcccaagacttccacgtgcagtccagtgctgtttttcagttccatgctaccacacattagactattagaaaatttctctatttaactatacagatttggaagcatgctttcctcctactaatttgttattcgtagatatctgtggatattgagtgagtgaccgtgatatgcttacatacaaaacacattatgcaaaacacacatggcttgtgtgcttaacaatgcatcattcattcagcaaacgtgactgaggaggaaaaggggaggcttcacagaggaagatatgttgaagctctgggtggtccattcctttgacaaaggtgcagagaagcaggttgagatggacccccgatctcccatctacccacaatctgcttatgtctgggctcccacctctgcctgtaactgcatctccttgcttctctggagttgccaactgtattagtccattttcatactgctatgaagaaataaccaagactgggtaatttataaagaaaaagaggtttaatggactcacagttccacatggctggggaggcctcacaatcatggcagaaggtgaaggaagatcaaaggcacgtcttacatggcagcaggcaagacagtgtgtgcaggggaactgccctttataaaaccatcaggtctggtgagacttattcactatcacgagaacagcatgggaaaactcgctcccacattgaattacctcctatgagtccctcctgctacacaaggggattatgggagctacaattcaagatgagatttgggtggagacacagccaatccatatcaccaacatcactgtcccttgcctaactgattatatttagaatgagcagtgccttcattgcagtttgcataatcaaccaatgttggctctactggacttttcttcaaaatcagaaactgtacatcctaagcaaatgccagaacaattggcaagaatgcctggacttgttttctgcatggtcatgaaatagaaccatttttcatatgttggcaacctaaatgccattaatctggaatctcttcttgatcaaactgaaactggaccagataggctgaagtctcctctcgggattccacagactgccctagtgaatgggaggaagggaggctctccctcagtggtggtgagcctacttgtccttagtgttgtcacctttcatttcattgattagcatgtggggtctgaagttgcatcagaatgctgagattgcttctattgatccaagaacttttttttttcatgtaatggcttttttagtttaattttgccaaagtaggtttttatactataaatatcatcatggcttatataggtttgcaaagcttgatggactgaatccacactggtcccattgtttggaattattttctggtttgcttgtttatgaagagactaagaccatctatagtgtgctgtctaatatggtaatcactagtcacatggagctattcaaattaaaattaattaaaatgaaataaaattaaatatttagcttctcagccacactagccctatttcaagtgctcaatagccacgtatggctagtggctaccatactggatagcagagatacgttttcatcattgcataaagttcaattggacagcactgatctgctgcgtgtagggatctgctttatctgaaaacttgatgcagaatcacggctagttcaaagaaacttgcagaacatttcatgaaaattaaatttctctatggtgaaaactaggggtcaagtagcagatgaatactggctgtgagatgaatgcataaccagaacctcccattcccctttttccagcgtctctcctatctcccagcagtgctttatcactttctcctctcaagttgataaagagaaaggaagaaagaaacagagaagtcggtttatgttcataattaacatccatgaactctgcataattttttcccctctctttacaggtcctcgaggccacacgggttaatcgaagaaagagcgcactggctttgcgctgggaagcagggatctatgccaaccaggaggaagaagacaacgaataaacttccttcaacccaggaagcgtctttggtgcttgggagaccaagaaaccaagaaattaacaactgaaagcattttaatggactatttattaaagtgcaaacaaactcagcaatccttatgtagaccagaagctgcaatatacaatgatgaaaatgaaacgaaaaggaagtccccccatcagactctggacacccaggaatcaaaagagaaaggacttttttggtgactcaatcccagtgtctggtttggggccaatctacaatggatccaaaaggacaaaacatgttacaagcaaatcaacatagttgctgcaggcggaactgagaccagcctctctgggcgatgaaggacaatggtggtagggccacttagagagcagtagggcccaggctggtgcagcctacatggcacaggatatttccctgcaccagtttcccacctgtcacttgcagcatcagagggtgttgcattaactccattttctccagcagccataaaatgaatggcgtttctctccatatttgcccagaagaggcagttatgattccacttctcctacatttaattatttttaattgagaacaactcatgatcacaattcataaaatccatattttaagacaatagttcttcatgtcacaaacacaatctattctacatgaggaggctgagaaaggggaagagaaaaacaaaccaaatggatgatgttagctttaggatcgtgtctgcttataatattcactgatctgcagtttatgagaacacattttcacagttatgtttcttcataggaaaactatatttagtgggcaacaactatttttatgatgggatgggggagtatatacacgtatagaatctgtacgcgttgaacaacttggttcaagatggtgggggcatttttagagcggcaataattgaaaaaaaaggcgaactctgccttggagaggtagatgataagaaataaaaaggtgtttataactattttgtattataaagtgggccttagagataggaagaagaatgatggattccttttggatcaatcagaaaggaaacacgaaagaaaagtcaggaaggtagagagagaaaaagggagggaaggagaaagaatgggaataaaataaggaggtaagagatactatttttgctgagcaaccagtgtgtttcaggatgatacaaagaaaaatatagaatagaaataagtgcaggcttggaatcagctacaaatcctaaagatggggtgtgtgtggatgtgtgtgtgtgtgtgtgtacaccattgtgtgtttgtaaaatgtgtatgttcatgagtaagggtgtgtgtgtgtgtgtattaaaattccagagtgaccgtggcacttgggtgtacaggtaattcctccagagctgtttgctggcttcaggagtggagtgagaatttcttttttatgaaaagggatataaaggcaccgagctgatgcagtatttgtaatattaagttgacctaacaaggtatttgcatgagtcacaattacaaagttttgagcggttttgtaatttgacatttaggaaagtctcctatttattctcatactttacattcatgcttagtatactatagaggatgccagctttaatctttctgtcatttaaagcaatatgataagggtattcaataattgggtgccctaaatttctggatgagaaaattttcaattctggccatgagaaagaaaaaaaaataaacagccttctttttttttcctttgttttaaaactgtggttttttaaaaaagcaataattaactcagacctcactaaaaatcatttttgtttttatattgttatgtcataagctctattatgttattctaacaagtagcaatttcacaaaatttgtatgtagatgttaacgcacatttcctttgcttcttttattagactagtgttgactttggggggggacatttattcacaaatgagaagtaggcacaaagtaaaaaatggaaccatctactaacaaggatcctttaaaactgccaagggagctctaacttgaagccacatcctacagatggcagcccaaatagcacatgggcaattggcaccatctttatatggttgagtctcctgaatattttgaatgaattctcaacaaaatgtgctagccactggggacgcaaaacaagtaagatccctgttgcaagaaattcattttatagtgagggaggttggcatggagactaaaattctcaggaaaatgagatccgtgttagattagaagtcctgatgtgaaatgggaggactcaggaaggaggatcgtctttacctgaggatttctagccagaggtcccagatgcctgggctgagaacccagcgataagggggcgttcccaaagcagacacagggataagaacagaggaggcagcagcattgcacagccccaggcacagtggcagttaggatggctggagagtaggatagttctatgggttgcccaaaaaatgtgatgcgcttcatgttttctctgactcatggatctggtagagaccatagacatgatatagactaacttccccatttttcacaagaggaaaccatccttatgacttaccttaaagttttttgttctgttttgaaggaaaccatgtgcttcatgaaacctacagttgacaagagaatgtacagctaagagaaaagcttaagaggccacactattcgcggaatggctttagaggcagatgaagtggtctttgaccacagttgattgaaccagagcacttattgcttaaagaataacagagttctagagctgggggttcttgggccatgctccgtgtgtggataaggaaagaaatactgtttctgggactctcccacagtcacaaagctgttttcactgtggcccctacatctcttaacttttgctattactcctatgctgccttccggattactgctgtctatcttcttgctccactcactgaagatcctattataatcccatgaaaatgtaaattacagtttacttgggagagccagattttctctgtgctcttgagttttttattcattcaagaaaccttgggccaccgctttgtacatagcaccgtgctaggctctgggatcccaaatggacccttttaactttctgaagatgggaccgtcccctggaggaaagtcattcctgcctaatccatcgagagaaagaggcttacgaaaaactttgcctctgatgctcagccccacccccaaatagcacacaagcttgttaaccccacctcttacaaaatgtttagattctgtaggtgttaaaagcctttctggaagtattgcattctgccgtgtttataggtgttcactttcctccagagctgattaactactgacatgacttggctttctcatccagaaattatggaaacagggtctgtcagtggcaggaggccgtgctgtgttttacttggatgacacaatgcagtttacttgcctcttcatacccatgcatgctgctcaccctagacaatgacatataagccgtatatagatcaatgtccacatatatatacacacacacatatatatatataaagtgtaacaaggaacactaaaacagtgttgattcttgtctctgaagacaaataattaaaccttttttttcccaactaaagaatggatttaattaaactatgtattgaaaaaaaagtagcctaagtgttagagatggtgaatatattccattttagttaaagaacaaatttcctgaattttaagcattcagtgagctgccaattttgattttgtgttgctctttacccaaattattttttctttgtttttctttttttgggggaggaggggaaaaaagcagcaatactgtgtttggaaattatactctgtatctggttttcctgtgtatgttaaccacttaaatgttattatcctgctttggttttagagtgattgtgaggcattcaatgcaagtatacagttattttctcattaaaatccaatgtgtgttgagtttttataaataatggctgcttgtttgaccgtgagggaggttggaagactgggccaaacagtggcacgccagcgtcctacttggccgctactgtgtgacagcttctggttcctcatgtttgcaacaaaggaatcaatccgagctgagggggcactgctgcaccaggctgttcccacagcccccttttcaatgctgtccccagccaccctggctagatgccagaagctgcaagtgcctcttaaggacatagactcgaagccacagcaagagctggacaaacagcaggacgaacggtaaactccagccttgcctgtagcttttggctctaacctttagaatacattatgagcaccggccgggcgcggtcgctcacgcctgtaatcccagcactttgggaggccgagacgggcggatcacgaggtcaggagatcgagaccatcttggctaacacggtgaaaccccgtctctactaaaaatacaaaaaattagccgggtgcggtggcgggctcctgtagtcccagctgctcgagaggctgaggcaggagaatggcgtgaacccgggaggcggagcttgcagtgagccgagatcgcaccactgcactccagcctgggggacagagccagactccgtctcaaaaaaaaaaaaaaaaaaaaaaaaaaccacattctaagcacctgtatttggctctcctctgcaaggaatagctgatggctacatgttgacatgaaggactccttttgttgtattcaacataaagcccctttccccaaactcttactctggtttctttattttcctactcttcgactacccccaactctttttctttttctttttcttttctttctttttttcttttttctttttttttcttttttttttttttttgctagagctttattgtggtataatttacttaacaaaatttattcatttcaagagcatgcgaagaccacaagtttctcaggaagcgtcctcccttctacttcctccctcccgcttcagtctccggctgctccatcccatcaccgagccctgggcccctgacccctgaccatcagttttcctagtctttccctcggcccctcctcttcctggtacttcctttccagctgcctttttctctctctccgcatttgtaactcttccagcctttttctccccaggatttccaaccatatcttcctgttctgagcatctgggggtgttctgtggcacctgtcaggggtgatatctttcaacctctaagtggtgagagttctgaatttggaagtgggggcacccctttaaaaatttgatcaaagtctagtaacagtggataacacttgtgaatgtcactgagaatgtgacaggcactccaggctctccatgactatgatacatttatatttatatttatattgatttccattttacatagtaggaaactgcagccccgggaggttagtttttcaatgcatagcttgtaaatggtagtgcttgcatttgaaccccggctcttaactgctcttcccacagaagcacacattggcagcttcacatgcgtgtgaagtcgaaatgggcttgcaccatctccccgcactgtactgtccaggaaagaggctctcagggatcaaagccaaggctgtgataggagcccaagtctaggggaagagtgaggttttggtgggagcaacaaagaactttcttcctttggatgaactttctctgggctcttctcttcgagatcatctctcccaggagatggtgacagcagatggcccaggcatcgcagctgccaaaagaaaggacccaaaattgactgcaaatagggtgataaaaatgtgataaaattaaactgtggtgatggttgcacaattttatttttattttatttatttatttatttattatactttaagttttagggtacatgtgcacaatgtgcaggttagttacatatgtttacatgtgccatgctggggtgctgcacccattaactcgtcatttagcattaggtatatctcctaatgctatccctctcccctccccccaccccacaacagtccccagagtgtgatgttccccttcctgtgtccatgtgttctcactgttcaattcccacctatgagtgagaacatgcggtgtttggttttttgtccttgtgatagtttactgagaatgatgatttccaatttcatccatgtccctacaaaggacatgaactcatcattttttctggctgcatagtattccatggtgtatatgggttgctcaattttaaatgtactgagaatcatacacttgaaatgagtaaactttgttaagtaaattataccacaataaagttccagcaaaaaaaaaaaaaaaaagaaagaaagaaagaaagaaaagaaaaagagttggaggtagtagagggagtaggaaaataaagaaaccagagtaagagtttggggaaaggggctttatgttgaatacaacaaaaggagtccttcatgtcaacatgtagccatcagctctctcactaatgaggaataaagcttcctctccaggctgcctccaggaaccaggggcagtggtgctgtgaccacgtatggattcagtcctggtcctgtttccatccatcactactaacatctggaggcctcaggcagaggtagggatgagatttggcaggcaggcgtgctgggaaggaaggaactcaggccatgtgtgaaaaagcaagtctcctgcaatggtagaggagggtacaacactcacaatggaagttattttttgggatgctctaaccacaaaactaccaatgttaaaaggcattaaccctttacccagtagagggcagttatgcagggtctttgctctgtgatgtgtatctgtgggaagggatgggggcctgtgtccattacccaggctcatctcccctgttttgtatttgtgacagaggctgtcattgtgagacacacaaggccatgaggttactttggagcactgctcattttagttaggggattcctgggccatgagagggcagtgactatactcctccctacacggaactcacaccaaattcagaattgagctgctagggacatagagaacaaatgggaaattgaaaaggagaatgcaaaagattttaaatgtacaagatgacaccaagtgaaaaaatggggactcaggaaatacctggagatgccacatcggcaatttctaaatgttgcccaagcattcacatgctttctctgggagaaagaagagtatttgcatggtgcgcattgtttcatgttgcgaagacatggtgatctcaatgtcagttaaccttgatgggagagttatccaaactctggatggagagttctctttgttctaagttcaaagtgggtggactctggacaactggaatgagtctactgctacctgagacaagtaaaaacacaaatcagtttggtttttctctgtctgctcatgtatggaacattcagtctctgcagcggtcttcagctggttatatcaaagagcctctggtgagccctggctctcaaattggagtgagttctgcatcacctggagggcttgttacaaatctgggccccatttctgatctactgaatcagatctactgattctgggtcccatcccagaatttctgatcagtagatctggagcgaagccccagaattttctacctagctccctggagatgctgctgctgctggtccagggacctcctttgagaaccatcggtctagagtatgagaaatgaatatgtctgggcctgccacttatgtttgaaaatgggggaactgatacatgactgataagctgcaaacacagccacgtgtggttctggggtgttgtgaatatttgttgggggcttttgtgtgtttgtgcagcctaccgactcaccattttgtgggccttggtgaagcagaactttgactccacttagattctcgaacgaggcccctccaactgtggctaaacagattaagaagaaagtgggggaaagaggaaaatatctctgtatgttcagactttaatttcagggtaagatcaaggaattcatttgaccactggaagaagtttttattatgtgggctgatgcacaataacataagtttggactttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttaaccaggatggtctcgatctcctgacctcgtgatccgcccgcctcggcctcccaaagtgctgggattacaggcgtgagccaccgcgcccggccaagtttggacttaataacataaggaccaataacataagtttgtttgagtgacatggttacataatttgagatgagaagcaaagtaagaagttattcttatttggtcgagggcagcacatctcaattctgactccacattagaatcacccagagagttttaaaatttggattcagttgacatgggttggggtccaggtattaatatgctctaagagcatcccaggtgacccatatgcagcaagccttgagcaataccaccctgtgcagtggctctaacctgtgcttacattaggatcagctcaagtgattttaaaaatactagtgctggctgggtgtggtggctcatgcctgtaatcccagtactttaggagaccaaggcaggcggataacttgaggccaggagttcaataacagcctggtcaacatggtgaaaccccatctctactaaaaatacaaaaattagccaggtgtggtggcacatgcctgtaatcccacctacttgggaggctgaggcatgagacttgcctgaacccaggaggcggaggttgcagtgagccaagatcatgccactgccctccagcctgggcaacaaaatgagactgtctcaaaaatcaataaacagacaaaccagtgcttgggcctcagccccagatattctaatttatttaatctaaattggtctcagacatgagtgtgaacatgggtatggcggcacacgcttgtaatcccagctactcgtgaagctaaggcaggagaatggcttgaaccccggaggtggagtttgcagtgagccaagctcatgccactgcactccagcctgggcgagagagcgagactcttgtctcaaaaaaaaaagaaggaatataacatgtggtgaaataattgatcagcatacatcaaatacatataaaatacattaaatgaatgttaataggtggtgccataaaacaaaatatttaaatagataatacaggtaaatataaacaaacaaatgtatgcttgtattgctctgtcaccaggctggagtgcaatggcaccgtctcggctcattgcaatctctgcttcccaggttcaagtgattctcctgcctcagcttcctgagtagctgagactacagacgtgtgccaccacgcccagctaattttttagtatttttagtagagacggggtttcaccatgttggccaggctggtcttgaactcctgaccttgtgatccgcccacctcatcctcccaaagtgctgggattacaggcataagccactgcgcctggccgtttctttctttctttttttttttttttaagtctcacctggaagcaggcagctagttcctgcacagaggtctctggacaggaccctcaaatagactttacttttgcaaatgtctgcccatcctcacccgaccctccaaattcaaaggaaggatatgagctttccctgaggttctgcaggccacaggatgcatcctttgttgccctatgattgtttgactcatctgtcacctccacacctaagaatgctgggcactgggaggaatacagccaagattgggttttttttttctgtgccctgcagcctctggtgtttgccagtggctgacacaccacaggtggacccaccttattcagaggcaactcttgggatggatgctggttggcatggtaacactgaaggattctttttggaatcctgggcaccacagtcatattgcttgttgctacaccctttctgacagtttgagttaaagcagaatcataaaagggacaatgctaggagaagcaataaaagaagagcatcacatgccaccgtttctaagggtctcacttctgaacattttattatctctgcaattagaatgtgtcttacaatccctgctgcgtgggcacagacatgagtacctggcctgacctaagcaagggaaaacttgggtgtggctatttctattggggtcaccgtaattgagttttcagccttgctggccatgcatgtgttgtttacatactaacccatgcaatggaaggcaagaggaatggacaagccttagaatagattttaaacatttcaaagaatgagaagctattgtaaataatttgttcatcatttggatcacttttaggatggcaagcatgagtttgatggaagctgcctgcttatttaactatgagcttagtccagtgggaaagtgccagtcaccaaatttacagaatgggtatggctgacttggaaggaaataccagattcaatagtggagtacccccttaagaaatactgtgctggcaaggcacagtggctcatgcctgtaatcctaacaactttggcaagctgaggcgggaggattgcttgaggctaggagtttgaaactagcctgggcaacagagtgagactgcatctctacaaaagcaaaaaattagccgggcatggtggcacacacctgtagtcccacttggaggctgaggcaggaggatcacttgaacccaggaggttaagggtgcaatgagctacgatcatgccactgcactccaccctggacaacagagcgaaatcctgtctcaaaaaaagaaaagaaatactgcactgacacacatggccacagaggatgatcatgtgtataaaaatgtggaaaaagaactcaggagagctagactttaacataaagatgtcttaggaatacctttagactttaacacaaagatgtcttaggaataccttggccaatttattttgtttgttcttcccttttttatgcatgcacaagagtgatgtatcataaatatctatatttaaataagcccaaaggagctattcaatgggcacaaaataaacattctcagtgatcagagggtattgggttgtggtctaaatggcagtgctttttcttaatggttatatttagaaattcaaattccaattgatggcgtatgagatttgatgaaatgtggtaatagggcagctacaacctattacaactatatgctaagtcatgttattcctcccttttcacttttaagaaactgaagcacaaatagttgaagtgatgactcgcataaagtcatccgtatctaggcagtcttaccaaagtcagagttcttaaccacagaactgaaaagaattatcagtgaggcaaagacattttaactttgtgttgaagctcgaacaagagactatagtcacctctcctctgtattgtgttgagaacaacacaatttctctttatactgagaatgtggtttggggaagagcttgagcttattacacctggagcctatcatctctctaaaggtagtaaggg

SEQ ID NO: 1319 - DNA, 4440 bp, Homo sapiens
tccagaagcctccccagctttctgaggatgatatctggctaaaaagcgagggagacaactatagtgccaccctcctggagcctgctgccagctctctttccccagatcacaaaaacatggaaattgaggtgtctgttgcagaatgtaaaagtgttcctggaatcacctctaccccacatcccatggaccatccctccgctttctattcacccccgcataatggcctccttactgatcaccacgaatccctggataatgatgttgccagagagatccgctatctagatgaggtgctagaggccaactgctgtgattctgctgtggatggaacgtacaatggaacatcctccccagagcctggtgcagtggttctggtgggcggcctaagcccccctgtccacgaggcgacccagccagaacccactgaaagaacagctagccggcaggcacctcctcacatcgagctcagtaatagcagccctgaccccatggcagaggcagaaagaacaaatggccattcccccagccagcctagagatgcgctgggggacagcctgcaggtgcctgtcagccccagctccacaaccagctcacggtgttcttcccgagatggagagttcactctcaccacactgaaaaaggaggccaagtttgagctgcgtgccttccatgaggacaagaagccctccaagctctttgaggatgacgagcatgagaaagaacaatactgcattagaaaagtgaggccttcagaggagatgctggagctggaaaaggagaggagagagctcatccgcagccaggccgtcaagaagaatcctggcattgcagcaaaatggtggaatcccccgcaggaaaaaaccatcgaggagcagctggacgaggaacatctggagtcgcacaaaaagtacaaggagcgcaaagagagaagggcacagcaggaacagttgctgctgcagaagcagttacagcagcagcagcagcagcccccatcgcagctctgcacagcccctgcctcttctcatgaacgcgcaagcatgattgacaaagcaaaggaggacattgtcacagagcagatagatttctctgctgctcgcaaacaatttcagctgatggagaattccaggcaagcggtggccaagggccagagtacacccaggctgttctccatcaagcctttctacaggcctctggggtcagtcaactcagacaagccactgactaatccgagaccaccttctgtcgggggacctccagaagacagtggtgcctcagccgccaagggacagaaatcccccggtgccctggagaccccatcggcagcaggaagccagggcaacacagcctctcaggggaaggaagggccctacagcgagccttctaaacgtgggcccttatctaaactgtgggctgaggatggagaatttacgagcgcccgggctgtcctcactgtggtcaaggatgatgaccatgggattttggatcagttctcaagatctgtcaatgtctccttgacccaagaggagcttgactctggtctggacgaattgtcggtgaggtctcaggataccacagtcctggagaccctatccaatgatttcagcatggacaacatcagtgacagcggggcatccaatgagacaaccaatgccctccaggaaaattcactggctgatttttctctgccccagacaccacaaactgacaacccctcagagggccgaggagaaggcgtctccaagtcatttagtgatcatggtttctattccccttcctccacgctgggggactctccgttggttgatgaccccttggagtatcaggctggcctcctggtgcagaatgccattcaacaagccatagccgagcaggtggataaagctgtgtccaaaaccagcagggatggagcagagcaacagggacctgaagcgactgtagaggaagctgaagctgcggctttcggctcagaaaagcctcagagcatgtttgagccacctcaggtgtcttctcctgttcaagagaaaagggatgtattaccaaagattctgcctgctgaagacagggcgctcagggaaagggggcccccccagccactgccagctgtgcagcccagtggcccgattaacatggaggagaccaggcccgaaggaagctatttcagcaagtactcggaggcagctgagctgagaagcacagcctccctcctggccactcaagaatctgacgtgatggttgggcctttcaagctgaggtccaggaaacagcggactttgtccatgattgaggaagagatccgagcagctcaggaaagggaagaggagctgaagaggcagagacaagtcttgcagagtacgcagagccccaggacaaagaatgccccatcactgccctccagaacatgctacaaaactgctccagggaaaatagagaaagtcaaacctcctccatcccccaccactgaaggccccagcttgcagcctgacttagcccctgaagaggctgccggaacccagcggcccaagaatctgatgcagaccctcatggaagactatgagacacacaaatctaaaaggcgcgagagaatggatgatagtagttacacttctaagttactgtcttgcaaggtgacttccgaggtcctcgaggccacacgggttaatcgaagaaagagcgcactggctttgcgctgggaagcagggatctatgccaaccaggaggaagaagacaacgaataaacttccttcaacccaggaagcgtctttggtgcttgggagaccaagaaaccaagaaattaacaactgaaagcattttaatggactatttattaaagtgcaaacaaactcagcaatccttatgtagaccagaagctgcaatatacaatgatgaaaatgaaacgaaaaggaagtccccccatcagactctggacacccaggaatcaaaagagaaaggacttttttggtgactcaatcccagtgtctggtttggggccaatctacaatggatccaaaaggacaaaacatgttacaagcaaatcaacatagttgctgcaggcggaactgagaccagcctctctgggcgatgaaggacaatggtggtagggccacttagagagcagtagggcccaggctggtgcagcctacatggcacaggatatttccctgcaccagtttcccacctgtcacttgcagcatcagagggtgttgcattaactccattttctccagcagccataaaatgaatggcgtttctctccatatttgcccagaagaggcagttatgattccacttctcctacatttaattatttttaattgagaacaactcatgatcacaattcataaaatccatattttaagacaatagttcttcatgtcacaaacacaatctattctacatgaggaggctgagaaaggggaagagaaaaacaaaccaaatggatgatgttagctttaggatcgtgtctgcttataatattcactgatctgcagtttatgagaacacattttcacagttatgtttcttcataggaaaactatatttagtgggcaacaactatttttatgatgggatgggggagtatatacacgtatagaatctgtacgcgttgaacaacttggttcaagatggtgggggcatttttagagcggcaataattgaaaaaaaaggcgaactctgccttggagaggtagatgataagaaataaaaaggtgtttataactattttgtattataaagtgggccttagagataggaagaagaatgatggattccttttggatcaatcagaaaggaaacacgaaagaaaagtcaggaaggtagagagagaaaaagggagggaaggagaaagaatgggaataaaataaggaggtaagagatactatttttgctgagcaaccagtgtgtttcaggatgatacaaagaaaaatatagaatagaaataagtgcaggcttggaatcagctacaaatcctaaagatggggtgtgtgtggatgtgtgtgtgtgtgtgtgtacaccattgtgtgtttgtaaaatgtgtatgttcatgagtaagggtgtgtgtgtgtgtgtattaaaattccagagtgaccgtggcacttgggtgtacaggtaattcctccagagctgtttgctggcttcaggagtggagtgagaatttcttttttatgaaaagggatataaaggcaccgagctgatgcagtatttgtaatattaagttgacctaacaaggtatttgcatgagtcacaattacaaagttttgagcggttttgtaatttgacatttaggaaagtctcctatttattctcatactttacattcatgcttagtatactatagaggatgccagctttaatctttctgtcatttaaagcaatatgataagggtattcaataattgggtgccctaaatttctggatgagaaaattttcaattctggcca

SEQ ID NO: 1320 - protein, 910 aa, Homo sapiens
QKPPQLSEDDIWLKSEGDNYSATLLEPAASSLSPDHKNMEIEVSVAECKSVPGITSTPHPMDHPSAFYSPPHNGLLTDHHESLDNDVAREIRYLDEVLEANCCDSAVDGTYNGTSSPEPGAVVLVGGLSPPVHEATQPEPTERTASRQAPPHIELSNSSPDPMAEAERTNGHSPSQPRDALGDSLQVPVSPSSTTSSRCSSRDGEFTLTTLKKEAKFELRAFHEDKKPSKLFEDDEHEKEQYCIRKVRPSEEMLELEKERRELIRSQAVKKNPGIAAKWWNPPQEKTIEEQLDEEHLESHKKYKERKERRAQQEQLLLQKQLQQQQQQPPSQLCTAPASSHERASMIDKAKEDIVTEQIDFSAARKQFQLMENSRQAVAKGQSTPRLFSIKPFYRPLGSVNSDKPLTNPRPPSVGGPPEDSGASAAKGQKSPGALETPSAAGSQGNTASQGKEGPYSEPSKRGPLSKLWAEDGEFTSARAVLTVVKDDDHGILDQFSRSVNVSLTQEELDSGLDELSVRSQDTTVLETLSNDFSMDNISDSGASNETTNALQENSLADFSLPQTPQTDNPSEGRGEGVSKSFSDHGFYSPSSTLGDSPLVDDPLEYQAGLLVQNAIQQAIAEQVDKAVSKTSRDGAEQQGPEATVEEAEAAAFGSEKPQSMFEPPQVSSPVQEKRDVLPKILPAEDRALRERGPPQPLPAVQPSGPINMEETRPEGSYFSKYSEAAELRSTASLLATQESDVMVGPFKLRSRKQRTLSMIEEEIRAAQEREEELKRQRQVLQSTQSPRTKNAPSLPSRTCYKTAPGKIEKVKPPPSPTTEGPSLQPDLAPEEAAGTQRPKNLMQTLMEDYETHKSKRRERMDDSSYTSKLLSCKVTSEVLEATRVNRRKSALALRWEAGIYANQEEEDNE

SEQ ID NO: 1321 - DNA, 38977 bp, Mus musculus
  misc_feature (1)...(38977): n = A,T,C or G
catagcatggagctgcccaggagcccatgaggcccagaaggaggcaggggttcaggccaacagctgagcacagaggccaggtgggtgtcctggttcctttcccctgcccatgcagctgcccgccagctttgcaccagccctgcccgggacccacccaccttgctgcctgcaggcaggaggccctcagcctctttgaagactccaatgttcacacccgacattgaggaagtgctaggatgccccgctcccagagttcctgctcccatcagggtgagccaagttcagggtgagccaagtgtagactgacagcacacaatgtcagcctccccagccaccgatagagtggctgtggcacacaaggaacacctgtcgggcagaagtgaggtggggacctggtgctggagggaatgtatgatgttactcagcgtaaaaaggagggctgtcttgagacaaactgtgtcatcaatgagcatggatgacatcccaacaagttaaagaaatgacagagatcacaggatcccattgacatgaagtgctgagaagaagcaaaaccactaagacagagagtagtgggtacaagggccagggaagagacgggatgacaaaatgggaggatgattactaatgagtaataataataacaacagcaatagtaataataatgagggtgcccaggtggagatgaaaatgttctaaatgatggtggttatgcactattaggaggtgtggccttgttggacgaagtgtgtcactgtgtggcaggccttgaggtctcctacgctcaagctgtgcccagtggcacacagtctcctccttgctgcctgtcgatcaagatgtagagctctctgctccttctccaacaacatgcctatctgggcgctgccatgcttcctgccatgatgataatggactgaacctctgaacctgcaagccagccctaatgaaatgttttttataagagttcccttagtcatggtgtctcttcattgcaacaaaaccctaattaagacagccagtctgtgggatgtcttcttgattaatgattgctgtgggaagatccaacccgctgtgagttgagccacccataactgagtggtcctggagtgtatacagaagtaacgtgagggctggagagatggctctctggttaggagatctgactgctcttccagaggtcttgagttcaattcccagcaaccatatggaagctcacaaccatctgtaatgggatgtgatgccctcttctggtgagtctaaatacagctacggtatactcatataaaataaataaatctttaagtggaaaaaaataaaaaagcaaagtgagccggcccagggaagcgctccaggaagcagcacttcagcagcctctgcttcagttcctgcctccaggttcctgccttgagctcctgccctgacttccttaatgatggacagcggcttggaagtgtgagtcaaataaagccttctcttcccaagttccttttgatcagaacgttttacagcaacagaaagcaaactggagacagaggtcaacatgagggctatgaggtgttgctgtgagggcctaaccacgttgttttgggaggactgtggcagcgtttgaagctttagnnnnnnnnnnnnnnnnnnnnnnnnnnnnnnnnnnnnnnnnnagaacatggagagaaatgcagatgatggaggccctggtctgtgacgttttcagaaggacaactaagtggggttattcttgtggtatatttgaattaagactatggtttctggtcagctggagatgaagcatcagctttgactaagacactagccctggggactggagagatggctcagcagttaagagccccgattgctcttccgaaggtcatgagttcgaatcccagcaaccacatgatggctcacaaccatctgttatgagatctgataccctcttctggggtgtctgaagacagctacagcaaggcaatggggccagagtgagaaggaaaaaaaaagtgtctgaagacagctgcagtgtacttaacatataataaataaattaaaaaaaaaaaagagagagactagccctgctgaagtgaaacctttgggacactggtcagctgaagctgagaaattagcgtcaattaagaaacctacaccatggtctacagagtgagttccaggacagccagggctacacagagaatccctgtctcgaaaaaacaaaaacaaaaacaaaaacaaaacaaaaaaaaaagcggggcgtggtggcgcacgcctttaatcccagcactcgggaggcagaggcaggcagatttctgagttcgaagccagcctggtctacagagtgagttccaggacagccagggctatacagagaaaccctgtctcgaaaaaccaaaacaacaaaaaaccaaaacaaaacaaaacaaaaaaaagaaaccattaaccagcaaaactcttccaggaggctatagtccagagggttcaaggctacatctcaaactggcagccaaacttggtaatgtataagagtaggccacagagtactggtttgggggatatgtaagctgcaggactgaaggagtcatggggagaagttgagccttggcaccatgtggcagggtcagcgtctctgcagagaaaccaggagaccattagtgagggtcagcctcacttgtagtgaatgccttagcatactggagatgccaggaccacaggatgaccagcaaggacaacgcaactgtgatgtggagctggccagcgcctacgagaaggcctatgtgtgctgtggagggcagagatggagaggtggagctgtgtaaggcctttggagtccaaagatcatgagtgagcagaccttgggcaatgagctacaggatttaatttatactgcttgatgtcggttttgctttgatctaattgtaactgtgccctggttcctccctcttggaatgagtatgtaactttcattttacaggagcctaaagttgaaagactttgaactttcaaagaattattggattttttaaaaagaacttggacttttaaagtattggcatttttaaagactgtggagcttttaactctgtattgattttgaccttgtgatattaacctgtgatcttggagataaacagagaagggaagtttatggcttaatagtgatatcttcatgtatcagaatgacaaagcatcaattatactggttagcttttgtcaactttataaaagctgggaagagggaacctcaattgagaaaatgcctccatcagactggcctgtagggtattttcacaagtctgtgagggtattttattgattagtaattgatatggaagggaccagcccactgtgggtggtgtcatccctagccaggaggtctaatggtttcttataaaaaccaggaaaacaaccaaccaaacaaaaaaaaaaaaaacaacaaagctgggcgtggtggtgcatgcctttaatcccagcatttgggaggcagaggcaggtggatttctgagttcgaggccagcctggtctacagagtgagttccaggacagccaaggctacacagagaaaccctgtctcgaaaaaatatataaataaataaaaatttaaaataaaagaaagccaggggagtcaccaagtaagcaatgttcctcaacggctctgttctacttcctgcctccaggttcctgccttgacctcctgtcctcagtgatgaaggttaacaaggaagcacaagccagccccaagtggcttttgttttgttttctaaattaattatctattttatgtgagtacactgtagctgtcttcagacacaccagaagagggcatcagatcttattacagatggttgtgagacaccatgtggttgctgggatttgaactcaggaccagtcagtgctcctaaccgctgagccatctctccacccccacctgctaagtggcttttggttagatgtcttagcatggcaataggaaacaagctagaaatttacacactaaaaactgtaagtgggtggagtcggggatgctgggggaggggaggggaaactgcagccagaatgcaatatacgagagaagaataaaaaacaaaacaatgaggtgattgcctgaaaccaaagcacttgagaggtgtgggcggaaggactgagaatctggggtcagcctgagctacataattgaactctgtctcaaaacaattttatttttatctttatttgtgggtttttttaaaaatacagtctctctattatgtagtttgtagttctggttgcctctgaactcactatgtaggctagattggtctttaattcacaaagatatagctgcctctgcttcccgagtgctgggattaaaagtgtgcactactacacctggctgtcctggaacttgctctgtagaccaggctccacatccggggacagaaaaaaaaaaaaaaatatatatatatatatataattgttctatgtgtatgtgtgtgcacctcatggctagaagaggatactgaatcccttgtgactagagttacagagagttgcaagctgcctgacaggtgctgggaaccaaatccaggtcctctgcaacagcagccagtgcttttcagcatggagccagctttccaacatcttccaacatctcaaaaaagattcttgataaataaagagaaaaaaggctgatgaagccaggcagtggtggtggtgcgcacctttaatcccagcacttgggaggcagaggcaggaggatttctgagttcgaggccagcctggtctatagagtgagttctaggacagccagggctacacagagaaaccctgtctcgaaaaaaccaaaaccaaaccaaaccaaaccaaaccaaaaatcttaaaaaaaaaaaaaaaaaaaaggctggtgagatgtttcagtggttaagagcactgaccggccttccagaggtcatgagttcaaatcccagcaaccacatggtggctcacaaccattcctaatgagaaacaaaacaaaaaacaaaaaaactatgggccagagcaaatggggctggagcaagaggggcctggagcaagtggggagggggaagaaaaataaataaagagatgggggtgggggagagaacaagctacaaaatattgctgagaaaatggacggggaggaaatccccaaaagaaatacaccatatacccagctgctccagtttccctagagaattccacgcacgcattcaaagctgggcatgggggctcacatctgtaatgtaagcacctgggaaggcgaggcagaaggatcaggagttcgaggtcagactcggctatcgagcaagttctaggtcatccacgtcagaatctgtcccacagaaaccaaaccaaggggaaagggagctgggaagagtgatgggccgaactgtattcttcctgctaaaatccatgttagtcataaccctcagtaccaaagagtatgagacagagccgcagagacacaaatacacagctatatttggagataaagttgaatgaggttacagggtggtccgtcagccaactgactggtgtgcttgctgtaaggagagattaggattcagggaagtccccatgaagacatgagagacaccacctaaaagccaaggaaagaagtcagaaggagccaaacctgctgattttttgaccgtcagactgccggcatccaggacctaaatcaaagccaggtggcagtggcatgtgcctttagccccagtactcagtaggcagaggtagacagatctttgagtttgaggccagtctggactacaaatgagttccaacgcagtagggctacaccttgaaacccggtcttgacccctccccaaaacaaacaaacaaaaaacaatcaaacaaaagaaaccaagaacaaaaaccagaacctcagtcactctgaggctgtagctatgcagcctatgcggactggtgagaggcgccaggcctccatcctcacagatacacccaccagtcggactactcgcttgatttttattgctttgcttgtttactttgagacagaatctcaccatgtcacccaggctggtctcaagctcctagactcacatgattcccctgcctcagcctcctaaatagctagtatcacagatatttatgatcagacccagtctcaaagttattccctttaatgtgtactggtttagtgtctgtcaatgctagctcattcaagtaaaaaacaacaacaacaacaacaacaacaaaaaatctcagaaacaaaaaccaaaatatgggactagagagatggctcagtggttaggagaacagattcctcttacagaggtcctgagttcagttcccggcactcatgtcagaaggctaaacaactgcataattccagctccaggggatctggtgccctattctagagtctgcaagtacctgcactcacaatcacatttccagcactgacacagacacacataatttcaaaacaataaaaatacatttaggaaaaacagatagggacggggctctgcaggaaagagcacactcgggatctgtgtggattccagattggaggagacacctgttcctggaacattctgctcctggacacaatgacccattctctcctaggagaccccaaggcttcgaagtcccagcacaccagaagagacacaaaatacaagctacataccttccttggcacaagctaggccaccggatcccccaccgatcaccaagagatcaaagctctgctgccctggtgaggaagggaggagagataagaaggcaccagacccagcaccagacccacacctgaccttgctctcgtaccctcagttctgtgtggtacaaagcactcaggggtgaccacactgtccgcacaaataagacaacagagagtgccgagacttactgctagggcgtatgtccatctttgcaaaaaacccctccccaactcccaaaaagagtctcagaacccaagacttcactcaatgtcctcagccagacagaacaagaacattttcatttaatctacatgcttttccgtggtaaaggtgactcttcactatagcaacaaagagtatatatatatgtagtccctcccacacagtcaagagtctcagggttgttctctgacctccacatgtgtgccaggaccatgcatgtatgcacccacacccatgaacacactaaataaatacacgagccaaatataaacataatacttttaaatggccacaccttaagtaggcaaggctgcagagaaaaccctggactcccatacccttcaaggtcactggcctgcaccccaccacaggaacacatagatgaaagtcacgggtttgcagctccacagctgaatctaccccagattcaagtcccgagaaggcctgaacagttacaaattatttaatggctttgatgtgctcctaaaaaagaaaggaggcaagttggcgtgaggaccagtttggcaggctttgtgtgctttgtatgccagaggtgggagatcctgtctttaccctgaagaaggatcctaccttccattgctgatgcctgtcctgtctgttgcccgagtggggctcctattgggtcatcctgctctgaggccctatactgtaccctctgtctgtttgctaccaaatgactggcagggctggcttatcgcaggccacttgctttcccacagtgcacacccaggagcctcctctctgataaaaacttagaaggcggccacagtgagagtttcaagggtcagtatgaagaaggatgcgagaagcctactggggccctcacatcccagccttcactcactgtgcttaggcctgtccttctgcccacagctcatctccagaacatgtctctgtttcaactctgcctcaggactcaccgtgctcctgtttcagtttctttctatcgtctggaacagggcagtaggaatctaatcgacatgacaaggtctaaataaagggcctggctgctctgataaaggaagatggtctcctaatgtgtacctgcctgccagagaggccaacagccttcttatcctagctccagtttggatgatacaacaccctctcccacccctcagctggaaaacatgggtattcctgcttcaaaaggacagacggcagagctgacctggactcacaagtgaactctggagtcatatggcgggtggcatcttccctagacctcacaacatcctcaccaaagcaaagtcctgaacccttggggtgtgagacacgagtcctccagtcagtagtggaggactctgcccagtgggaaacaaatcccaaagccacaagggcttcctagcagcttgaagggccctagacttgtgagctcagtgaagctcctgtctacagatttcaacatactctttggcttttatttattttatgtgcctgagtgttcatttgcacttatgtctgcactgtgggcacacagtgccagagggcagtgccagagggctgtgccagagggcagtgccagagggcagatgagggcacggggtccccctcggaatggagtcatcatgtgggtgctgggaactgaacttggagcctctggaagagcagtgagtgcggagtcgctcttgtccctcctttacagacattttactgttattatgtagggtgacggtaccaatgacacagagtgacggtaccaatggcacaggtactttgactgacttgggttttttttttttttattccgaaccccccgattgtttttttttttttaacctccacataaatcactaaaactacctccacctaatatacagcactaggagaccctgaagagccagagacctgggagttagcaaagctactgaaagagcacccgtcaatccctgaggtctgtcccctaggttcccacctcacatgtagtgactgcttcctggtactctcccaggttagcttctgccactgagccacaaggcctctgccaacttccacttgcagtcggtctacctgccttggccctgtagaccaagggccagccattgtacctttcatagcactgcctctgtgaagaaccctggcctgcccttgctcctctccctctatgctcgctccctgtggacagaattgagttctgtcactcacattcagggggcagtattaagggtggtcaccatgaaaagacataatggagaccactcatgaaactgatcataccactgggaaactctgggggaacttggcctattgggggtagtggacccatgttgagaggtacccagtttccccctttgaaattaattactatcctgatttcagcaataacgcttcctggtgcaaacaagttgtttcttccccttctcaagagccctgacaagcactggggcttggttccacaaactttctagtgtcttctcactccccaaacactaggcaggtcatgaaggtgcatttggaagctgaggaaggaagggccaacacctcaaggctaactctagctgcactgccaactgaccatcactcaaaaaatcaaaatcaagcccaaaacaacaaaccaaggtagttcatgactgtaaccccagaaggccacggtcggtggcaactacctaagcagtctgtggccagcttggctacatgggggtgggattacggacaaaaacaaaaagaaaaaactagaacaataaaaagagttgctgcacctaggaagttgtgtgccaatggggtacctgtgaccatcagagcccttgacatcatcccatcacagccctgacatcagggctacgattaatattggggacacaaatcccagaagactgggcttgctgccaccacaggagggcctcaggcaaggcaccgccaacgttttagacacctggggaaaaagcagccctgctagaagcaggtcccctcctaatcagaaccctggcctgtgtgggcacgcccacgcggacacgttccaggacagccccgccaccgcgaccccctgtggacactcgcacaggcaccctctccgcgtgcaccgcccacgaccccaccctacctcccgctgcactcgccgcgccccttgtcccgcgtgtcagagcccgtgtccgcggccggaagcgcctgctgggtccacgcagcgccgccaccatcgccgccaccatcgccgccatggtccggggacctcaggcggtcagggctgcccttcgcactgcctgagcgtccgcgcctcggggtcagacctgtgcgcggccttgacgaggtgagtggtgcccgcccggagctcggactcgggatcagaatctgcatgcaccgaactgggactagggtgaagggcccgtacgtgggaactggttctgacctaggagagcgcaagccggcgctggggaatggggacacatgtgaagggggtctgatcttggctggggggtcgctgaagggaggcaggtgaccgaacttgagtatcagtgctgtggtggaagatatgtccttcggtggggctgtggagttgggcttaacctggatagaatgtagcacatccagggcctggcccattataagagggtccgacttacttagttgttggattgggatgcaaaccttagggtcaaagttacagggctcagggatggtcagtagagttggaagctgttgaacaggggttcttgagagaggccttagggtgcccccgggtcactccttgcaaaagaagtgctacccacccccacccccccactcccaaagggaccccttggagctcaggagcactagggcaggagcactacggcaggctttgggtgtgtgctaaaaagagaaagtcttccagccagggacttttggggtccttgctggccctccaagccttgggagaacagtgggagctgccacgacttgtgggagcttgtggtggggtagggccctagaggacatcttgtcacagagaaacagcatcgccctaataattgggacagattttacctaggagctgtaggggaccggctgagtcatctccatttgagcagaggtgacaagtgggtgtcttctggggaacaaaggagcacagaatccatgaagggaagggaagagaagggaagggtgctttatacaggctcttcgtggctttgctgctgggctaattcccatgatcccacagaagctacagagctgcagacactttggggtctaaagttgctctagggatgcacccgtgagctgtcagagatgaagctaaagtttatatttttaaaaggagcttggctaaatgtggctaagcctccagtgtgtgcacccagtagaggatccttttccaggaagggagacgtccttcctattgaacagaagtccattttctgttccatgtgagggtcattcttaagaagacaatagaaaagttggtgttagccacaaatcagtcttttttttttttttttttttttttttttggtttttcgggacagggtttctctgtgtagccctggcttcttagaactcactttgtagaccgggctgaccttgaactcagaaatctgcctgcctcccaagtgctgggatcaaaggtgtgagccaccaccgaccggcaacaaatcagtctttgcacatttctagatgccaggtgcgagtgtctttagatggttgatgaggagcagcctggaggctttaccaagttgtcctctgagtgtaggaggcagaagtgtgtgagcacacggtttcaggcgtgatcatttcctggagcagtgtgtgcacccagtagaggactttccctcgtggcccttgtaaccgaggcagaaagctgtccccagagtatttggtgtgttgaaatctgacatttctgtcagattctccctcaagctttcccagatcgtagtgggataggatagccgcatcaagcactgttcccagcaggacccaaaaccatcaggcttttgttccaaaggtcaagaaattaggaaggagaagaattgtgaacagtttggagagttgtgggcagatattaaagccagatgtagcatgtggatatatttacacgcagcttaaaagatgaagcagtgtgtcagcacgcacctgtggtcccagccctcaggcagaagcgagagaagcatggattttaggtcagtgtgctacatagtgattttcaggcctgcctgggttacagaccctgcctttggagacagagaaaaaaaactaaaaacatcagcactgttttctccttgcaaatgaagatgtaagatggccttctgatgtccatatttttattaggggatgagagagtcctaccacagtgaaactcaaagttacagacattctggcccataagtaagtacaagttttattgttgctttcactttttgaagattgtctaaaacccccatcagcctctcccatgttgggatgatgttcctaagctaccgtgcctggctctatctgtgtttgtgtgtgtgagtatgggcgagcgcctaccatgatgcacatgtggagaccagaggactactgtggatgtcttttctcgcctcctcgttgcttggagcaggctcttttctcttgtttacttctccttatgctgtggtagctggccctcaagctcctggggtttttctttctctacctctcatctcatagcactgggattacaaacatgtattaccatgtttggctttaagtgggtttggggatcagacctgggtgatctttccagccccagctgttttaccatcatttgaatgcattaggaaaacactattctttctctaggcagttttagctttaccagctgtattgaagtttcttgacttttagccaacacaaactgaccctggaataagggactttttccccttttcctcttgagtttttctgacttcagaaggaaagaacaaaggctggggaatgtagcttcgttggtagagtgcttgcttggtatgcatgaggtcctgggctctatcactagcacttcattaaactaggcatagtggcatatgtctgtatttccagcacccaaaaactaaagcaagagtatgataaattcaatgtcaacctcttctccagagcaagtttgagagtagtgtgggctgcatgaaaccttatccctcacccccccacctccaaaatcaacaaagcatgtaagaaaacaggatgaaacaggtaagtcataaatcctcaaagatagtgaagaagatcagaatctgaaatcggggcacgaggaggagcaacgtcatgcttgagttctcagcgtctgggaggtagaaaccgcaggatcaggagtttaaggccagtcttggctacatagcaagtctaagcccagccagggatacatgagaccctgtcttaatagaagaggaaggagaagaaaaaggaaaccaagaatctaatgagctaccgtacttctctgttgaaacacagaaagttacatccctttctgataaacataaaacagcattttgactttttgtacagtgctgtgattgtaccctggggtatactaacctctgagctcctgagcacagcccaagattattcctgtttaaaaaagattctgccaggcgtgatggcgcacgcctttaatcccagcacttgggaggcagaggcaggcggatttctgagtttgaggccatcctggtctacagagtgagttccaggacagccaggactacacagagaatccctgtctcaaaaaacaaaacaaaacaaaacaaaacaaaacaaaacaaaacaaaaaaaacaaaaggaaagaaaggaagaaagaaagaaaaagaaagaaagaaagaaagaaagaaagaaagaaagaaagaaagaaagagaaaaagaaaaagattctaagcccagcgcgggtgacatgttcctttgatcccaggactcgggagtcaaaggcaggcagatctctgagttcaaggccagactggccagagtaagttccagaacagccagaaatacacagagaaaccctgtctcaaaaaaacaaaacaaaacaaaacaaaaccacaaacaaaatttaggtcctagagagatgcattagggttaagagcaaatactgcttttagaggtctgtttgttaggacctatttcaagggactcgtgactctgtaactccagctcgaggagattggacaccctcctctggtctccatgaacactcacacacaaatagtcacacagacatataaatcaaaataaaaaagaattgtagctggacatacttttatttccagcattcaggaagcaaaagcagtcaaatccttgagtttaaggcagcctcaggaacgttaggatgccttgaccttggtgagagcaaggtacacccagatttatagaggatgcccgcatggagggatgatggcatattcttggatgcttctgagccttcagaggtcttttaaaattccttatggacctctgaggcccatgctttactggtatgaataggcaggccatttctaagaaagcagaatgctttttgttgtatttatttatttgttgttattttgattgttctagacagagtttctctatgtagccttggctgccctggaactcactctgtagatcaggctggcctccaatgcagagatccgtcgatgccttccagtgctgggattaaaggcatgtaacaccaccctgcctttgcattttggtttttgtttgtttgttttaagggacaacatggaggttgttttgttttgagtccgggtctctccatgtaccttgataacttagagctgtgtagaccaggcttgtgaacttgctgaaattctcctgcctctgcttccagaatggtaggatgacagatgctaccatacctggccagcaaagttttcaagagggctttgtaaacattagctcaataaactcaaacttagttccttgaagctctctgattctgggtgatgggtctccaacaggacattccagtcaacaggctgcctgaagtttccaattgtttcctgctggaagagaacagacccaactgcagctctgtaaataactgctaccatgaaaggaagtacttgggaagtttgttattgggaggcatcagacagtgagaaaaagacgaatgtttcaatttagcaaagtataatttactgaatagttatgagtcatggatagttaaagagaactagtttctttttataaccaatagataaaaaaaatagaaccctaggagaacagtgtgctgaacgacaggaggcaaagcctagctatcttttcattttattcacttccatgtccttaattctttattcattttaaattgtttttggtttttagacatttttaatttgggggtagtttggacactatgaagacctggttggctttgaactcacagatcaacttaccctcctcccaagtgctgggattgaaggctgggctactctccagcccttgttcctgtagttttattgtcatatattgacttttgatctggaccagcaggttgttcttcagtgtcaggatgctgaggaggaaagatcagagataaagaagacagaacaggtagctcaggaattatgcatgacctatctcttatacctagcaagtttattaagaagtacactatcttatgtacttttgcagagggacatggggcagtcagtgggaagcgaccatacagtgggacaaagtcagcaggcccctgagcaagcaatattgcctagggaaacacaggatctctcaagggtgtctgagacctaagcacatagcagccttagggctcaatacagcagtcactcagcagggggtgcgtgggtgagggaggttagtttaaaagtcaaattcccaggaaataaaaccttacctccttccagtccctgaccccaggcgcaagtataggccttgccagcctgcctctgggcaaggacatagaaccaggttcctttgtcttttcatcagggcctctaagaaagccttggattggcctggctctcaacggattatacatggtatattgattatgtatatatttgtgaatacaaactctgtgtgtgtgtgtgtgtgtgtgtgtgtgtgtgtgtgtgttgctgaggatgggactcaggacactgcacatgctgcacacatgctttttactgaagtgtgttctcaactcatatatttagatattgttaacatggatcttacaaaaataaactaggaaataaagttacaagtttatcacatgccaggatctgccacagattagtacagtacatgaattcatcatctcatgacctctagcggtatttttatgatgataatgattttgtgtgtgtgtgtgtgtgtgtgtgtgtgtgtgtgtgtatgtgtgtgtacatgccttgggtgtcattcttcaggaacgaggtatcttgatgtttgagacagggtcccttactggcctggagctctcagagtaggcccagctgactgcctagtcagaggatcgtcctgtggctacctccctctgtgcctggctttttacatggattctgggaaataaactcaagcccacatgcttgcatagcaagcattttgctaactgagccagctcctggtaccttttttggggggggggggctagggggtacagtctctttatgttgccctggctgtcctgggccttgctatggagaccaaaataaccttgaactcacagacatctgcctgcctttgcctcctaagtgctggaattaaaggtgtgcactactacacacatttttttttaatgttgaaagaatatgttcattaatttattaattagatgtgaactttttagtcattctgtacatctaaacatacttagttaaaagatagagatagacagcttatcttgcctggcagacagttgtggatttggacccagcagagaaagagaaagagcaaggggggtgttgcacatctgtaactccaacactgagaaggtgaaggcaggaggaggagaaggtcattattagctactagaaaattcaagaacaacctaggctgagtaagtccttgtctcaaaaaaaaaaaaaaaaaaaaaggaaggaagctgagacgatggcctggtgtgcactgtgcttggtgtgcacttgtggggacctgagtgcagaatgcaagaacccattagaatatgggcaaaatggccagacatggtggcaaatgcctctaatcccagaattcaggaagcagatgtaggtggagctctgtgagtctggggccatcctagtctacatagagagttctgggacagccagtcctacatagagagaccatctcaaattactaaaccaaacaacagcaaaacaaaatagtgttgctccagggatgggaggtccctaggctgatctccagagctcactggccagctatctacaagctccagaccctgcttaaggggggggggggggtcgagagcaataggggaagcccattgtcagtgtctggcttgcatgcatacagtcacacccatgtgcaggcaacacacatgtgcttgtctagtttggtgctggggtggagtgcagggttccaaacaacagttagttacatgcaggcctcatcccaaccctccaatttgtgttttcttcaggtggttgctttggtgggtccctgaattcttagaacacctacaaaggtgaagggtctcagatcttagagaccacccaaagctgagcagccggagaagtgagggccctgtctggtggcataggcaggagtggagcttggacttgaaagggagtctatgagatgaagctgggttgcccaaggaaaggtccgtgcagtggaagggtgaggccaaggctgccacatggctcgttgtccagtgtcagtgcctgcagtgtatgcagggctccaggctccatcctagtgtcctccccataaaccactccactttatttttttgagacagggtctcagtctggggctcattgattcactaaggctggcctaactcctgggatgggccagtgtagtccctatctcccaccccctgcctcctgccagccaagtgccaggtttttattgtgttagggatgtgaactcatatctgaatgcttgtgctaatacagctaagcaaccaccccccagcccttccccaccaccacaggctctcactgtaaccaaagccggcttgggactcactgcatagcccaagttagctttgcattggtaagcttcctgccttaggctgccaactgttaggattacaaactctggtcaaatcatggtgaacagcatgggtgtagctggtggagtgcttgccttgcatgctcttgaggttctgtctttagcaccagaagggaggcattgtcatctgggaatgtggagcctgaccactgtgctggaggcggctgagctgaccttactattacttattactggctcattaggcctaactacctatatcctggatgggagctctgtgcttcttgggcatgtttgtggccagcaggtgccaggtgctatgtaacctcttgtcctgccttgtaggatctgtaagactttcatcccagcttacagaggaaagaactgctcaggacctgtcctaagagcaggcttgattcttgccccagagttgccctgtgagcctctcttcttagcctctgactgctcaggtgcaagaacatcatgatctcagagttaacctatacgattgtgctttccagaactgggagttgagggcacaagtcagcgtgtggaacgcagtagacccttgggaaagcctatgcccagatgtggccacagcagcagccctggcacaaagcctctgtacaaagaagcttcagggtgcttgcagatgtggcaccccagcgccattcctgctgctccttctggagatggcaactggaggtgcccacatgcaatagggcatgggggtggcacctagaggtaccaaggggcaagtggccgccacccgttttgtttttgtttttttaaaaaaaaaaaaaaagctggggctggagagatggctcagaggttaagggcactgactgctcttccaaaggtcctgagttcagttcccagaaaccacgtggttgctctcaaccatctgtaataggattcgatgccctcttctggtgtgtctgaagacagtgataatgtactcatataaataaaacaaataaatctttttttaaaaagccaaacaaaaatttttgtagctctggggcatttttgtagccctggatggcctggaatgcactatgtagcccaggctggcctcacccactctttttttcttttttttttttttaataattttattaggtattttcctcatttacacttccaatgctatcccaaaaagtcccccatacccacccacccccaatcccctacccacccactccccctttttggcctggcgttcccctgtactggggcatataaagtttgcaagtccagtgggcctctctttccagtgatggccgactaggccatcctttgatacatatgcagctagagtcaagagctccagggtactggttagttcatattgttgttccacctatagggttgcagatcccttcctcacccactcttgaccctcctttctcaatctcctgtgtgttggaactccaggtgcataccaccaagctgtcttcaccctccctctccttccctcctttcctggtttctctcttcctcctacctccccctctcagccagagcagttcagaagccttgctggggccttgctggggccttgctggggccttgccgccctccccctcacagctacaagatgagtccctggttccgtctagtacctacctggttcagtgaacccaggagtcacagaggctgaggaagactgactcccctccacacacataccccgaaaagctgtgaaccttgtgaaggttgtttccccccaaccccactccatgcagtagatagtggctctttcttcttccacttaaagccgactctcccgttgttctcacaacgccccctttactcccacccacctcgaggctctttcgtgacaaagctcattctggctcagctccccgctgcttgatctaaccggaagtcagtagttctaacagtgaggattctaacctaaacctgtgtgcgcatgtgtgcacttgtgtgcatgcaggctgtgtcctaggaacgtagaatctaggtcacacttctcacatccgagaacttgtgtgttttcggacatgccggggttatgcgccaaacacaccctgctctgggttcagcagaaacagcctttgtatcaccagcagatgattaacgttctttccaggctgctggcacttctgtaaataactttaggatgaaaacatcagacttggccatttgtcaggcacgaagggcgttcatggtattgtgtaattgttaccagaactttctcatcattccacgctgtcactctctagccacaaagtgatttcctatccccttccctctgctcccatagctactcagtttccagtcctgtgctatttgctagcctgtgtctggatgattttgcttgcaggcccatccttgctggagcatgggtctgtacttctcgccacagcaacacacaccccattgtggagcgtcctggctggcctagctcaaacaagagcaggcagatatctgaagacctgctcccggtcctggctacacagcactgtcacgtgcatagcctcttgtgggagcataaaactgtttcccccagttttcacctagtgtgtcaggggtctaattttttccccatatttttactaactttatcgtcttactttaaaatagaaattaaaaaaaaaaaaaaatcaggcctgatagtgcagacctgagagccattctctacggagttgtaagaagatagagagttcaaggccaacctgagcaacttaatgacaacttgtctcaaaaatacgtgggtggcaatgcagctcagtgaagccctgtgtgctgcccctggtatcttgccccagaaaaatgttctttccattgtggctttgatacacatttccttagtaactgtaactaacaatgctaagactcttcacagaaaggctttcctgacaaagcttgtgtttcccaggctgtccttgaactcacgaggatgatcttggtcttctgaccatccagccctggatgtcaggatcataggagcgttccgtcatgctaaactggagtggggctggaaccgagggctttctgaaggccagacaaacactctgtcacctgagctgcatcccagcctctccccagtgccctagttttaaaacactttatgcatgttatgttagacaggcattcgaccacagagctaacacccaagccctaaaagccctaaatcctcttttcctttttttttttttaaagatttgaaaaaacttttttttattattgattttattgattgatttgggacagagtctagtatggcccaggctgccctcaaactcatgatcttttttagactcttaagtgctagaatctcagatgtcaaatactcaacactatgttttaacttaccacattgttttaattactgtagctttgtagttagttttaaataaggaaggtaagttcttcacctctgtttcaagattaatttggttatttgtgctccctagagattggataaaacttagcatggatttctctactgggtagtgctgagaatcttaacagcatagtatcaacaatgttatcaatagcaagtcttccattctgcctcggttactgacatcttcatttttatactctcttgatcaactaagatcaactaaatgtgagatctgcagagcccagcccctgcctagaactcctaaagagttgattccaggagcctgcagaatagggctcagagctgtggagctaccccagcactgcttccatttcctcacttacacgatcttttctgagctttgggaaacaggctgcagtgtggcccgtcagcctcagtattgagcttactgtgtgcattaccacaaatggcttttcctctgtaaaaaccctaggaagtaatgactgcttgagtttggcagttgccccttagttgctccatttcccatggccaggtgggcatggctccacccactcctcacagtgcacaaagcagaggagggcagttttcaactgagccttgcactctggggatcccccccaaggaagatgagtcttttggaaggcaattggggctgtattagggttctctagaggaacaaaactgataaaatatctatatattaaatattgtgtagatagatataggtttttcaagacagggttcctctgtgtagctctggctctcctagaactcattttgtaggttaggctgaccttgaactcagagttacacctgcctctgcctcatgaggattaaaggattaaaggtgtgtaacaccactgccaggtttaaatatgtgtgtgtgtgtgtacatgcatgtatacatacatatatacatacatacatacatacatacatacatacatacatacttaggctgacctcaaactgttaattatactgtcaatgttgtgtaagcttctaagctacctctctagctgaattttggatggatggatggatggatggatggatggatggatggatagacagtatagctcattgactcacatccaatgctacttctagtataataatggatagtataaactaagacacccaagcacgtgttaggaaaactgagccacagaatggaggaaaatgaggccggcgtcagatagtcccgaaatgcccataatcccagtccgcagcctttcaggcagactctggcgcctgtttccactttgctgcacccactcttggccttctctggtaagctgcacagtagccacagggaccattgtccccctggatagtttcctgtaggtttacatgtgtgctctgtaactgactgctggtgtgtgatagtgggaagcaatggactgagcaaagcaactctctcctgcttctcccaagtacacatgacatcagggcccctgattggagcgatacccacactctctgagactgggaatgtgctggaatatttggaccttggtcatttctaggtcagtttctgtcaaaaattggccaaaagacaagttgagttcctcagaatttcatacagtttccatgtctgctcagctcaataagaggtggagtccaggcccttcctagaaccgatcatgagggtaagagctggatgtgagatggcttgactgacggaagcccatgggtatataaaggctcaggcccagtgtgcatgcagagtgaccacatgagcactctgccttttggaaataggtgacatgagtgtgtgggctgtagagcctcagctttgaggtccctctcttgagactatcctgaagcagccctcacacctagggcttggacctgcctcctctaaagactcttccacaagccttcccaacctagatcagcactctaccctggaaggaactgtaagtggccacagtcgtgggtggaagcttccctagttcctctttcttgtgtctttttaggttctcgcaagcctttgctgtgaacttagtgaacccagtgtcagctgtggggacgctggtgaactgcatctattagatcctgggctatgctccccagctcttgcttaccagaaggagtgtgtgtgtgtgtgtgtgtgagcatagtcactcacacttaccgtgtactggggacagaactcaggcccttctgtgtgctaaacactacactactgagctcacccagccctgtggttttagatctgcaatctgaagctattccttacttcaatggggagagatcccagtgtctcacttagttcctctgtgagtcttcagccaagtctggtaaatcagtcagtgcaaggcttagtggcaagaggagagctcacgttttattaaatttgcacagccctggagatctacacaaggagatgtgccccagcgaaatgaccaaatgattataggcatggtagtacatgcctatatataatcccagccctcaggaagattaggagttcaagactagcctgggctgtatagcctggctgaagaaagcgggttgatcagtagaggttagtggtggagtgcttaccttgtacacataaagtgccatccacaaccaaaagaaaataaagtacacagggccacagctttcctgctttctgaggcaaagaatgataattttataggggaaaaaggacatagatctctggatgaggctggtgaattctagagatgttgcttggtaatcaatgcgggttgtgaagccagctaggaaatgagggtcactccaaagagattatttattcaggtccccagccccattaacagtctctgcttgacgaaggctatttttccatcttggtactagagaactctcaccccaagaaatcttcacattctgccacttgtaggagcaaacaggtcacatggcccatcctgtacccacagttcctctttctgctagaaacagtcggaatgctggttcagtgcaaaatgacactgccttcctggagaaaatactcagggcttgggaccatgcctcacggtcctctacacgggactccaggaggcacaaatgtgcctgctctgcagccacaggccagtgagcagggtggcttcacccagcgaggcactgacccccatcttcatgtagtctctgaaccttggacctccttggcacaagggaccaattaagcgagccaagaacaagtgggtaggcaggaagggcacatgacacacagcctgtctaccctgcccccgccctgcagatgctgttggctgctgtctcattgggtctcctgttgctggccttcctcctgctcctgcgacacctaggctggggcttggtggctattggttggtttgagttcgtgcagcagccggtccacaacctgctcatgggtggcacaaaggagcagcgcatcctgcgccatgtgcagcaacacgcaaagcctggagacccccagagcgtcctggaggccattgatacctactgctcagagaaggagtgggccatgaacgtgggtgacgcaaaaggtacatggcccagcagcatgcaagtgacggggaaactgaagtgggtatggcagcgcttataggagagcctgttagagggagagcgaatcatgggtcatgcttctgtctagcccctgtggagaccgaatcatttacactggaaaaggccaggtaggtgggtgagaggggtccctgtgtgtgaaagtccagtgaactctccaagggtgtatgcagcagggtcctctgggctatcagaaggcaaagggcctttctcagcaggtcaggagcatgagaggaatgtgtgttgctggtccggagaggagtaaggccagagttggggatgggtttccctccctctacctgtacttacgccctactcaccaccctcaggccaaatcatggatgcagtgattcgggagtacaggccctcgctggtgctggagctaggagcttattgtggctactcagccgtgcgaatggcccgcctgctgccacctggagccaggcttctcaccatggagattaaccctgactacgctgccatcacccagcaaatgctggacttcgcaggcctacaggacaaagtagggcccagtgtggcagctgaggggtgaagagggggagagctgggcaggcagtgggggagggtgatgagatccttggccagccactaagcacctgccgtatctaacactggagtcaaggaagcaaccccagcaagttaggcacatggtcttactggcctatcctgtagagcaagcaacagccaggactgccagggaaactcaatgcagattcctctccaaagccccaaagagatgtagacacaggtgggggggtccaggcaagctcctgcatgtcacagtgggcacagttctgacagagcattgttccaggtttccatcctcatcggggcatcccaggaccttatcccccagctgaagaagaagtacgatgtggacacattagacatggtctttcttgaccactggaaagaccgctaccttccagacacacttctcctggaggtgagctgaactactgctgctcagcacgatggcctctgtgcggttactgctggggtcactgagccttgacctcttgaacagcccaagggcataggtgggcccagggacagtctgagttctgtgggttgcagaggccctgtggtgggtggagatgaaaggaagaggtaggaatgccaagccagggactccctgcactgcaagcagggtactgtagggagtggggcaggtaccagagaccagaacacttgggcctgaaggacccagaactgagtacccaagggagcagaactgggtgtcaaatgggtctgactgggggtcaactggggctacccacggggatggcaagcatgtctacgctccctaagccttttcagccctcagcactgcccagccactttcccctagcaggaccccagctctgactggggaagccatccctactcccaagtgactagagtataaggggacattaccttgtcctgctctggtggcctgcaaagagacatggaatggctccttggccctcacttggtctcctcacagcctttcacagccaatggggctgtccatgtggtatttaccagccagctgtctcaagagctgtataccctgtcatatacagtggagtcccgaatgtgggaggatcaggcagtaagcccaggggcaggacagggccactgtggcttgggcaggattcagatggctctggtgcgtgtaagaacacagacaaaggaaaattcaggcatgggctcactagggtcagaggcagggatagcccagggcaggcaaaaaggagaccagcaggcccggtcaaccatgggaagctgcctcagacagggtcctgtccctggcagacactgaacacgatgttacctactgagaacagagaaaggcagctgagcagtcaggctctacctatacaggagagtcaagcacagtgcagggagttgggcttctgcactttctgtgtgtgatcattgaagaggcctgcctttagaaaagacggaaatactgctgttcagtaactaggaaactaacggttttcagtgctgctgcttaaagctggcaattagctccagaagagaggcatacattggaaatgggcacactcattttttttttcaatgtatgattgtagggaattgaacccaaaggaagaacctttaagaatagagatcataaactaaaactacttgtacccaggcttactgctgcacacggacaatctcagtacttgaaggcaggaggatcatctgctggaggccagcctaggttacacaataagatattgtctcacaaagcaagcatcttgtcttacctatagcattcagtactctatctccttagcatagaagccccagcactcagacacagatgcagtcttacctggaattccctgggtggcctgagaattctttcaggaggctcttggtacctgaatactgtcaccagacaaggcatgtttcctgaagggcagcatgggtgcctagcaccaccaaagtgcataccttcctgtcatgaaatcggaagttttctgtctcagtgtctgactgacagtcaacatgtaactcttgatgtttccatgtccctggctaagcctcagcacctcatgctcatcttgaccctttcccactctaactgcagggtccccttctggactgggcagggtcctattcatagcgagacacttggatgttgtggcgggagactatcccgagcttactgaccagcctcagggtccctcagccctctcatagtccacaccccacccccacccactagggccagctggagccctggtcaactgtaagagcacagcactggtgtgtgaggacccagagccctctgctttctctctgggacagcagcatgatgggatgtttttatttgtgtgtgtgcctgctagcagtgctcttcccactgagacacacttcagccaagggctacttactggattttactttccattttgggttgcttccagtatgtttgaagacaagtgccttacatgtcttacatagtccgggtagcctggaaccaatgaatctgcctcagcctcccgaccgctgagattacagacgtgaccccatcagacagaactgctgttattatcttttgtttcatgattatgttaaaaacaaccccctaagcctcctgggcaaacagatattcaagtgtcctgtttcctggctctccctacccctgccccctcccacccctttcttggcaggtacttcagttatttgtatgctatcagctgatatacttcccagagaggatagacaagcatcctacatgggattctcacaatcacaagttctagacccactgctccaagggcccaggaacgactccctcctgctcagagcctagcacctagtgtcttccctggcccaaaaaaagtccagagcagatcctcaagggcagggttgttggtgaggatgccatattcttggcatagagtgttggagggaaactggcgaacctccaaaccttcactgtgtggcctacatgctcctctagggctggggatggattcgaggaagaataggagttggaagtggttccatgggagagcagctgcccatggattgcactgtgcttgccaagcattcctgaccctccctgtctgtcccctgcaggaatgtggcctgctgcgcaaggggacggtgctcctagctgacaatgtcattgtcccgggaacccctgacttcctggcgtatgtgagggggagcagcagcttcgagtgcacacactacagctcatacctggagtacatgaaagtggtggacggcttggagaaggcagtctaccagggtccaggcagcagccccgtgaagtcctgaccactcagcctgatgagcttccgtcccagctcccttctgcacgatgacacacactcactctgaccccctctatgcttctggggcctttcctcagggcctgtggctccagattgtcatacactggcacattaaaggtagtgagctcaccatgcaaaccactacaatacccctggaaaacacctgtgcatcaaaggctgcattgaggccagagatgcagtagatcacagtgcgtgcctggcacgcaaaacccctcacggtgaatcctctgcacccaagaacaaaaagggagatttaaaaaaaaaaaaaaagggggactggtgagatggctcagtgggtaagagcacccgactgctcttctgaaggtccagagttcaaatcccagcaaccacatggtggctcacaaccatccgtaacaagatctgatgccctcttctggtgtgtctgaagacagctacagtgtatttacatataataaataaataaatcttttaaaaaaaaaaaaaaaaaaaaaaaaaaaaaaaaaaaaaaaaaaaaaaatcaaagcaggtgtcatcctgatggcctcactaactggaagaggagattttttacaaagtttcagtgtgggatccctaggcactgccatcactcagcaagaagtcaggaaactgaacatatccagataccattcggctgtcaccaatggcagcaacgactcagacggtactgtcaccagcaactcataccacatttcatcttaagaatgagtcacaaacttttcaggtatgatggcgcatgcctttaatcccagaatccaggaggcagaggcagatggatctgagttctgtgccagcctggtctacacagtgagttccaggacagccagggctacatagaaatactttgaaaaaaaaagtcataatctcttttatattataaaagaaattaaagatctaaatatttggatataagaaattcactgagttattcttttcagctaccacactgctcttacttggcgcagaacagcctttgtactcatctctgactaaacaggcatggggccacgctgtccccgatgtctctgggataaacagtctctccagttcacaccattgaggcatgtctgccaggcacccagattctgaggaagtgccaacccaagcttaagagtcaccctagcccccatctctttcaagaggctcctcaaggcctcagtaggggcccatttcctagactagaaacaaaggtcagctccatcttgtctgctcccacatatgcccatattggtcagccggcacacaggagccaggagtgacagcagtgggacgtgcctgaggccaggggcagagcacaacccccataccccttccaccccctccctgcaatgggacttgagggaactgtatcttcaccagggggcagtggtggctcagctagcacaggactgtgccctctcctggtgagccaaggcagaagacaggcagttctttgctgcttttttaatctttaaattttcttacaaaaatttcaatttttgttgatagtcttattttggtttcatttttaatgcattttgtcagttttcttcattttaaagtcacaaacagcaggcactgaacagcagttccccccactgctgccggcagtcaggccccgaggttacttgaggttctaggcagatgcaacagccagggtggccccagccacaggcagcttaggaggagtatgctgcagagggaaggtgttccaggaatccaaggatgggggtgctggtgacaagcacagcttgccactacccccaatctggctgcctcctaaacttccctgtctggactcttttagagcagccctccctgtggtcagcctacatgcagtgtagtactccagccacccttgggagcccaagttcttttccaaggccccctacttgtcccattgcctgctccaggacctccaatccaggcttgtatttgctcctctgtggctgtgcatggggacctccccccagcctcctctcctaccacacagcaccatgtcagtaaacagctaactcagacctggagagttagagcagaagagtagagaagagggtagggtaaggtaggacaagaggcttggccaccctgccacagcagggtggggctcctggctccaagactggttctgctcaagatggcgggccctctggccctcttccagctacctcgatgcgatccctaagaacaaacagctgggccagggccctgcaaaggaaggcaaagacagatgtttagtcgggagcccagatagataagaggcagcaaagtgtagcaaggtgacttgggacctccatacagggagctgccttgataggccatacagaagcagtagctgtggagtgagggatgggccataccaagacccttgacaccagaaccagtcctgtcttgcgggtcctcacagggccctgtgctgggggtatttgaggaaatagggggcctgtttccccaggaccctgatctccagagaccggaacagggctgttgtcaagtcctgccagagatcacatagggagctcagtcatgcagcaagcagagatgaacacggagccctagtccaaggatgggcaaaccagaggaaggaacgtaccaggcatgcaagctagacccaggagtcaacaggctgaggcttagtgtcccccacggcgtccaccagcctgaccgagggcctgctgggcccaggcggaggggccttcctgccaggatcgggctgcagtgcatggtgggtgggcagacaggagttagaagcagaaaataaaagcaggttaactgcaactaagggtaggctagactggttcaggctgattgatgtatataaggaaggggtggcatggagggcctgccaaggcagtacaaggaagccaagctctggggttggttatggctcacacatgaatgtacccagaggctggtacgtgaagccaggatactggcacacaggtggtagatgctgccttttccaggggaccacagtagacaccttgcccatacacatgtaagagaaaggtacaaatccgtttgctcggactctctggacctacgcagcctgtggccaggcagagctgcccctgtctgcttctttgcggcaggtgcgtgcaccagaccccctcagtgctgaagtctgattgatgatggatatataggctacttcctgggccctgcaagtgagtgccactccagccgtgtcctccaattctgatcaggctcaacactatctggctgttctcttgacaagcctccctggacacttgcttgctgttactcactctcaatagttctttctcagaggtgtcccctgtggagtcactgcccagtgtcctcctctccctccggtcaactgtggcgtaaccatctgtagggtggaacagagcatggaataaatggagttctggggaagtcaccatggggataggtgatcttccttcagtccaaatacagaaagccctgggatgggggacttctggtctaagtgccagctccaaccagtcctgaggcctctaaatcaaccacctatcttttctccaattgacatcttatcatagcaaggcctcggcatcgcccagggttacaccatgaaaccgggtggtcctccccagtcctcttgcctgcacacctgcactcacctggaccaagggtatccatggggatcacatcccgggtgtttgacttctccccatctgcaaggcatgagcaggtgtccatgagcagtgtgcaggcatggggagggcaggacagacatgctgacatgctcgccacagaacagtgctcagtgtcttctgtcaggagtctgtcctatctccttaaccccacctaccttgtgcattagcaggtgggagctacccttaagcctcagggtaagtctcatgtccctctcccctgcttgtgctcaccaaggctcttgtctaccagtggcagtgtgctgtcatcaaagccgccagaacttggtgtccctttgggtcctttggcagtgctagcagactgaggagtcacaaaacacaagcaagagttaaggcctaagaaactgcttgggatcagacgtgacaaagtaagagagaaggcggggcagctgtacctggaagcgtgacttcgtccagccatccctctgcagggctccacgcagctccttgtagctccatacagtctgtagcacgtgtgatgctgccttggcctcccgcactgactggctgcagcagcagcagccagggctggggtcagtggcctaccgcatcctagtctccctccatccccaaacccacccgaccctcagcaggccctgccctcacccacctggaggccacaagtgctaccagggcaggcacaccacgggcctgcaggagggagcgagcattgtccaggctgtcggacacgatctcatggatggtgttgagcacggcaaccacagtatcctcctccaggtgggcactggggtgagcgggagcctgtgcattgcgaacattccgaaccagctctgtcatggcatagctccctaagaggcagggtcagacattaggacatatctctgctctacccctgtgagaaggactggcattcagacaatgggtatcaccagacacaacctctgctagcaggttgagcctcagtgactggggaaagacctaagcccctatagctcagggtaggaccagcccaaccaaccacctgggaggaggaatctggccccctgaacttaatcctcccacagcctgttccctgtacctgccccatttcacaagccctggcctatcacagcagcatcctcaccgatgaggtctttgttccgctggtctagtgagaggttgcgcagcgcgatggctacagcgcgcaccaccttgtcggtctcagactgtagcagttccaccagtactggcagcccacgttccttgcgcactgtggcacggatgtacgtggcccactgtgagggtagcagaggaggtgactgctcagatggggggtgcttcctcgcacagcaccaaccgcattggcccagatggagctaagggctcaaggcagagccactgaggtgtctgggactccttctgtccaggtcttgtcctccctgccaacccgactcctcaccgtccagttgccagcactgaggttttgcagggcaccggctgcagcttccagggtgttgaagttccggctctccgtaaggagtgagaggtagagacgtaccacctccggctggtacagcagctcgaagcctagatacagggcaatggcagcccagagtcattgttaaactcctctccccacctccagccccttcttattcattgttctggaggtagggagcaggacagatactgaagtcatgtttaacatcaattaatgtccccattcagatgggcaaactgatggtgagccggggggtaaagcaggaagatgaggataccccttaacacggacgtacatccaggaggaaggtagagcgagatggacactaggctacttcagcaacagaacctaccttccagggcagcacccttaaagacacggtttacctaccctatctgaccatagggaccaccctcaccagtgagtaagtaacaagactgtgtagcagatgtccacctctagcaacaggcatccctgggcaactactccaggctcttcagtgactgaggcccagcctagcagcaaggtggccagcagaaggcctcatgggtaagagctaaggtgctttcaggcctgccccaattaggggcatctgggttcttttgatatcctgggcttggccgggcctaccagggcagtttctcactgaggctagttcacagtgcactcactgcacaatgtcagtggaaatccagcagacataacaaacagcaggggtgacccaccctggactgcagatgtccattctcacaccctggcccgtgggtcatgcccctttgaagtcacacagcttggtcactgtcagtatctctccaactcatatacctctctctcacttgctgcatgactaggaaagagcttacctgaaacaacgtgtacgtaccgactgaaccctcaggggttaccaggcctaggccattctctagggaaccccactctgatgcgttggtctgtttatgtacctgacctccaaacccaagccttcttggcctactcatggcacaaagttttgacccctggccaggctccccagctctgcctctttatccattcaccttttgcagcctccgttcgtttaggcaggtccagtgtgtcaaagttccggtccatctctgcatccttcttccctgaaacagaagggtggtacgaattgagagggaggaagagtccatgacagacaagtgtgtggcaagagttaggcacagccctctcctgctcagagcccaaaggggacctaagacaccctggcagagatgtactgtcctcagagaagtcaggctagcccaggacagaggtggcattggagcgtaggaacagcctaaccatgtcctgagtacgtaggcctccctctcatcaggggcattgatgcagcataccagaccacagtgcaacaaggctggcctaaaagttccatccaaggggaaaacttcccctagttggggaccagccgtcggccaacctatagcagccagcaagccactgcagatgacctggtgttcctgccctgcttacccatatatacttctgtgctacacatcacccatttcttccgaggggcagatggtcccctggtgctggccactcctaggccctgcccactgtttgctctgtcccagtgctggcttggtagcttgttctgactttgtaagcagcagcccctgggcctccccaccagcccagggctacattccagcctctgtcatgtctatgcagttgtcatggagatggctgcccttccaggggactggggggtggggcagggcctgaaggctggatggcatcccagctgccctacagttgtcatggaaataactgcctgagcctaggtaacagagtgttactctgttgcccactgcacttgccagacctggacagcagaacaaacagggactcaccttgatggaaccactcctctgggcggccggaggaagcacaggagagagcagatgagcctgagcagcagaaccctcccatgacttacatccccacccatggcaggccaagcaagacaggactgtgcgacaggactcactccgggaactccggggaaggactcagtacccggaaggcacagggcagagcacctgtcccactgctacagctggaggatgcagggacctgaacctgtaccctgcaaatgctgagggcacctggccaggtgaaggagagggctgtgctttgcaggctgctctgtgaatagccaggtagtgtcatttatgggccctcagatccttccccagaggagacaaaggtaaaagcaacccatgacccacaggaaagggttaaggctaggcctggagtctgcacctttcccacttgctgcacacccatggggaccgactggatgtcttcaggactctgggaccactgccatggacatggagagccctgagccttggaagcggtgggaaagagacacatctccgcctcacccacccaccttttgctttcttgccaccaaagcagctggcgtcatccttcctccgtcgctgggaggttgtgctgcccgggatcccaggctctgcctcctggtacctgtcagcccctggaacttctttgtgcacgtggtaggacaggttccgcatgatgcacacacagttctctactgactgtggggaagaggtgtcctggttgagcagaaaacactggacaagggggctgctgagcgtccagacccttgtgtgaagccgtggctagttaacaacagtggcactgtcagcctaagatggggagaactgccagagcgaccctgtgtcatgtccctgtgccatgtgagggactgtgtgtcttgttctggatagttacaacctgttctcatctgtgccattctggggtactccctgtgacccttggcctctgttcctgtgaccctcgggctgagaatctggagggcaggctgctccccatctgccccacccaccttattatctgtgtctttcctgcccacagctgactgcagggcatgtaggagagcgtccaccagcccttcgcactcacggagtcgccgccgggcctctgcaccatctgagctcacattcctggatgggagggagcaggaccaccagtgactacccccaccccccatttttgttccactaaattccccagaccacagggacttttatctgcacagtagaccctgctggatctcagtgaaggtgaacagggtggccaatcccaagcagtcaggctttagccttgtatgaggggggtgagggtgggggacaagtccccctgctcccagctgaactggaacaggatagagatgggccccaaggggccagaatccatgatatgtaggtaattctgcccctcccccaaacagcagtccccaggaccctgtagggtcacaacggtacaaaactgatggacaggcaggacctcagggacgcagaattctatctgtgggtgtgagcagatctccactgcaaaccccagagacttacgatgtggctcaggaatgcctaaactttgaacaagctgggatataaacatggcagctcctgccaccctacagacaggcctgtgccccaaccctgcccacacctcaggcagcctgatgtgttcttgaagactgttgtccactcggcatcccggggcttcgagtcttcgttaggctctcgctcccagccggaatggggcacgatgacctcatgggtcagagtctgtaagccgtggtcaatgatgaccatcttcaggggctcgtaggatgacaggttccagagtgtgcctgtaatgtgcctctagtcaacactgttgaccatgaccctactgcctcggcctccccagggatgacacaatctgcttctgctttccctccttgtcctctagccagcacctgaacccagcatagttgctactgtttttgtggggtgtgggggtggagagcagggataggaagttgtctcaaagatggcacccagggcctttgcacatgttaggcaaacatttacactgagtgacactcagttcacataaggaccactgaaagctgtaagaggttctgggccctgtacaacaagatgtatgtataggcagcacttagtaggagctttcagctaacaaggaaaaactatagaagaggcataaccagtgatagtttatcccatccattccctgttacacccaagtgggtggactggcaaatgctcctgagactacaggaccatggacacggtcctgtgactcccaagctctccaaggcacaagctccagtttaggaaccagggcgacagggtctggtgccagcaaccccatggttgagagagttggggacccatcccacaacatgggcctgctatactcctgtttccccaatttcgggctgagccacgctcatgtcagctatggccaatgcccactcaccagtgaccagctcacggacctcattgtcacgggccgcccgcagtaggcgcaccagggctggcacgcccccgcagtcccggatggcggccttgttgtcagtatcccggccataggagaggttgcgcagtgccccacaggcccggcgccgcacctcagcccgagggtgatctagtaatgccacaagcagggggagcccacgcagctgccgcactcgccgcttaataccctcgttctcaaagcagaggtgctgcaggtaggctgcagcattggctttcacagggtccacagggtgccgcagcatggccaacacctctggcagctcggggtcccgccagcgtggctccttgcgggtgctatccactgaaggtgagcgccgcactactcggtccaagctgcccaggctgcccctctcaggctgggccagaggggctgttgctgctggaaatgggggacgctcttctatcagctcaccagcatcatctgctgtgtcttcaaaggccctgtgtggatgaacagatcctgccaataccttcacagttagctgccagcccaacccccccccccatctagtccaggggcctaggaattccctgccaagggggactgacagcatcctgcatcagctccaaacagtgtggacaccaagaggtccagcccagcccagcccagccagtgctgctgcaaggtcaagattacagcccatgtcaggaagtttgcttcttaacagtgttacttaatcgtgacttaatgtcagtgtggcatctgttggggacagggcaggactcccacgt

SEQ ID NO: 1322 - DNA, 1253 bp, Mus musculus
ccgtgtccgcggccggaagcgcctgctgggtccacgcagcgccgccaccatcgccgccaccatcgccgccatggtccggggacctcaggcggtcagggctgcccttcgcactgcctgagcgtccgcgcctcggggtcagacctgtgcgcggccttgacgagatgctgttggctgctgtctcattgggtctcctgttgctggccttcctcctgctcctgcgacacctaggctggggcttggtggctattggttggtttgagttcgtgcagcagccggtccacaacctgctcatgggtggcacaaaggagcagcgcatcctgcgccatgtgcagcaacacgcaaagcctggagacccccagagcgtcctggaggccattgatacctactgctcagagaaggagtgggccatgaacgtgggtgacgcaaaaggccaaatcatggatgcagtgattcgggagtacaggccctcgctggtgctggagctaggagcttattgtggctactcagccgtgcgaatggcccgcctgctgccacctggagccaggcttctcaccatggagattaaccctgactacgctgccatcacccagcaaatgctggacttcgcaggcctacaggacaaagtttccatcctcatcggggcatcccaggaccttatcccccagctgaagaagaagtacgatgtggacacattagacatggtctttcttgaccactggaaagaccgctaccttccagacacacttctcctggaggaatgtggcctgctgcgcaaggggacggtgctcctagctgacaatgtcattgtcccgggaacccctgacttcctggcgtatgtgagggggagcagcagcttcgagtgcacacactacagctcatacctggagtacatgaaagtggtggacggcttggagaaggcagtctaccagggtccaggcagcagccccgtgaagtcctgaccactcagcctgatgagcttccgtcccagctcccttctgcacgatgacacacactcactctgaccccctctatgcttctggggcctttcctcagggcctgtggctccagattgtcatacactggcacattaaaggtagtgagctcaccatgcaaaccactacaatacccctggaaaacacctgtgcatcaaaggctgcattgaggccagagatgcagtagatcacagtgcgtgcctggcacgcaaaacccctcacggtgaatcctctgcacccaagaacaaaaagggagattta

SEQ ID NO: 1323 - protein, 318 aa, Mus musculus
VSAAGSACWVHAAPPPSPPPSPPWSGDLRRSGLPFALPERPRLGVRPVRGLDEMLLAAVSLGLLLLAFLLLLRHLGWGLVAIGWFEFVQQPVHNLLMGGTKEQRILRHVQQHAKPGDPQSVLEAIDTYCSEKEWAMNVGDAKGQIMDAVIREYRPSLVLELGAYCGYSAVRMARLLPPGARLLTMEINPDYAAITQQMLDFAGLQDKVSILIGASQDLIPQLKKKYDVDTLDMVFLDHWKDRYLPDTLLLEECGLLRKGTVLLADNVIVPGTPDFLAYVRGSSSFECTHYSSYLEYMKVVDGLEKAVYQGPGSSPVKS

SEQ ID NO: 1324 - DNA, 47318 bp, Homo sapiens
cctcagcctccagaatagctgggactacaagcaccgatcaccacgtccagctaaatttttttgttttgtagagatggggtctggctatgttgcccaggctggtctcaaacacctggcctcaagcaatccttccaccttggcctcccaaggtgctagaattacaagcatgagccaccaaggtggactaaaacattctcaagtccacgtgcctttcagttgtgaaggctgccctccgtcacaagtgagcaagaataaaagcacaggccaggggcggtagctcacgcctgtaatcccagcacttttggaggccaaggcgggtggatcacaaggttaggagatcgagaccatcctggctaacacagtgaaaccccgtctctactaaaaatacaaaaaaattagccgggcatggtggtgggcgcctgtagtcccagctactcgggaggctgaggcaggagaatggcgtgaacccaggaggcggagcttgcagtgagcggataccacgccactgcactccagcctgggagacagagtgagactccgtctcaaaaaaaaaaaaaaaaaaaagaataaaagcacaagcagcccctgtccctcacagctggccagtgcacacagccagggtcttggtgtgcccagctgcagtcagctaggagggaagccaccctgggcacagggagagctgcctgggctcaggtttcatccctggaattccttttgggctggttgtggtgtcgcctcaccttggtcctccatggtggctcactgcacatagtgccactctcagcctttttagcctgcaaaaggtgtcatcgtgtctactctgcaagctactggcgaggaaggcaggcaaggggcagccaaaaaagggagggatggagaagggactggagggaggaagtagagaggggaagtacactgaactgggcctgaggtccgggacacccagcaccaggcaccagccaactccctgctgaaggaaggaagaaataatagcaagtcatcagtctgctggggtgagggcagggtggggactgatgacaagactctagggtataaaacaagtagtgccctcagcccctctgcagacacgagcctgcccagatgagaagcaccaccctcccagagcatctggagccggtcgctgcttcagacaaggccaagaggttccatgatcagagcagggtctgtcatacaaggctgggcaacctgcccaacacctccatcagagcctagcgtctgccatgagaaggctgcacttatctttgcagccacctccaccttcctaggcaggcaaggctgcagagagtgtacttggagtgtcatgtctctccacaccctggccctgcagatgccccacagacaggtctagaacatgcactcctaaaggatacaagagctggagcctagaggagccctggctcacagctgagaaagcttgggaagctgcatccaggcactcaggccatggcctgcagcgagcctgccccacaaccaaacccacccactctttcacctggcagccagcctctgagtgcacgtgagatgtgtgcgcacctgcgggaactgacagagccacaactcggttccaacagccagtccaaagcacactcaattcctaattcaactcaagggctctggaaaggcctaaattgttgtaaattattctaatggctttaatataagtctagagaaccaaggactgctggtcagggagaaaatgccaccaggtcccccggggagcatgaacctgctgatggagaagcatctctctcctccagctgcctggtagccggaagctttgctcagaacgtccctaccttccatggcaggtgcctgtccttcttgttgccatagcagggcccttgttaggtcatcctgccctgcagcctcgcactgtgccccctctgtctgctatcaggcagggtgagcagctgtctgtatggatgtgcttatcttgggcagcttgctcgccccctgtgcacacccaggagccctctcgggctgataaacactggcatagggcagtcgtttgcaagcataggaaatctgcctttaagcacttggaagggcttgggtagcctgctgggaaggaaggaccccaaagtacctcaaaggtgggtagggcagatgctgttctgtgggaggaagggctgggtggcaggcgttacctggggacacaccacctgtgcactccagtgtcctggagaacctcataaccttgcctttcacccactttagccaggcataccctctccacctgcagggcttggccccagcaagtgtctgtcttgcctctgccttctgacatattgtccattaattttctgctcctctttgaacccactgcctggtacaggccagcaaagagcaggagcccagagctcatagcaaggcccaagagaatgcagcactgcaccagtgagggcaagtggaagggtcccccaaaatgtgcacccacaggcaggctggccacctcagggtgccacctcaggggccctcctgtatggctgctctatctagagctctttcctggcagcaggtgttgtcattctggctcctgttcaggggctgcatcgcccacccactccaagcctgggacagttcaggtcttcctactctaaaaggagaaactgcagggcccacagtcccagctactagggaggctgaggctggagggtgagttgaacccaggagttcaaggctgcagtgagctatgatagcaccactgcactccagcctggttaacagagtgagactctgtctcagaaaaaaaaaaaaaaaaaaactgcacccctagtctgggtacagtggctcacacctgtgttgcaggaagtcaggaaccccgaatggagggactggctggagccgtggcagaggaacataaatagtgaagatttcatttcaatatgaacatttatcaattcccaagtaatacttttatacttttttcttttttttttttttgaggcagattctctctctgtcgcccaggctggggtgcagtggcacaatctcagctcactgcaagctccgcctcctgggttcacaccattctcctgtctcagcctcctgagtagctgggactacaggcacccgccaccacacctggctaattttttgtactttcaggagagacagggtttcaccatgttagccaggatggtcttgatctcctcaccttgtgatatggctgcctcggcctctcaaagtgctaggattacaggcatgagccaccgcgcctgggcccccaagtaatacttttataatttcttatgcctgtctttatctcttaatcctgttatcttcataagctgataatatacatcacctcaggaccactgtgataattgtgttaactgtagaaattgattgtaaaacgtgtgtttgaacaatatgaaatcagcgcaccttgaaaaagaacagaataacagtgatttttagggaacgaagacaaccataaggtctgactgcctgtggggtcaggcaaaaagagccatatttttcttcttgcagagagcttataaatggacgtgcaagtaggagagatatcgctaaattcttttcctagcaaggaatattactattaagaccctggaaaaggaatgcattcctggggggaggtctgtaaacggccactctgggagtgtctgtcttatgcggttgagataaggactgaaatacgccctggtctcctgcagtaccctcaggcttattagggtggggaaaaaactccgtcctggtaaatttgtggtcagactggttctctgctcttaaaccatgttttccgttgtttaagatgtttatcaagacaatatgtgcacagctgaacatagacccttatcaggagttctgattttgcccttgtcctgtttcctcagaagcatgtgatctttgctctgccttttgccctttgaagcatgtgatctttgtgacctactccctattggcacaacccctccccttttaaaatccttaataaaaacttgctggttttgcggctcaggtgggcatcatggtcctaccgatacgtgatgtcacccccagcagcccagctgtaaaattcctctttgtactctttctcttcatttctcagccggctgacacttacagaaaatagaaagaacgtacgttgaaatattaggggcaggttcccccaatatctggcgcccaacgtggttttctttttcctaagtgcatgtgggaacccgattccctttggtaggtgcggagaaatgttcatcggtccagtccacagaaatgcttgtttggctccccaacgattggtgagttgtctgtgtattctccggggtaactatgggtcacgcagagtctaaacattatgcttatctctgctatattaaattcctgttaaaatgggggagttcgggttcccatggaaaatatggtcaccctattcagggcagtggaagaacactgtccttggtttcctgaaaagggaacgttagatgtggaactatgggatcatgttggtgcaaaattccgagaactggtcccaacaggaaattatgttcctgtcactgtttggggtgattgggccttggtacgtgccatcctaatgacataccaatcccgtgacaccctgcagttaccacagttttctgaatctggccaccctctacctcttcctcagctttcctctcccactcggccttcattatctgctcagcccctccctttgcctactcctcccccacctgacgatactgaggattcaatatctaactccagtgactttggcttaacatcaccccctgatgatcttatttcttttcacgaagagccgacacttgtagctcctgcggccccaactcagacagcccaggaccatatctatgctaactcttccctctccaaacctttacagtctttgcctccggagccatccaaactacaatttacctgtaattctgcaggccctcccccatccaccacagcccctcaccctcctatcattttggtccctcaaccggtcactttgccatccactcaacctgcttctctgtacccttcttcatgcagggacacccctgccactctggttgtgcaggactgggccagtaatcaccagtatgcttctgcctcttctgctcccccaatgcccctttctcacactcttataccagtccgaccccgtcaatctcagtttctcttatctatacatacttttcctgtcacttctatgccgactctatctcatgtgcctgctcttgaaactttcatgcaatgcttattacgccaaaacaaacaagtagattagaggcgtgggcttattcggtcatgctggaacctcctaatgctcaaggggtacaagtgtgtcgatatacgccgctcaatcttacctttttaaaagaattcaaggatgcttgtactcagtatggtcctacttctccatatgttaaaacggtattacagactctttgtaccgaggtcattttgcttcctatagactgcgaccttttggcaaaagctgttctaactccatctcagcatttacaattccatacctggtggtcagaggaggcccgcctgcaggctcagctaaatcgggctgatggcattccaattactcaggctcagctcacaggctccgataattactctgatactactgctcatttaggctttgatgctctcaccacggaacaagtaacaaaggtgtgtatgagagcttgggataaattacgcaccccaggccaagcttctgtttcttttactattgttaaacagggtcacaatgaattatatcttgattttttagctaaattacaagatgctgttgaaaaatctgtctctgatgagcacactcaaggtattcttcttcatatgttagcttttcaaaatgcgaaccatgagtgtaaaatggccgtgcattccatcctacgtcaaaatttacctgatcatgaggtgttgcctgcatatattaaagcttgtgaaggcgttggatcggagacccacagagctattctgtgggcaccggccatgaagcacggcaaccaaactggctcgactgattcttttcttggagcctgctataattgtggccaacttggtcatacccaaaaaaactacactgttaaaaacttaaaagcggccaagccggctcaacaaacacggccaaatgctcctgctactgtttgcctgcgttgtcgtaagggtaaacattgggcaagtacttgccactcagtctgatatagatgaaaatcccttgccacagaaccagggaaacaggaagcaaggccagtcccaggccccaatatcaaatgggacacctcggactcagaccaatgttgtgtttttgcgtcaagcagtcccaacgcagcccccagcacaaacaaatttacctacagccaatccagatgggtcccagcctcttcttctgtctcagtacaatgcttgtctacctccacagtaggcagcagggcggtcgatctctgtagtaccattcctctaaatttactacctaattctttgcctttaattgtccccatgggggtcactggccctttacctcaaggttcggtgggcctggtgttaggcagggcatccacctcatgatactaaaggtatcatagttcatactagtctcattaattctgattcctctgatgagattaaacttatgtaaacttatggtgtctgccaaagttcctgtttccattccggccagtgagtcaattgctcaattacttttactacctaacattgttttaaacaaaggagataagacatggggccctgggatgggctccagcggtgaaaaagccgcttattggattaatgtaatttctaaacaatggcctacctgcaccatacacattcaaggaaaaaaggttgagggcctagttgatactggggctgatgtttctattatttcctctaatttatggccttcctcctggcttaaacatcccactaacatgaaactagaaggtgttagaaaagctgaagaagttcaccagagcacatttatcttggcttgcactggccctgatggtcaaaagggaacaattcagccttatatcatgcccatccccattaatcttcggggcagagatttgctggcacaaattggggctgaaattaatattccacataacttttacagtgctcccagtcaacatataatggaaaacatggggtttgtttccagactcggtctcggtccaaaacgtgaaaaaattactaaacctcttcaagttactgtaaaagaagacaaggctggtttaaaagcataatttaactactccccactcccaattatatttagcattgtttaagctttctaaatgttcctaaaaacaatactctgactgcagctaaatgccattatacaggcaaaaaattctccctaaacgaaggcaagccagtgtcatggaaaaactcccaaaccaatacctgggaacctggaacaattataacgtggggaagagggtatgcttgtgttttaccaggagatcgtcaatcccgtctgggtgcccactaggagacttaaacttcgtgtgaatactgacaataaaaaccacgaggaagagacgttcgcgtcagagactgccctcatacctgatgagatctgtaccgactcctcagaaactggcatgccaaatcaaaatgggtctggttcaatcctccctaatggcaatgtaaacccctctaactaatcccacttctcctaattatctttttctccttacgaacctaaaaatctcaccatttctattagcctgaaaataacatccctctgttcttctcttcctccttcagcactggatctcacttacaataggttttatttaataattatcttccttacactttctgtctcaccagtttccccttaaactgatttacctgctacacaaaattattcttattgggcttatgtgccttttcctccacttattcgacctctcacctggatggatgctcctgcagaaatctatactaacgatagtgtgtggatgcctggaactacagatgaccgttgcaccgctcagccaggagaaggcactgcatttaatgttactatgggttataaataccctcctctgtgccttggacatgcacctggttgtatccatctagaagctcaagtctgggctgcttgtcttccagagagattagctatagggaaatggggacatttggtctctggcctctccctttctcctttaagacaaataaaaagaggagtaataggagataccccatactttcaatataaacctgtaggaaaaccatatcctaaaaattttgagggcccatctaaaacttcaatttgggaatgattgtgttaactcacatgcagtagtattaaaaaatgactcggctgggcgcagtggctcatgcctgtaatcccagcactttgggaggccaaggcaggtggatcatgaggtcaggagattgagaccatcctggctaatacagtgaaatcccgtctctactaaaaatacaaaaaaaattagccaggcgtggtggcagatgcctgtagtcccagctactcgggaggctgaggcaggagaatggcgtgaacccgggaggcggagcttgcagtgagctgagatcgcaccactgtactccagcttgggcgacagagcaagacactgtctcaaaaaaaaaaaaaaaaaaaaaaaccccaaaaaaacaactcatatggtttagtaacagactgggcacgaaagggctatttaaaaaacagttgctcctctggcggaaaggaatgcctggagactacttattttatttcttactgggaggaccaggatcatcatcctattttgcatagaaggttcagtttgttctttcccttaaaataggaagataagggcattatccccctaagtctcgtatgatattccccattctgagtccagaatacctagaaatttggaatttggctattgccgtgtctggactgtgagtatgggaaggggaagcttttctgtctgttgtccccactaccgcccctcacatccgtgattctgaaccccatgataaatgccctttgaacctttttcctccttttgatgccgaatccccttttatgggactccgccagcacgggtgcatttaaccttcctgagcttgcccacctgacgcatgcagccaagaagctttgaaagatggagtgccctggctgagggttccaggtctcagcaaggccacgaggtggtgactgcctcccagaactctgttgggccaccctccgtcctggagacccccaaaacctccatagcaccaactctgcccattcacacacacagtcagccctccctcccgagtccaccgcgggcagagggccagccaccatgcctcccatagccgccatccctgggaaggagccctgaccccgtccttacacccctctacactcactgcctgtggggagagctgctcgctgtcacaagcatccagggggctgggtcgaggggccccctgcatggtgggggaccatgttgtcgtgcatggaatgaaactggccacacataacagatatggtggcgctctggtcggatctaggggagtctgtcctacaggatgaggcttgaactgtcctgagtgaccagacacccagcctctgcttcgagtgctcagttatgattattgtcctgatttagttaactgttcttcaggggctccaggaggacgagtgtgtatcctcccattgctctgtgcagcctctaacctctagagtctaggggtctggggagaagttgggaagtctggccagtggggccggtgcctggtgacctcgggaggtgggatatcatcatcttcagaactgtagttgttactgggataccagctctgggagaccacaggtgcagtcagcacagcaggaccttagacaaggcacccagccccagtttccccacctgggaagggggctacttgtggctagaagcagcccggactcctgagcaagactagaccaagaggccggtatgtggacacccccgcgtgggcacccccacggggacaccctggccaccgccgcgcggacaccctcacgaggacaccccggccgcgcggacacctaccgcggggacgccccgaccccatcctacctgctgcgccccgcgccgcgccccgcaccccgcccgccacggcctgcgtccgccaccggaagcgccctcctaatccccgcagcgccaccgccattgccgccatcgtcgtggggcttctggggcagctagggctgcccgccgcgctgcctgcgccggaccggggcgggtccagtcccgggcgggccgtcgcgggagaggtgagagcgctggctagaccggggccgaatgcggccggattcggggcgggggccttcagacctagggtggaacactgggatagggtgtggggaattcggaccgctgtgaagtgatctgacgttgggtgggagtctccggacttggggtggggaatctggatgggaactggggaattcggaccttgggtggggatctttggaccggggtggggtccccagactccttgtggaaagctgaggttgaagatctgtgctgtgatgaggggctccagatagcggtgagagatcccgcttcaagactgggttgggggtccagaccaggaggataagcctctccctggagtagggcttgacctggtgagggtgtggtagagtcacaggggagggtcccacttggtccttgggctgggatcagactctcagagctggagagttgcaggaggcctgggggagggtctgtggagccccagactcagagggccttggtgacttctccaacaggctccctgttggaggccttggggtaccccagggcctttccctgcaagagagaggctgctccaccaggaaggggcccaggactccccagggtcggggggatgtgtggtgtgcaggaccacgtgggaatgttagagaaaggggaagtcactccgggcctgccctgctaacagacctgctttttggatttttccagccagggatttttgtgtcctgttgctttttattgtttaaagtgaccctccaagcctgagggaccgtaggagctgccctgcagagcccagtgagacactagttaatgcagaaaaaacagattttacttggtaactactgacaacatgagaaaaagctggctccatgctgatttgtctagatgtgcctggagtttaaagggagagtgagggagtgggaaggggtggggactcagtagagttagggaaacagaaaatcaccaaaactgggaagggagggttggcccctgtgaaaccaactgatctgggtttgccactggggcttaccgaagtcaggcccccaacctcccacagagactgggagacaggggccccatcctcaggtgttggctggaacacacaggaaattcttgtggcagccttgaacttctcaggcaggcactttagagggggctaggatcgttctgggaatgtggccttgagctgttaggagctatgttagtgttcgttccagcctagataggccagggtgaggcccagtggagaaggggactctaaggagcctggctggagtgtggggagggagggtctttgtcagcactccccctgtgcaagaagagcagagacctgcttctttcctctcaacagtccccgtccattttctgttctgtgttgtgttcataaactaccagcgggaccatctgttgagacttggtagcaaaggatttttgctggatgatgcaagcagtcaagcatttaatgaggaaacaaaaataacaggccaggcacagtggctcatgtctgtaatcccagcacttttggaggccgaggaggatcacttgaggccaggagtttgaaacaagcctgggcaacataaagaccccatctctacaaaaaatttaaaaattagcccggcgtggtggcatgggcctatagttccagctgcttgggaggctgaggtgaaaagatcgtttgagcctgggaggtggaggctgccatgagccatgatcttgcctctatactccagcctgagcaacagagagcccctatctttaaaaaaaaaaaataataataaaataaaaaaataaaaagaaagaaagaaataaaaacaaagatgaatggagctgttgataaacccagtttttgagcctacagggcagcagttgaggtttctggccgttgggccctaacaaggccagcaggggcactcagggacttcctggtgtgtggtgtgaagtctgtgatgatggcataggcattggtatcccagttgtggttactttctggagagagcatgcggcatgcaggagctggagggggggtcttcctgggcggcctgtgtagcagcagctccaggcacaaaggctgcccctggagaatctgttgtggttctgagttctttcaagtttatatcaagttttccggcttcagtctgcagggctgtttttttcagatcctgggggcaaagggcagctacaagaccacctgagtcccaatagggatttgagttcttggtgacaccaagtcagggaggagacaaattagaaatgtcagtctgaagagagtggtaggtagccagatactgaaggaaagtagatgggaggatttggtaagggctgacgtgtaggaaggcagtgacagtccaagtgacaggcagatcataaaacctcaaggataggccgggcccggtggctcatgcctgtaatcccaagcacttcgggaggccgaggtgggcaaatcacccgagtccagaagttcgagaccagcctggctaacatggcaaaaccctgtctctactaaaaatacaaaacattagccgggcgtggtggtgcactcaggaggctgaggcgggataatcgcttgaactgggaggtggggggctgcagtaagccgagatcgcaccactgcactccagcctgggcaacaagagcgaaactccatctcaaaaaagaattaggccgggagcggtggctcacgcctgtaatcccagcactttgggaggccgaggcgggtggatcacgaggtcaggagatcgagaccatcctggctaacacggtgaaaccccatctctactaaaaatacaaaattagccaggcgtggtggcgggcacctgtagtcccagctacttgggaggctgaggcaggagaatggtgtgaacccgggaggtggagcttgcaatgagccgagatcacaccactgcactccagcctgggcgacacagcaagactgcgtctcaaaaacaaaacaaaacaaaacaaaacacctacaaaagacagtgaactagactaggatctgataactcccaagggggtgttatatttctccactgaagcatagcatttctctttacaaacccttcccttttgattgaagataatcaaagtgagattattcttatttaccaaataattctggtctcattaaatttggcctgattatttacataaatgcagcacgaacagtaattgaccacacaggcctttttaagtttgctgaaacttttaatagggaatcttagattgagctttttaaagccttt[450 bp omitted]aaagataattgcttcaattttgtttagagaagtatcatttactataatattacgagtcattgataggttaagagaaaagggaaaggtttctttctttttttcttttttgaggcagagtctcactctgttccccaggctggagtgcagtggcgtgatctcagctcactgcaagctccgcctcctgggtttacaccattctcctgcctcagcctcccgagtagctgggactacaggtgcctgccaccacgcccggctaattttttgtgtttttagtagagatggggtttcactgtgttagcaaggatggtctcgctctccagacctcgtgatccacccgcctcggcctcccaaagtactgggattacaggcgtgagccaccgtgcccagccggggaaaggtttctttttttaatattcagaaaataaaacataaagagccaacaatattctgaacaaaagtcataaaaagactgtaatcatccttcagcagtttactcagttgcatgcaggtactgaattcttgttctgcttgatcttgggctagcaggtacatgaacccatcttttctcaaccagtggagatcctggctcagtgcagtcatgtgatctcaaagttaagaaatgctgtcacgcccaggtgcagtggctcaggcctgtaatcccaacactttgggaggccaaggtggctatatcacttgaagtcaggagttcgagaccagcttggccaacatggtgaaaccctgtctctaccaaaaaatacaaaaattagccagttgtggtagcagacgcctgtaatcccaactactcgggaggctgaagtgggagaatcgcttgaacccgggacatggaggttgcagtgagccaagatcacgccactgcactccagcctgggcaacacagtgagactccatctcaaaaaaagaaataaggaaatgctgtcagaagcctaccccatggtacctgtcatgggccttttcattggtccctttttgttgaagatgaagcactttgccctgtagctgattgcaagagatttcaggaaagcatcagagtaaaactctaatgacaaaagacttaaaatagtgtagttaaatatctaatgagagatcattacaaaatcaaacgatttacaaggaatgttggttgtttatgacacatagcattttaaataataaccagaatgatgattgctgttatatgaggacatgtcattggcagaagggtattcaccagtttgtgggaactttatacaatatctggaatccttatattaacatttaccaatatgcatgtaactcaaggaagtttaaatagcattaaaaaaaatttttttttagtttttttttttttttttttttttgagacagagtcccactgtgttgctcaggctggagtgcagtggcacgatctcggctcactgcaacctccgcctcctgggctcaagcgattctcctgcctcagccccccaagtagctgggattacaggtgtgcaccatcacacccagctaatttttgtatttttagtagagatggggtttcgccacactggccaggctggtcttgaactcctgaccccaggtgacctgcccaccttggccttccaaagtgttgggattacaggcgtgagtcaccgcgtccggccctaaataacattttttatttgacagcaccttgcatgaaattctgtagggtccagccctacagggtctgtgggtttttctccccgtgtgcagagatgagagatcgtagaaataaagacacaagacaaagagatagaagaaaagacagctgggcccggggaccactaccaccaagatgcggagaccagtagtggccccgaatgccaggctgcgctgttatttattggatacaagacaagggggcagggtaaggagtgtgagctatctccagtgacaggtaaggtcacatgggtcacgtgtccactggacgggggcccttccctgtttggcagccgaggcggacagcgagaggagacagcttatgtcattatttctgtatttcagagacctttagtactttcactaattttgttactgctagttagaaggcatagccaggtacagggtggaacatgaaagcggaccaggagcgtgactgcttaagcacagcatcacagggagacggttaggcctccggataactgtgggcagacctgacactccacaagaggtggttgagcagagtcttctctaactcccacagggaaagggagacttcctttcccggtctgctaagtaacgggtgctttttctaggcactgacgcaactgctagaccaaggtccgctaagtaacaggcgtcttcccaggcgctgacgttaccactagaccaaggagccctctagtggccctgtccgggcataacagaaggctcacacgcttgtcttctggtcacttctcaccgtgtcccttcagctcttatcactgtatggcctggtttctcctaggttataattgtagagcgaagattattataatattggaataaagagtaattgctacaaactaatgattaacaatattcatacataatcatatctatgatctatatctaatgtaactattcttattttatatattttctttattatactggaacagctcgtgccctcggtctcttgcctcggcacctgggcgacttgctgcccacaaaattcaccattgaaataaacctaattagtttaacatctctcttataaggtcacaggacagatcctttgaggtcttccaggggccctccaggaaatctcaagtcagtctgagatcaagacaatgtcacaggccacatgcagtggttcacgcctataatcccaacactttgggagtccgaggagggaggattccttgagcccaggagtttgagaccagcctgagaaacatgctgaggccctgtctctacaaaacaaaaaattgaaaaattagctgggcatggtggtacatgtctgtagtcccatgtactctgaagactgaggcgggaggatcacttgagcccaggagttcaaggttgcagtgagctgtaattgcaccactgcactccagcctcagtaacagagtgagactctgtcactaaaaaaaatttaggctgggtgcagcggctcacgcctataatcccagcattttgggaggtcaaggtggacagatcacctgagatcaggagttcaagaccaggctggccaacatggcaaaaccccatctgtactaaaaatacaaaaattagctgggcgtggtgccatgtgcctgtggtcccagctacttgggaggctgagacagcagaattgcttaagcctgggaggcagaggttacagtgagcccagatcacaccatggcactccagcctgggtaacagagcgagactctgtctcaaaaaaaaaaaaaaaaaaaaaaaaatttaaagaaactttatacataaatccattcaatgattatgaggtcaattctagccagctttgacctcataacataaaatttcttttctgcagactttcttgaggccaggagttcaagaccagcctgggaaacatagggataactttctgtatccattcacagttgcttttgttttgagacagaatctcagtctgtcacccaggatggagtgcagtggtgagatctcagcttactgcagccttgacctcctgggctcaagcgatcctcctgcctcaccctcccaagtagctgggactacaggcatgtaccaccatgccaggctaataatttttgagtttttttatagaaacagggtttcatcatgtttcccaggcttgtctcgaattcctgggccattcaggctttgtcccatatttttcctctttttgtaattttacttcaggacaaaattacatccctttctttaacaaaaacactctacattctttgcatacttttcatataaaaacacatcctatcttcctcccatactttgtataggaaattgtttccctcattcttattgtttctaggagttttgttttcatatattgattataatttttaaccattagtaaccggtattttttttttaaagagacagcgtcttgctcttttgcccaggctggagtgcagtggcacaatcaggactcactgcacccttgaactcccgggctcaagtaattctccaacctcagccccctaaagcactgagattacaggcatgagtcaccacgcccggccataacttgtattttacaagtaaaactgggaagaagacaattggaaattgtctgtcatttaccagtttgttggcaaattttatgaatataccatcttataatctctagaggtatatcctttttatagtacaatgtttttaagtgccaagtacatgtttattaacagaccagaatacctttagccagtctgtaccatataaaaataagaagccaaaaagtacaaaaagttacgcttaataatgaatgttgcagcactttcttctcttcaggtattatttagatattcaatgaatgtctattatttaacttcacttagtatgactctgaggttgaaagttactgaaaacatcttggaagcttttttaggccaatatattatcaaacgcaattaacaaaacacaactcactagtttatataagagctagttctcacttttttttttactctattttatatattttttcttttcttttcttttcttttcttttttttttttttttctgtagagacaaggtcttgctgtgttgcccaggctggtcttgaactcctagcctcaagtgatccacttaccttggcctcccaaagtgctgggattacaggtgtgagccaccacccagccctattttatatttttatctgaactgtgtttctggcaaattggacaagttaagggtcacttgctccatgtgaggggaaggctttctacctgtatttgtggataagacctttacgacttgttttgccctgatggatgactacatgtttccagtgagctcagctggttgcttttgtgggtccctgaggcactgcgagcccctgatggggcaggaagcctaaagttccagggaccgtggggagttgaggggctggagggggaagagagaggcctgcagcggggatccacaggtggaggaggccagacttgaagggggtgtctccttcaagagaaagtagggaagtatggaggtgataggaagggagaggcctgagaggagctagtttggggagatctcaagtatcccaaaggagccactgatgttccaaattatccttggtaaagtcacatcaacaaggaaggaagcagacagaggcgcacttgttccttgcagttttgttttgatgtgctgattaaagtagcgcagagggcatgatcagcagggctccagtaagacgctcccacgggaggagcaagaacacagaacagagggggcaagacagctccaccaggagtcaggagtgaatcccctctgggaacgaggcactaggaagaagaacttccagcccaggaggtaggtagcgttcagaagaagcctggggcgggcgcggtggcgcacgcctgtaatcccagcactttgggaggccgaggcgggcgaatcacgaggtcaggagatcaagaccatcctggctaacacggtgaaaccccttctctactaaaaatacaaaaaattagccgggcgttgtggtgggcacctatagtcccagctacttgggaggctgaggcaggagaatggcatgaacccgggggacggagcttgcaatgagccgagattgtgccactgcactccagcctgggcgacagagcaagactctgtctcaaaaaaaaaaaaaaaaaaaagcctgggactcttagcgcctcagagccttactcagaatcataaaatcattagaagcaatgtctgtcctcactgctgcatccgatattcttccggaccactggatcacaaatcaaaccatgtgactcccgcatgagcaggcagagtggagataacacggatcgctgtgtacactgtgtgctccggttgttgcatccgagggttgatcggatggtggttcccatccagatccaagtcctggcccctgatcacagagaaacacagctggacattaaagtggtgaggacggaaattataatatttggtgaccagtgacaggaggggagagagccgagctccgctccgagttgtgcaaagaagtggggagtggggaggaagaacagtggggactcagtggagtgaggaaagtggaaaattaccaaaagcaggaagggagggttagccttgggaaaccgatctgggtttgccacgggggcttactgaagtcaggcccccagtcccacagaggctgggagacaggggccccatcttcaggtgttggccagaacacaggaaattctcttggtagccatgactttctcaggcaggcgctttgaagggggctgggatcattttaggaatgtggccttgagctgttagaagccatgtgcagtatggcttacacctgtaatcccagcactttgggaggctgaggctggagaatcacttgaggccaggagtttaagaccagcctgggcaacgtagcaagacgctgtctctacaaaaataatttttaaaaaattagccaggcactgcggcatgcccctgtgtagtcccagttactcaggaggctgaagcaggaggactgctggagcccaagagttcaaggttgcagcaagctgattgcaccactgcactccagcctgggcggcagaggtgatcacgccactgcactcccgcctgggcgacagagcaagaccctgtctttaaaaacaaaaaggccaggcaggtgcggtggctcatgcctgtaatcccagcactttgggaggccaaggcgggcggatcatgaggtcaggagatcgagaccatcctggctaacatggtgaaaccccgtctctaccaaaaacacaaaaaagttagccgggcgtgctggcgggcgcctgtagtcccagctactgggaggctgaggcaggagaatgccatgaacccgggggatggagcttgcagtgagccgagattgcgccactgcactctagcctgggagacagagcaagactccgtctcaaaacaaaacaaaacaacaacaaaaaaaaaacagccgagcgcagtggctcacgcctgtaatcccagcactttgggaggccgaggtgggcagatcacaaggtcaggagttcaagaccagcctgaccaacatggtgaaaccttgtctctactaaaaatacaaaaattagctaggcgtggtggtgtgagcctataatcccagctactcaggaggctgaggcaggagaatcgcttgaacccaggaggcggaggttgcagtgagccgagatcgcgccactgcactccagtctgtgtgacagagtgacagcccgtctcaaaaaataaataaataaataaataaataaataaataaataaataaaatgaagcagcagcagctttgttagtgtttgttcaaggcctgataggccaaggtgaggctcagccgagaaacgtgctcagaggagcctggccggagtgtgatgggggagtctttgtccaggctgctgccacggtgggcctcaggactcatggcctgggcgctgggggtggggctgccactcagccttgaggagagcaatgaggaggtcagattccactcacatccagtgcggtctggatgcaggcctggcccagagcctggtccagatgctggggctttgtttttttgttgttgtttttttgagacagagtctcgctctgttgcccaggctggagtgcagtggcactatctccactcactgcaacaacctccacctccacggttcaagcgattctcctgcctcagcctcccgagtagctgggactacaggcacccgccaccatgcccggctcattttttgcatttttagtggagacagagtttcaccatgttggccaggatggtctccaactccagaccttgtgatctgcctgcctcagcctcccaaagtgctgggattacaggcgtgagccactgcacccagccggctttgtttacagtactcagcagctgccaaaatagtccccattcccaggcagggcaggctcccgggctcagtccagcggggcagatggccagcctgcacgtcaccccactaggcatgtccaggccctttctgcccctccctaaaggcacccctgtcctttctgtcccctccacactgagccaagccagcctccactcttgccccaggcctgccctctgctgggagccgggacactgagctcctgccacatgagcaggttgacctgcagggggcctccaagcaggtgccaaggcagaatcggatgtgaccaggagaacacccttgaaggataaagcgaatgtgcgaccaccatgcaggtctggcccatggaagggaggggagggggccccgacggggccacagtaaaggagtggaggggccccacaggcagggatggcccagctggccccctggggctgtgaatctgcaggtgcagtgcagcctcttgcctctctcagcccagcccttgcatctgcctcttggtgtgtctgtgaagacaaagtcaccgtggtccctgcagcacctggcttgaagcaggtgtgcagtccgtgtgaaagccttccctttagctattaggtattgagtcaaaaaaaaaaaaaagccttcccctgagcctgggggcctggccccactgaggataccaggcgggggaggctacaggaggctgccctctgcctggccatctgaccttccattctgaccccttcccttccacaccagcccctttccctatgtagggtgcagtctttgttgcaactgctcacctctgccatggtcggatgagagcagccacggacaatgtctgtgcaattgtgcgttttttgttttgttttgttttgagatggagtcccactcttgttgcccaggctggagtgtaatggcaccatctcggctcactgcaacctccacctcccgagttctagcgattctcctgcctcagcctcccaagtagctgggattacaggcatgcatcaccatgtctggctaattgtgtatttttaatagagactggggtttcaccatgttggtcaggctgttcttgaactcctgacctcaggtgatccacccgcctcagcctcccaaaatgctgggattacagacgtgagccaccgtgcctggttgattgtgcgttctgataaagcttcatttacagaaatagcaggtaggcccctcgcagggtgcccagagcaggtgcactgtctcacctcttctcaggtgtcaccggggtgagaggctagtcctctgcctcctccttcctctctgcaggttggagaaatgacagcttcttgtactgggggttatgagacagtggcaggagggggacactcccagagtgctgccagaaagaggcgaggccccatctggatttgatggcatttttattgtggtgttgttttagagacagtgtctgtcgcccaggatggacgacatggtgcaatcatggctcactccagcctccaactcctgggcccaagcaatcctcccacttcagcctcctgagtagctgcagctataggcacaccaccatgcctggctcaatgggtattttgtggccattaaacttctggtcattcctttagattcccagaggctggatggaggtgagtggccagcccctgggtccagagatgagcgcggggcctggctgcagcctgtggggtctcccaggctggcctccaggtgtcctctcagcctgtccacaggcgctgcccaagcgtgtggcctacctggtgctgcctggcctgtctctacgcacctgtactggctctccctggattactggatcgcagtcgaatcccctgccagaatcctggtccccctttatcacaccggatcagccccaaagggcagggcttcttgcagcagttccagcctttgctgggggtttccagccctgttgagcaagccccaggtagggccctctgcagcccccgtgggggacctgtgtgccgagcagagctgccccgtgtgtaaacgcttagaactggcctccttcctgccatctgtgtcctgtttgtcatcacgcctgtggctctatgcttgtctccccgactgggccaccagccctgtgagggcaggatgaggcacgtccaagccacagtggctctcagtgtgcagggtgctgttagcattggttctgtgttctggaatagtgagaacagtgtgccccaaatggccagtggcctttccgagggtcactgcagccgcatgttggccctctgtggagaacggaggatgcacagccatttcagagcacaacctgaggtctcctgagcttgctgtgcagcccagtctttctctccgtggcccctggtagctgtctttctcccaggaggaggagaaagacaccttcctgagcaggaggatgtgggtgaatagagaccaaagtgtcaatcactcttctgacagaggtgatagcagaatgaaaaactgatggaccccagatctttgcaaagagaacaaagtcagtttctagttatctttctttcttttttttctttttttccttttttttttttttttttttttttgagatggagtctcgctctgctgcccaggctggagtgcagtggtgtgatctcagctcactgcaaccgcctcccgggttcaagtgattctcctgcctcagcctcctgagtaaccaggactacaggcacacaccaccacgcccagctaatttttgttatttttagcagagacagggtttcaccatgttggccaggatggtcttgagctctctttttttttttttttttttttttgagacggagtctcgctctgtcacccaggctggagtgcaatggagtgatcttagctccctgcaacctctgcctcccaggttcaggctattctcctgcctcagcctcctgagtagctgggactaacaggtgcttgccaccaagcctggctaatttttgtatttttagtagagacagggtttcaccatattggccaggctgatctcgaaatcctgaccttgtggtctgcccgccttggcctcccaaagtgctgggattacaggcgtaagccaccacaccaggcccattttctagttatcttttacggattttttaaaatgagcctagaaaccaggtcatataattagtttattttttaatttcttatagagacagggtcttactatgttgcccagagtggtcctgaacgcctgggctcaagtgatcctcctgcctcagcctcccaaagtattgggattacaggtgtggccactgttccagccatagttcatattttaaaggatttttaagagtctcatttcactgatgttacttgcagtatatttatggaaaacattcctgtcttttttttttttttgagacggagtctcactctgttacccaggctggagtgcagtggcgtgatctcggctcactgcaagctccacctctggggttcacgccattctcctgcctcagcctcccgagtagctgggactacaggtgcctgccaccacacccggccaattttttgtatttttagtagagacagggtttcactgtgttagccaggatggtctcgatctcctgacctcgtgatctgcccgccccggcctcccaaagtgctgggattacaggcatgagccaccgcgcccggccagcattcctgtcttttaaagaaagatgagaccagatgcagtggtgtgcacctgtggtcccagctactcaggaggatgccttgagcctgggagttcaaggctgcagctgcagtgagccttgatcacgccactgcactccagcctgggcaattgaacaggaccctgtctctaaagaaataaaataaaggcagatgaatgtcatctagggtgtgtccaatgtgagagagaatactgaccaggtgacagaggtgatggactctctagctctgcagcagactgctgggcagagaagcttgggcaggcctggcactgaggcccagaagcttcatgctctttagagccagaggtgtcaagcccagctgcctgtgtcctggccgcactgtgaggcactgaggatgccctcacacgtgcatctgcatgtggcgtgcatgtggcaagcatgtgcaggtgctgtgtgggcacgatcatgcctgccctctactgtgctggagaggtaagaccatcagccgtttcacagaggagggaatgtggacctcacgggggtctcatgagcttgcgagccgatggccaggcagccggtgcagaaggttcatccattttgatgaaccgtgaattcatctgtactttattcattttaataactgaatcatacctcattgtatggctctaccatgttttattatccattcaggtgctaacggatggaagggttgtttctacctgttggccattgtggatgatgttgctatgcatattggggtacgagtatctggtttagtccctgttttcaattcttggtatacacctaggagtagaattgctgggtcatatggtagttctattttaacttttttttatttttaatttttgtgggtttttaagaattttttaatatttgtgggtgcatagcatgtttaattttttttttttttgagacggggtcttgctctgttgcccaggctggagtgcagtggcaggatcacagccctgtgcagcctcaacctcctgggctcaggtgatcctcccgcctcagcctcccaagtatctgggactacacgtgcggaccaccacgcctggctaatttttaagttttttgtagagatggggtcttgccatgtttcccagactggtatgggactcctgggctcaagcaatcctcccatcccaacctcccaaagtgctggaattacagtcatgagccaccaggtctgaccacatgtttaactttttgaagaactaccaaactgttttccacggcattcacaccagcaatgcaagagggttcccatttcatcacatccttgctaacacttgttattttccttaaaaaaaaaaaaaaaaaaagccagctgggcacggtggctcatgcatgtaatcccagcactttggaaggccaagggggtggagcacttgagctcaggagactagcctgggcaaaatatcgagaccccacctccactccatctctaccaaaaaaaaaaaaaaaaaaaagctgggtgtgcggtggtgcacatctgtcgtcccagctacttgggggggctgaggcaggaggatcccttgagcccaggaggtcgagactgcagtgagctgcgaccgcgccactgcactccaggctgagcgacagagtgagaccctgtttcaaaaaaacaaaaaaaaagcacatttcaaacatacacaaaagcagagagaattcccctcggtcctccggcctgcaccccaccgccccccaccacaggggcattcaaaactgtctttttgcctctctgtaaggtaaggggggactcttgacgctccccagaccacacagccaaagtagggcgatcggatcatagggggtcccgagtcggacactgagctggcgtgcccactctcgagtcctgggaccccaaactaaaggagctgttccttttccccatggagggctgacggggcaaaatcccagggctgggaacatccgagcagctttgagtagcacaggtgggtttctacgtggctttctttaaagggaggcctgattctcggcttttcaggacccgccctccattttctcacttgcctgctctttcgtcctgcgaaactgggcagtggccggtgacagcgcagggtcagccctcggatggccaggtgggcgtgatcccaccctcctccgtggctgggtgggcgtggtcccaaagtcaattggatgtggtcccgcgtccctcccggcccagtgggcggggcctccccttctggggcctcccatcccacaccagcgagcagagaggagggtgggcggggaggccctacggggctggggcggggcggagcggaggtggttagctgtcgggaggtggggtgggcaggggccagggctctgttggtggcccggggcagccagtccctctgctcagggcttcagttcacactcacaagggaatcccagcgctcttctcctctggcggttgctggagggccttgtgaggtggccgtgggcactgtagcccccaggcactgcattgtggcctgggcgtgttggcctttgagcctttggccttgagcacttccccatcccccatggctcttggccattggaccccagttggccacagagccgcgggcaggtgggacaggcgggcactgggtgcctctttgcaccagccaggcccagcctgcagagtggagtgggccggtccctcctgccaggcaaaggaagggggcttcgggcccctccctgctgtggcctcctcccctctgctgcctcccactaggccctgggagacactgcctgcagatttatgaacagacagacctagagattagagattcaaaagccaaattcttacacaattcaagtattaacgcagatttggatttataatttgggactccaaggtctaccaagtaatttgctgtttcagaatagcccttttaatttggggtatatatttctaacactgttttttaaatatggagagtaaacaaaatggcccattatctgaccacacaaatactagtagtcattatagataaaccatagcagataaataatagtaaacaaagcaacaggctgtgtcataggaaatccccaccatgaagaaaggagcaaggtggaaagttctggctgcttcaggtctgcatggtccctctccaccatggttccccctgtcatcttcctgccagaataaggacactgtccttagggaagcaccatctcttgttttttccccacgagccctgtgggtcatggcacgtcctgccccgctgggaaacacagtgggccacgggtttccctgcaggcctgggacccttcccaagggtagcagcagaaggcagcacgattcccactcctgcagctgtggacaggggcacccccactgtcactgagccctgcaccgggttccatcacctgctcggggctctggcctttggccttttcctgtgagctgcatgttggccactgtgacctatctgtctcatcatctttttcttactggtttgtgtatgttcttggtaaactagcccttggtcttacacatcatttccaaggtactaaggactcttcaggggaaatacaacttgagcagagtggttccctcctcttgtggttcacaaggtgcaggtgcacacacacatagcccacagggcagtgtggacagggaccaggagactgcccctggggtccctggctgggggacactagtagggatgtcccttggcctctctgaggccttctgctgtctcttctgaggccggaaaggcgaagcactgccctcgccctgctagggaaggctcaggccaggctggccctatccggggaaggggctcaggtatctggaccttggtcatcgccaggttagggtttatgttgatgattatccaaaggcaaaattgatttccacagaaataacatctgctttgctgccgagctcagaggagaccccagacccctcccgcagccagagggctggagcctgctcagaggtgctttgaaggtgagttggccaacggaagccggggcagtgccagggtgggtacagattccggcccggtgcatgggcacaggtctgctgagcacatgtccactctgcctgtgtaaataggccacatggcctgaaatcccctagaagcctggtgtccgcatgacctccccctagggcggagcctctgcttccctgttctcttctgctctgtcctctggtgccctgaggctggcctccaggggtgtcccctctgtggccctaggcctgcctccttgcctgggtgtgcctttctaaaatggagcgtccagcagagagtgggatctcctatgccactgggagcccagggccccatcccagaaagacctctgagtgagcacaggggccctagaagaagtttccttgtgtccttcccgttttagggtctgtgacctgaacccctgggcttctgcctcaggcctcctgtgctctgctctctgcctgctgggtcccctcaccaggcttctgtctggttcccaggctacctgcctggagggtcacaccaggaggatttcaaacaggtttcaagtggggtcacttgccatcactgtgccccacgaggtacactgttgtgggcggcagggctggcctttctcatctgggacatgccacgttgctgttcccaaggggagtggtgagtgggtctgtcctggtgtgcctggcctggggactgccagtgtccttacttggacactcaatgaaaaggccacatgaatccctggggcgtccagagcatgggtgaccagcacgggctcaccacatgaggccaaggggctgcaccatacagcctctcctttggccacccgtgactacccccaactccgggccatggggcttccctacccctgggtgtcctctaagccagctgggagacaacagcctgagtccgtgtctgcttctgtattttgtgtggttttagaggatccctgggctgcctggggaagcacccagggccagggagtgtgaccctgcaggctccacacaggactgccagaggcacacacctgctctgtctacccgagggcaccagagggcacgagaaggctggctccctggcgctgacacgtcaggcaactgaggcacaaggctggcatttctgaaccttgcccctctgcaaacacaagggggcgatggtggcactccaagcaaaggggcgtgtgggtgctgcaggaggagcacagagcactggcgcccctcccctcccgccctgcagatgccggaggccccgcctctgctgttggcagctgtgttgctgggcctggtgctgctggtggtgctgctgctgcttctgaggcactggggctggggcctgtgccttatcggctggaacgagttcatcctgcagcccatccacaacctgctcatgggtgacaccaaggagcagcgcatcctgaaccatgtgctgcagcatgcggagcccgggaacgcacagagcgtgctggaggccattgacacctactgcgagcagaaggagtgggccatgaacgtgggcgacaagaaaggtggggtccgggccagcaggtgctcagctctgggacagggacccaggaccaggcatcaaagcccttacaggagaagctgttatcaccccatttccagggggctgggaaccctgggatatgcccagatagggctggggggctcctctggagtcccagggtgccagggtccctgatgacccctgcaggccctgctgcctgctgccccaggacaacaggcccccacactcacagggtctgacggtggtgcagttccccttgaactctgttctggccaccatgggacctgcctggggaccagtcagacaggttctcctgggcccgcctcccgcttgaacttcagcctggggcacaggatgtgttaccgggctcacggagtgactcagggaactagtgccgccccagggccccaaggtgggcggttcggtgattcagagagggcagctctgtgttaggacacactggggccagccaggaagggtggaaaagatagggaccagcgtgagcatagaggctaagggaccatgggagctccaagcgcgctcacagtggggaccaggtcctgggggctggggacaccagggaggtgaaatacccctccagcgggtagggagggtgggcagaggagggccagcggccaggcatttgggaggggctcctgctctttgggagaggtggggggccgtgcctggggatccaagttcccctctctccacctgtgctcacctctcctccgtccccaaccctgcacaggcaagatcgtggacgccgtgattcaggagcaccagccctccgtgctgctggagctgggggcctactgtggctactcagctgtgcgcatggcccgcctgctgtcaccaggggcgaggctcatcaccatcgagatcaaccccgactgtgccgccatcacccagcggatggtggatttcgctggcatgaaggacaaggtgtgcatgcctgacccgttgtcagacctggaaaaagggccggctgtgggcagggagggcatgcgcactttgtcctccccaccaggtgttcacaccacgttcactgaaaacccactatcaccaggcccctcagtgcttcccagcctggggctgaggaaagacccccccagcagctcagtgagggtctcacagctctgggtaaactgccaaggtggcaccaggaggggcagggacagagtggggccttgtcatcccagaaccctaaagaaaactgatgaatgcttgtatgggtgtgtaaagatggcctcctgtctgtgtgggcgtgggcactgacaggcgctgttgtataggtgtgtagggatggcctcctgtctgtgaggacgtgggcactgacaggcgctgttccaggtcacccttgtggttggagcgtcccaggacatcatcccccagctgaagaagaagtatgatgtggacacactggacatggtcttcctcgaccactggaaggaccggtacctgccggacacgcttctcttggaggtgagccccaaccaggatggcatccgtgccagctgctgcccagagcccattcagtcagcctcagcctctccaaagagccaggcattccagtagagccctgtgtggacacagctcgctctggaggcaccacctgaggtctgggagtgtgggggactgaggaggccctgtggtgggtggagatgggtggggagctgggccaggggcctggctgggtggcctgttgggaactggggagccagctgcctgtgcaggtgcaaaatgggtggcagaagtggggtgcacaccccagaccagacaccagggcagaaacggcacaggaccaaggagatggggtggggaagggccgctctgggcccagcctgctctcccccaagcaagccactgctcgtgcaaagaaagcatgtgtctcctgcagatcttcctcctgaggccccatcttgtgcattcccccaacccagccccactggcgaggaccctgagtgccccgagtgaggctagacagcgggtggggctgtcctcgcttccctggggggcgtggggcactggtggcccttcacagactgatgcttaaggagcctcacatcagtgacacactgccccatccctccctggtggtcagcgacactgagtggctctgtgatcctccactgggcttgggacacccaccctcacggcctccccacctggtgctcgctcacctgcagctctcccagaaactggacactgctgttagcagccggactaggagcacgaggggcacagcccccatgcctggctaggtagggccgctggaccctggacacggattggaaggaaccagcactagcagaagcctgaggtgtgaaagggcagagaatgttccaggaacaatgggagtcagggcacacaggactttgggcaggtgaggatgaggttagacctgtcttctggagctgggctcaggggctcatgcctgtaacccttgcactttgggaggctacggcaggaggagcgcttgaggccaggagagttcgagaccagcctgggcaacatggcaaaagaaaaaatatatatatatattttagatggagtcttgctctgtcaccaggctggagtgcagtggcacgatcacggctcactgcaacctccacctcttgggttcaagcgattaccctgccttagcctcctgagtagctgggactacaggcgcgcgctgccacacccggctagttttttgtagtttagtagagatggggtttcaccacattggccaggatggtctcaatatcctgacttcgtgatccgcccgcctcggcctcccaaagtgctgggattacaggcgtgagccactgcgtccggccgtattccagcttttaaaacaacaaaaaacaacaaaaacttttctggaaagatccctgtcagccttgtggagtgtggagagggctgtggggagggcatttcagatgccctgaactcacgaggaggcactgaaccctggccgtggagagggaggacctgtagtggccaagggggtgggcattgggagggtgggagggagacctacaggccaagacagggtagctggaggggggctcacccctgacaaaggagcatgatgctggcaattgggtattgatggcagagagctggcactcagccagatgggcttcacttgggcaggaaagacacccacagctgggcctgcgttactgcggccgagtttcagcagctgtgatgtgggtgctaattacaggggcctgccttcatagaaaagtagcaaacattgcagtttagtaactaggaaactaatagttttctcagtgctgcttgcgcaaagctggtaattatctcaaaagaagcaaagtcatgaagtgggaagtcatgaattgggaatgggtgtccttgttaaacgcacatctgcacactcagggctggggccctgtgcccccttgtggagggttaggggacaacctggctcttgtgagggtctagccatcccctcagtgggttctgtgagcatcggaggcacggggggtgaggggctcaggagcaggttgcaattcaaaatcaagggctgctttgaggaggcctctccaccgggctgctgtagtcaccaagtccagcccatgcccaaaggaagaggaatgagttcccccttaaaaaaaaaaaaaaaaagaaaaagacagagtcttgctctgtgcccaggctggagtgcagtgatgacatcatagctcactgtagcctcaaactcctgagctccagtgatcctcccacctcagcctcctgagtagctaggactaaaggcatgcaccactacacctggctaatttaaaaattttttgtagaaatggggtctccctatgttgcccagactggtctcaaactcctggcctcaagcgatcctcttgcctcaacctcccaaagtgctgggagtacaggtgtgtgcttggtctgaggctccaactttttgttgttgtttctcgagacagtctctcgctctgtcgcccaggctggagtgcagtggcgcgatcttggctccctgcaacctctgtgaggctccaactcttgaagggaggagagtctaaggagggtgggccagatgaaaaccacctcagcatagtgtcacctgctcctctgacactgtcgcttctccatggcattagattttcagtcctgctcagacgctgatgcatgtttagccagttctccaggtggtctgagtagctggtaggaggcttgcagtgtcgggcgacaggcaggacaggtgctgccttctttcccctcttgaccagtttcgtaaaggagtgggcccctggcagcctccaaaggtgacccatgctcctttctgcccttccctccttctttcctgtttaactcgtgcaggtgcagtggtctggtgtctttcagtccgctgacgtcttctgtatccctgatgaccagattgggctcctgagtcccctggcgcaacccgagaagtccaggagcccaggcccctcactcatgcattccctggcccagactggaaggcagccgccctgctcaaggcctaggccattgtcctcctcccgggtggcgctttgttctacgtcttttcagctgacattgctaggacatttttttttttttctaaatgaaaacacatcatgattcatggtggtacttcctgctcaactccggaccttggggctgtcccctgacctcactgaccttgcagccgtgtggtgtccatactgtcacatgaaagccccctgctttctctgcagcatacaggctggaaacgaccgccacccaccaccaggacagctgcaagccctgtgggactctccaggcccatcccagaggcatgtggggtcggataccagtgtttcaaggcacctgcctgcaaattgattttattatactttagatgtttgagattgcttgttaacttttgtttggtgactaagtcaaatttccaagacaaggtgactggggtgtcccttgccctggtaggtccttcctccccataggcaaacacttcctctcaaggtttcttgtttatgtgatgtaagcaaacccttttctgatagcatagataggcaagcatcctatgaggtttctcccgatagtggaccccacgggccatgccctatggctgcgtgtccagtaacaactccttccttctgcacagaacccaggcagaggaactctgtgtcctcccagggcccaggcactggtgaagatggggggtctgcaaatgcaggagcttggggatgtccagaactgaccccaaggggcaggcttgttgatgggaggtctgccccacctcagccctgcagggtcaccctggtcaggccaatattgtctccagggaccataccagcaacccctctccttgggtgcctctccctcataggcctgagttcctggcactgggtgttgagggccccattgtttccactcacccagctagcatttattgagcacctactgtgtgccacatgctgttctaagggatggatactcctgagatggatacaggagttgatgagagaaaggtccctgtcctcacggggcccatgttctgaaggtggcacccaagtcttgtacagtcctttcctgcaggagtcacgctgggcagaaagtggaaacctggccccaggggctaggcacaggcgtggtgccgtggcctagtgaggagcacccatcctggtttggggcaggttctctgggcacctctgaccctcacctcccccaccccccggtctgtttgcaggaatgtggcctgctgcggaaggggacagtgctactggctgacaacgtgatctgcccaggtgcgccagacttcctagcacacgtgcgcgggagcagctgctttgagtgcacacactaccaatcgttcctggaatacagggaggtggtggacggcctggagaaggccatctacaagggcccaggcagcgaagcagggccctgactgccccccccggcccccctctcgggctctctcacccagcctggtactgaaggtgccagacgtgctcctgctgaccttctgcggctccgggctgtgtcctaaatgcaaagcacacctcggccgaggcctgcgccctgacatgctaacctctctgaactgcaacactggattgttcttttttaagactcaatcatgacttctttactaacactggctagctatattatcttatatactaatatcatgttttaaaaatataaaatagaaattaagaatctaaatatttagatataactcgacttagtacatccttctcaactgccattcccctgctgcccttgacttgggcaccaaacattcaaagctccccttgacggacgctaacgctaagggcggggcccctagctggctgggttctgggtggcacgcctggcccactggcctcccagccacagtggtgcagaggtcagccctcctgcagctaggccaggggcacctgttagccccatggggacgactgccagcctgggaaacgaagaggagtcagccagcattcacacctttctgaccaagcaggcgctggggacaggtggaccccgcagcagcaccagcccctctgggccccatgtggcacagagtggaagcatctccttccctactccccactgggccttgcttacagaagaggcaatggctcagaccagctcccgcatccctgtagttgcctccctggcccatgagtgaggatgcagtgctggtttctgtccacctacacctagagctgtccccatctcctccaaggggtcagactgctagccacctcagaggctccaagggcccagttcccaggcccaggacaggaatcaaccctgtgctagctgagttcacctgcaccgagaccagcccctagccaagattctactcctgggctcaaggcctggctagcccccagccagcccactcctatggatagacagaccagtgagcccaagtggacaagtttggggccacccagggaccagaaacagagcctctgcaggacacagcagatgggcacctgggaccacctccacccagggccctgccccagacgcgcagaggcccgacacaagggagaagccagccacttgtgccagacctgagtggcagaaagcaaaaagttcctttgctgctttaatttttaaattttcttacaaaaatttaggtgtttaccaatagtcttattttggcttatttttaatgctttttctcagtgtttttcttctgtttctgagtcacgaacagcaggcactgaaagcagtcccccagccactgccgaaggtcagtcccggaggtgctgcccaggctccaggcagatgcggcagccccggccacagccagcatgggctggagaaaggctctctactgcacaggggcctcacgtgactgcagggctctggggaggtggggcacctgtagcctgacccccaccttgctgcttccaaagcttccttgcccagggctgagccttgtggggcaccccccacactgtggtctgcctgcctgcagggtgcccagggagaccctccgcctttagaagtccaagttctttcccagccccctccctgcctagctgcctgcccctggcgccagacctggcccgcaccactggggcactgtgttcccaggggcaccctcctatcccaccagccccaaagcccagccaggcacccttccctgccacctccctgggccctgccccagcagcccagtcggcctcctcgggccttctgtcactcgctcacacacagcaccatgtcagtaaacagctaactcaggcctagggagttaggtaggatggggggagtggggtgggggggcaggagggtgtccccaaagtcaggcttggctggggcgaggcgctgccaacccctgccgccagggggctccaagctccacggcacgatctgctcagggtggcccttcttccacgatccaagccctaagaacaagaggctgggcctgggccctgcagagggaaaggggatggtggacgctgcagccactgagtggcacaggaccacgtgtaacctcagggcagggcagccaactccacaggctacatggatggagatgtggatagaagcatctgccctgggtggtgtgggctgaccccaagggtcttggcaccagggctgatcctgacttgctggtccccgaagggcgttggagggtatggtgcccatccctactctggtcccatttcctcaggcccctgatcccacagtgcctgggacagggctgtgggcccagggagcaccctccctctctgacctctgcctggtctttccgggaatgggccactgggctgctggactggaggccaaagtcctgcggggaacgtgcgggaagagcagagcgtgcaggcagcagagactaacaagaagccctggcccagagggcaggaacaggtggacgaacaaccagatgagagaacgtaccaggcatgcaagctagacccaggaatcaacgggctgaggcttagcgtcccctacggcgtccaccagcctgaccgcgggcctgctgggcccggggggaggggccttcctgctggggtcgagctgcagcgcacgggtgggcattagaggcacaatagagcaggttagttagagctcctggggggacagggcaggggcagggccgaggctggcgatgtaagggttggcctgccaggacagcacaggtagcaccaagggcgcagggagccggaaacatgtggctcacacgggcccagggcgggcacgtgcacacacacaggcctgcacaggaagccaggggattggcacacagcaggcagcaggtcctgccatcgctggtggaccctggtgggctctcacacgcacatgcacagaagggtgcacacacactagctcacaggctctggcccatgcagggtgtggccgggcagtgttgtccccagtgggtgggagctgcaaacttgtcagtacccacagactgactggcgtgaaggggctgcttcctgggcttggccccacaacccagctgtaccccagggcccagaccagacccagcatggcctaggctgctctccagcaacccctagacacagggcctcaccggggacctgcccacagccacatgaccacttactttcaagggttccttctcagaggcctctcctgcagagctggcgccccgtggcctccgctccctctggtccaccgtggagtatccgtctgtagatggggtaaggtggggcatgaggggcgctctgagggaggccctgtaggagcagatctccctctcagcccagacacaggggactcgtgggacaggggctttgggagacagcccccacccaccctgtcctggagatccaggctggtgccagctctcaccaacaccctgccaactctccagactcccctccacttgtgggtcagagcccctggctgagcactaatccctctctagctgccctgtacctcaccctctaagcacccctaaaccaaatatctctcctccacccagcaccatctacaccccataaaaccagcaggcccacttcaggccttggtcccctcccggcacagaaaaccaaccacactgcatctgcactcacctgggcccagcgcatccatggggatcacatcccggctgccagttttctcgccctctgcaaggcaggaggaggaggcgggctgcatgtggcagccaggggggatcggggcagagaagcccacacagggctggcccaggtagccctagaggctctctgtcactaaggtgcccaacctctgccagctggcagcctcaccccagcttgacaacagcgcggatgctgtgggaagggagtagccaagaggcagagggcagggaaagtggcctatggaagccgtctcagtgggaggcctgactcctccttcaccctcacccaagggtcaggcaactggggcagctggggtcgccaccctctaggctccctaagctccaccactcaccaaggctcttgtccaccagtggcagcgtgctgtcatcgaagcccccaggactcagtgctcccttaggccccttggcagtagcagcagctgactgagacataaaacacagacacagggtgggtgaagcacatggagtgggaataaggcaaagtgagcagggaatggaaggaaggccagggaagccgcacctggaagcgcgccttggtccaaccatctttctgcaaggtaccacgcagctccttgtagctccacactgtctgcagcacgtgtgacgccgccttcgcttcgcgtaccgattggctgtggggccgggggcggggtcagtggtggcccctcccccacctccgcggctccccaagccaccgaccccgcccctccacacctggaggccacgagagccaccaacgctggcaccccgcgtgcctgcaggagcgagcgcgcgttatccaggctgtcggacacgatttcgtggatggtgttgagcaccgccaccacggtgtcttcctccaggcaggcccccggtcgcggcggagcctgtgcattgcgcacattccgcacaagctcagccatggcgtagctccctgaggggcaggactaggtgtcagaacacacctctgccccacctctccaggaaggagcagggatcccgcgagggcgaggggcactgccaggagagcccctggagaccgcctgtgtgcaggcggtcacaggagcccctgtgagcagggcgctgagcttcagagacagggccggggggactggagctacctccagttgggacagcgcccaagcgagagggccggggcctggactcccaaaccactcatcctccaagcccctccgatgggaccccaaagctgcaggcacagttcggtgcccaggcgtgggctttgcaggcgtcctcaccgatgaggtctttgttgcgccggtccagcgagaggttgcgcagagcgatggcgacggcgcgcaccaccttgtcggtctcagactgcagcagttccacaagcaccggcagcccgcgctctttgcgcactgtggcgcggatgtacgtggcccactgcggaggcggggagagggttgctcagacatacatgccaggcactctcccacctccagacgctgaccgctctctccagctggaccttcctgctcccgtgcccgacaaagccctaccccaaaagctcaacggcacctccaccgaggttttcccaccgtccagggtgcacgcattgcccgcagcccatacacctcttggatcctggggtggtggtgtggcccctcctttccccgccagccgaggcaggagctgcaccagtgaggtgcctgggattccctctctcaggacttgcccaccctgcccgacctggtccctcaccatccagttgccggcactgaggttctgcagagcgccggcggcagcctccagggtgttgaagttccggctctccgtgaggagggagaggtagagacgtaccacctcgggctggtacagcagctcaaagcctaggtgcagggcaaccgccacccacggtcacccagaatctgctctcatccatcatacccctcccgcttcccgcttcagagctcccagggcgtgggtgagctggggccagggatgggtgtggatgagtcacgtaatatttactatcaacatatagtcacccaaggggaaaagcgttcccatttcacagaggagcaaactgaggctcaaatcagttggacctgcctggcagcaggagcatccaggaggcctggggtggggagggaggtgtcaaccaggaacgctctcctagcaacaagacccgcatttcccggtaggtccctgaagctatgcatcctggccacgcccctggtaatagggcccaccctccctggcaacaagaccagcattggccagtaactgagagttgtataaccaaggccacacccctagcaagaggacctgctttcaccagtaactgaagctgtgcagagagctacgccccctagcaacagggcccaccctcccccactgacaatagagcccaccctctgtaagtcaactgatgcagtgcaaccagggcagctgccctagcaacaggaggcactcttcctggcaaccactccaagttcccgggcaattgaggcgccgtcctgctgctctgcccagtgctccagaaatgaggggtcaaaacagccttccaagcttgcctgtctccaaactggggcttcagcctggcttgggtactacctcgatctcccctgtacccacccagtgacatttcatcacaccctcgccagtcctcatgccccatgctccctctactcctgccctgctgggctttctgctccaacacactccaagcacactccccgctggggtatctgcatcagccctgctctgcctgtaatactcccccacagccctcctgcggctggagccctccaccctggtgacatgcaggctcttccaactggctaggccccaccaggacagacctctctctcaagccagatcccagcatacagctcaataggcactgccctgcccctgcaggtgttcgtctggcccagcctctgaacctggatgtgagcatgcccgcctggctcccagccccctcagataactcagctttgtggctaacacaggaggccctgcctccactggaggcgtccctccaaaccttcccacctcttacgcaccgtgaggccgagcaagccctctgcctctctgtgcctgtctcccccaaccttgcctgacatgacccatggcacttcctcccattctaaaccctcagcaggtgtcctggtgctgaatcaccctccaggaaatcctgcacctaggggcctgtttccccatctgttccctgaggccctccaggcctgcttgatggctcaaagcttcactaccagggcaatcctgagcccagacatcccccagtggagctggcttcatctcagcccactcacctttggcggcctcagttcgcttgggcaggtctagcgtgtcaaagttccggtccatctcaccatccttctttcctggaagggaaaggtggtgggaggtgaggcagaccccatatggggaatgggtgtatcaggagagttgggcacagttctctcctacccaggccccaaaaggcacccccatgtccaggcctgggcacctgtgggagtggagcaccgttgtcagagtttgggcagacagtttagcctaggggtaggagttggtggcagtggggcctggggatgtcccagccctgcccctaggactcatctcccaccaggtgctgggagctgtaccacagaccctcccggtggctcccttgcaactgccaggtatgtagactgagggaagccaggagccctggctggatggtaggtggatacaagccaagaaactgaaggctgaccaggacaagactcatttgggtcacacagtaaggcagaactagggggaaactcccccagctggggtcaggacattgtcccaggatctactagccaggagaaaccccacagcagcccacctaacatttgtgtagccctggcttgcacacgtctgtgacagtgagcccactgtcaaccactctccccatgtcagatgatgcttctaccccttcagaaggcagcagagtggagccagatgacctggggtccctgccctgctcaccctcatgggacccttgtatccctccgagccacatgatgccccattctatcagagaaacagactgctccttggtgcccctagagataagtacccccgggccctgcccactcttggctctgcccaactctgcccaggtaggcaagtctgaggttacagaatgagccccgtggccttcccacctgccactgtcataaagatggcagcccgagtgatgaagccaggggtggggcagggccctggggctggaacgtgctcgcctcttcccaggtacccactgcacacgccaggcctggagagcaggataaaaagggactcaccttggtggaaccactcctctgggaggccggaggaagcagaggagagaggagaggagcctgaacaggcagcactcatcacccccccatgccctcccggaagcctcaggttcccactgcacaccctggatcaagcaggcagcatgtggaacctcatcccatcacttctgggcactgagcacccaccagggggacaagaagagggaggcctggggtcagtggggcaggggcaggtggcgtacaggtcccccacagctgctggggaggtcctgggaacctacaccctgctagtgcagtagagaaggtgtgcagggcatcttgcccaggcagatgggggctgccccacaggttggtggcagtctacagctattctgtgaacagtgagcaggcagcagccatggctccttcccaactcatgggcaagtggaactctccccggagtagaaagactgggtctgggcattggttggtttcccttgtgtactccctgggggtcccacagtgtagatggggaaggttggacctgggtcccatcaaccatgtgacccagggcagtccagcctccttgactcctggcttccctgcctgcctgttgggggctgaccaggtgtcctctagcctccatgatgggctgctgtgggtgtacagagagccttccgctggggcaggagttgagatggtagagatgataccccagtccgccccacccacctttggccttcttgcctccaaagcagctggcatcatcccgcctccggcgctgggagcctacagcactgcccaggggcccgggctcggcctcctggtacctgtcggccccgggcacctccttgtgcacgtggtaggacaggttccgcatgatgcacacgcagttctccaccgactgcagggagaggtgagtgggtggggcagggcaccctaggcacagggctggccctcaggaaagactggccacagctggtgtgcatgagggcaccgggagcaaaggaacagggagtcctcagtggaggggagcaaaagggcggtaaccgccaggaagggtccatgggaggaagcctctgccctcacggcacaccttctgcctgcaggacggtgcccacttcagtgtggtcactgcgaggcgggccacacccagaacgccaccccagacccacaagcccattcccctgtgctgctcccacagttccagcctcctgggacctgcatgatcgtctctccagcccttggtatgaggctgtgaccgtccctgcccaccttgttgtcagtgtccttccggcccacagccgactgcagggcatgcaggagcgcgtccaccagcccttcacactcccggagtcgccgccgggcctcagcaccatcggagctcacattcctgtgtggccaagagcaggccaggtgacccctggctaccagaaactccctggctccaccctggccttgtgggcttgtcttcatctgcaaaataggccctgctgctgccctcctagcactaatgggaaaggaccccacagtctggagctcagtgaagggggagaagctaactgcccccaggcctcaggaggggagccctggcagacaactatcttggctggggatagctgggcagggaaagacagggtttccctgcctcccagctgacctggaaagggacaggtgcactctcagagagacctgaacctgtgcaagggcaattctgggtccctcgccaccccaatggcagctctgggccccaccttaccccaaggtcaagagcctgcagggctgcgcgggaacaccctgatggacaagcaggactgtggggacccaggactctgtggggtcagcagggcctcccaggggtaggaggggaagggcagaggtcacaggtggctgggatgagcctcccaggcagatgaacaggaaggtcccagctccccctctggctgtcaagtgatgggaaggtaggtgagagctgggcagggctacggtaccacagagacccctccagagggtgcccctgggaagactgggacaccacttgggggtgaggacagctccatcaggccccacttctcatccacaggacttgtgccacagctctgaagctcctaagctctggcgctcctaagctcgccgccatcttccacactatctgggaccacgaggacggggcctggtgtgcatgtgggctttagcaccaggtctggtccacacctcaggcagcccgacgtgttcttgaagacagttgtccactcggcgtcccgtggcttggagtcctcgttgggctcacgctcccatcctgagtggggcacgatcacctcgtgggtcagcgtct

SEQ ID NO: 1325 - DNA, 1311 bp, Homo sapiens
acggatcgctgtgtacactgtgtgctccggttgttgcatccgagggttgatcggatggtggttcccatccagatccaagtcctggcccctgatcacagagaaacacagctggacattaaagtgaaataacatctgctttgctgccgagctcagaggagaccccagacccctcccgcagccagagggctggagcctgctcagaggtgctttgaagatgccggaggccccgcctctgctgttggcagctgtgttgctgggcctggtgctgctggtggtgctgctgctgcttctgaggcactggggctggggcctgtgccttatcggctggaacgagttcatcctgcagcccatccacaacctgctcatgggtgacaccaaggagcagcgcatcctgaaccatgtgctgcagcatgcggagcccgggaacgcacagagcgtgctggaggccattgacacctactgcgagcagaaggagtgggccatgaacgtgggcgacaagaaaggcaagatcgtggacgccgtgattcaggagcaccagccctccgtgctgctggagctgggggcctactgtggctactcagctgtgcgcatggcccgcctgctgtcaccaggggcgaggctcatcaccatcgagatcaaccccgactgtgccgccatcacccagcggatggtggatttcgctggcatgaaggacaaggtcacccttgtggttggagcgtcccaggacatcatcccccagctgaagaagaagtatgatgtggacacactggacatggtcttcctcgaccactggaaggaccggtacctgccggacacgcttctcttggaggaatgtggcctgctgcggaaggggacagtgctactggctgacaacgtgatctgcccaggtgcgccagacttcctagcacacgtgcgcgggagcagctgctttgagtgcacacactaccaatcgttcctggaatacagggaggtggtggacggcctggagaaggccatctacaagggcccaggcagcgaagcagggccctgactgccccccccggcccccctctcgggctctctcacccagcctggtactgaaggtgccagacgtgctcctgctgaccttctgcggctccgggctgtgtcctaaatgcaaagcacacctcggccgaggcctgcgccctgacatgctaacctctctgaactgcaacactggattgttcttttttaagactcaatcatgacttctttactaacactggctagctatattatcttatatactaatatcatgttttaaaaatataaaatagaaattaagaatctaaa

SEQ ID NO: 1326 - protein, 271 aa, Homo sapiens [sequence omitted]

SEQ ID NO: 1327 - DNA, 61876 bp, Mus musculus
  misc_feature (1)...(61876): n = A,T,C or G
atctcaggagccaaaccaccttctggtgctttcacttcttcttactcctctaattaggctaaggagaccactgaacactacaggcaagaatttactaaatactggtgatttctactagccaaactcagctctgcaagccaacaggtgaaccaggaggctctttgagttcattgtccattaggagtctgggaaacattttcaattcttcggtggctacccatccaacatcagcaaaagatgccaccacatcctctccaggtgcatggggactccattctgttacatgactggtaagctcagctgtgcagcagccctcaccctcccagctactctccattttaagttttatggtgaagtttcagttttgcacggtactagttgcttatacccacttcactcaaggtgagcaccagagagattgacaaatccagtgataaaacatatgttaagggaaggctattcgtattctaaacagagccagccagtactataaacagtacgatacaagatcgtacatgcaccagattcttgggctacagatcctggccttgtctccgctagactgctcttcataaaatcacaattggaaggaagccaaggatcatgtcttccatatttcttccatatttattgacctgagtcaggataaaaatggaaacttaagggtagggatcttgttttttattaagctgttggtacagtgcttggttaacccagctctactccatattgactcatcctgaaactccgtgatggaaatcaggctcctagcttcacctagtacaattccctaagggtgtctgatggctggctctaattgtctacttggcccaatgtagaatcacatgaaacaggtgtctccatgagggattgtcttgggttcatctgtgggtgtatcaatgggtgggggtagggagatctatcctgagtgtggacagccccatttcaccagctgggtcctgcactgaagaggagagagctatctgaacaccagcatgcattctttgttcttacgctcctttctgctttgggatgagatgtaaccagctcccttaagctttcgctgctttgacttcctaatatgatatgccgtaatccgagactgtgagacaaaaataagccttgccttccattgccctgtcagagtattttatcaccgtaacaggaaatgaaactagaggttggattcctcaggccagtaccccaggtggtcatctgtaagtttcccttgaggacctgtgtaggcatgtttccaagatctaccagaaaaaaagacacacacacacacacaccatggatggcagtatgtggagaatggatggagtgaaaaggatgaaaggaaaaaaaaaaaaaaaccactgtgacttgaccccaagaccaagacaagggccaagaaacagaatcccaccaatccccgagcttccccaagctcaggaattgaaatcttactaatcctcactctagaaatctccaccctggaaagctctgccctgcccctcaagaaaccccatataaaccctgcctgcttctctcaagtggaagcagccaccctgctgggttttccctcctaataattctcttgtgtgaggtttgttgtgcagtgtgactttgtgttattccttggctctgggtggagtagagctatttaacacttttgctggggaaattccccctgctaaagcagaaccgttagacttgccttggggaaaacttttcctgcagccccagtagagctggaacacttctgtaggggaagccattcccttcagagctgtaacacttacagcttggatatgccaacgggagtctacatgcatgtattccaggtcacacagtacttacaccatcacttttcaacattgtctgaggaatttgagactcccctatttgaatctggatttatgatccttcagaaaaaactattaaggatggatattaaagacacttctgtattcattttatttaggtgtatgtgtatgttacataagtgtgggcaccctcaaaggccagaagaggacattagataccatggaactggagttacagaatagagcttggctcctttgggagaatactgagtgttcttcagtgctgagccatttgtctggtccctgaatatggcattttgatggttaagctcttggttccttaaatttgttagtgctggtatcttctacttttgccataggataccacaaactttaccaggccagaatgtgtagatacacacacctggatgattcttgaaaggtgaatgtttacttctgctggaagctttttttattcctccttgtagctttctcaacagctttagatttcgttcactagattaaaagactttttacggtgagtgagtctcccaaattgtctctccaaacctgcttgagaagtactactttctagttacaggacgggatctgatagcaagttaaggaaataagcattccctttggctcagagttggggaggttaaagtctaccatgggaggggggacatggcagcaggggcaggtggctgagtctactcacatctggatggactggaccaagaagcagagagcatactgaaaggggagctgggctgtaatccttaatgtctgacctctctaatggcccacttcctccagggtgtcagaatcctacccctccaaggttctaaaactgcctggagacaagggattccaacagaagcgtctggggagcatttcacattcaacccatcaacaaggaccatcgatgtcagcgtgcttacctggttattgtccaacttccggtgtaagcagggcttttactttgtaagtttatattaaaaagaataaggttacttgcaagtagaggaaaatttagaagtaagtttcaaaaaaaattgctgacaagttaaatctaggataaccaaaaggattgtcaattttctttgaagggtgctaaatcccttcctctaaatcccagtccactttatagaaacagaaacttgataatgtagatggcacattatgactgtgcttatatagggaaaacagtgagatctaaacttaaacttagctcaaatcagaaaactggctagaaagctggctagtcctctgcctcctgcaaggtttatgcaggataatatttactatgcacttgaaatctattcacttctaaaacccgggaagtttttttttttcctccttataatttccagacatagttgagcataataagcattcctaatatcttttaaaatatcacctcttagtactccaataggcatcaattatattgtgtgcatgtgtgcatgtgtgtgtgcgtgcgtgcatgtgcgtttgcatgtgtttaaagacaagagctcactctagatcctcttgccttggccccccaaatacttgaattgtaggcatgtcagacaatagaaatttttgatacagccacattccatcacaactttttgaaaaattctgttttaagacaagcatggcgatgcacacttgttatctcagcacttgagatgtggaagatgtgtaggatcagttgaacaccatattggctgagtagaatttaaggccagtctgagctaaatgatatagaacggggtgcgtaggtaaattatttcatttttttctatacgccgttagtaattttcgtagaaagaacgtaaaattacaataatttctttagtgctttttaattttcaaaaattcctatcaaaatccacatctgctccttgccaataactctttaaatggctctgctaaaagcaaagatgctaggtgccaggcccagaagcatctatatttctttcaagccccaaactgaaagatcgcatcttctagacctggatgtcaagtaggcacctcaacttcatgagtacttgcatcactacatagtgctcttccccattctgtccccaatagcagaatgtagagagaggagaagggggaggagggagggagggagggagggagggagaaaaaaaaatcgttatccaccctaggtttgcactttctgcgctctgtctgatgagccgtacactacgggggacagttctgttttttctctaaactccaggcagcctcagggcactgccggagggacggctgattgcagatttctgatggccaaataggccacactaataggagcgctcggagaacaaagcaacagccagcgtacgccgctgcgcgcttgaccgcttctttgcgacagttgccgtaaagcgaggcctccgccgcagctctagagttaggtaagatgagggcaccggggccgggtagccgagcctgggcgtgggcgggttccttcaggcactgtcgctggtctactggtataccctgagtagcggtcgtccacctttggggtaccctccctacggcggcggggaggagtccgaggtcggccgcagtccgtgcacgagcttgctgccgccgtccccgctgtcccggcgacagatcgttcccacacgcccatgctgtccgttgatcgtcctgacccgcgagggttcgattttggaggttcatggagacgcttaagaggccgggctgggacagtgacgcttgagctggttggcgagagcggacgatgcggggagaccgatcaggtgtgaggaccaatgcatgccaaggtggctccgccggggaggaactgatgcagcctgctgctgctctgagtgcatccgacgccgtggcatgaacttacagggaaaggaagggggttggcagggcagccgcccagggagggttccacctgagaaggactttgatgctgcgccaaagccaagttctgtgtacagcaagcagcctgctgcaactgcttcgaagagaggtggtggttggcttaccagtcgctttcctctcttcttagactcctcagtagtcattcttagttcgtttgaaggagtgctcactatgcttaatagtatgatgacgatggtaataataataagtaacaataataatgataaggtgggcgcggttagcgatgcgagataactgcatgtaggaacgttcctgtcttccgtttacattatcagttggggaatatcgggaaagatttgataaaaatggggccgggtagttaaaagctttagataaaagtcgtccagagaactgaattcagatttcatcacgatcgccaatttctcaggtagtacaaggcaagccgctttcttgtatgtctcaagctttctcggctataaagaatgatattccagtctttctagtttgaagatttccattaagtaaaagtcagcctgtgagccaaccatggtaacacacacctgtaataccagcactttggaggccaagacaaaaaaaaaaaaaaagcactaggaaacagagctgcataatgatcgacagaccagccttgggtaaatgctctcaaccaagcagttagtcacttgcctcttgagggaaaggctttactcactgtcttagttagagctaatactacagtggtgaaataccatgaccaaaagtgactggggaagaaagggtttggtttgctaagttttagattacagtttatcatccaaagcactgagggcagcaacctggagcaggagctgatgcagtgaccatggagggatgctgtttacctgctctcatggtttgtttggcctgctttcttgtagaacccaggaccaccagcccaggaatgacaccacccataatgggctggaccctcccacatcaaatcacaacttaagaaaattctctacaggaggcttgcctacagtctagtcttgtggaggcatcttctcaattggggttccctcttcccagattattctagcatgtgataaggtgacataaaattagctagtacactcagttaaaaataacatgaaatgtaaatcaagtaacttgatttgagctggctcaactcactcactaaagtgcttgccattgtaggcatggtgatacgacttctgccctcttctagaaggtactttaaaaagctgagcatggtagcctgaacgtataatctcagagctggggagagggagatagaattcctaaggatccctggccatccagcccagcctgcttagtgaattctaggctagtgagagacttgtctttggggtgtgcaggagtggggggagggggttggagaggtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaatactgggcattttctggcctgcacattcctgccctctcacacaaaggctggtggtacccagagagtgaccccagaggtagtgtgacctccacagtacttgcaggcactgatttactgatttgcactcatcccctctgtgcacagtaacaactgatttagcacattccattctagcagtgagaacattggcaaaataaggttgctggtggtagtgggtttcttttgttttgttttgaaacagagtctcattgtgtggccttctctggcctggtagaggaggctggcctctaacccagaggtatacctgtctctgtctcccaagtgctcgaattaaaggcttacaccaccatgcctgattgaaagtagactttattctattttatttgtattgcagaattatgttcaaataggaaagacattaaataaaaagaaaaacatctacatttcttcacctgaaagtcaaccttacctagctaactttttatgcaacctctcttccctaggtcctttatttcctcaaagaactttccttccagcatattcagaaaggagtcaccatgtgcttatgattcttctggatagtcacatagacagagtacagtattttaccttgtcatcttccagtgacaatgtggcaaggtagaggttattttgtaaaggatgaagaagcgagtgaacattaattaggtaaaggtctatcattatcatcagtcctgggactgaatctagggccttgtgtatgcaagcactctactgctgagtgacattcccagctccgtgttcagtttgtattttgagatagtctcactgagtttctcaggctggccaggaactctgcagcatagtcagcttttgaatttaccatcaccctgtctaccttccagactaggtggtattatatacaggtctgtgccatgaggccctactagactttgtttttttcatactatatattttggttatattctttccccaccccaaattcttccctgataagccactcaactttctcttataaaaagcaaagcaaaacaaaaatacatgggggtctattttgtgttggctaactattaatgaatatgcagtctatcctgagctacgtttgatacatgctgtcactccatttaagaaaaactgttttctccccctgcccttcagaagttattagttacaaataccttcttggctcagggtgggacttcatgcccacttccccttctccgagctgggatttttgtctgacttgaacctgtgcaggtcttgttcatgctgtcacagtctctgtgagttcattggccttgttgtgtctggaaaacgctgtttcctctggctcttacaggctttctatttccttttctacagatatccctgagccttgaggggagggctttgataggttttccctttaggagtgagtgttccaaagtctctcattctctgtacgttgtctagtttggagtatttatgtttgtggtcaggacatgtagggaagatgtgagagcagtcacagctgtttggcagcatgaactagcaagaagagaagcaaactgtatgcacaaatgctctgtccgtacagcagcaaaatggagagattgtcaggcactctttgcgacttgttcctgataacatgaaggagttatgttttaacttttcacatataatgtgttctctatctttctcacatatgtacacatgtgtataaatttttctgtcataaaaaaaccttccatctagtctagaacatgtttcctactaccccagtgttcttatgaataactgatctgggggaggtctggtcatttaaagataagaaactaaaataaaatgaacatttaaaaatgttacagcgggaagaaaataaatgagaaaataagtgatagctgtgtaggtcaaaggggacaactaatggaagacggggaagtccgtggttaagggcatgcactgctcttcccaggggtctgattttgcttcctagaacccatgacaggcgactcacagctaccacctgtaactccagttccaggggaattccagttcctctgtccttcacggggcctgcacacatgtgagcacacccacgcatttactaagagtaaaaactcattttaaaatgacagtgttgtgctgtccttcaggggtaatgtgctgaccagtcctggagagagtgaggccttgggttcaattagcagcattgcaaaaaaatcaggcaacgttcattggctcaagtgctaggagttggttgtaagacagcagtctggcagagttcaggaagaaaggacacacaaggagacacagatttcataacagcctatgaaatggaaaattgaccttgaagcttcggcaaggtgacatgataacaggctttggaagttgaacaactgaaagggcagtgaaggagttatactttagttctggaaatagagaatccagtgtcctaatgaagttatttaaacataacttcaaaaagctttctataatcattataagtttaaagaacactcgaagactgaagaaaatgaatatacagttaccaccatcattatatagtctaggtaaacaagagttgaattttacaggtagggaatatgtttgcatactttgtacatcctgtcaaaacagatcagattctctgtatgtggggctgtggtgttgactgttatcaaaagaacatttagctttacagggcagtgatataaatcctgtaacctatcaggggacgtgaagtatgacctcccagccaaacttttctgacatcgtgttttaacaataccaacactaacagtagtggtaccttcacagtctcttcttgatgagctgcggagatgagtgggcacagggtatggcagtaggatcactgtggaataagagtcaaatagcataattacgggacagaataaaataaccaagtagaaataagtaggaaaaagaaagaaagaaccatagtttgtcagtttctcattataaccagggaacaaaagaaaacgtaaatgttaagtaaaagctgtattaatattgaaaaataaagctaaatactaggggatctttaaatctacctaactaaaatcatttttttggagagggggtaagaggatatacatattaaatttcctatactaaaaaggtaatcagaggtacccagggtgaaagatcaaaatgtttatcaaagtttcctttttctttgcaaataccaagttaatatatgaatatcctatacctcacactcatacacacatacacacgtctcacaaaataaacagctagatactatgatccttgactaaaggctgtctcacgtttttccttctttagtcagcgtggtcagaagtagcatcgcctttgaactggtcagacatagaccctgcggcccagaggtcccaggacagctctgttgagtcagactcatggagaagcctccctccgcactccttcttgccatggtgctctcctgaactgcagatagcctttcctgtctttcattttgtcttttctacgtttgcttttcatatttgttggtttgagacaaaatctttttgtggagctcaagctggccttaacctcattatgtagccaaggctggccttgtacttgctatccccctacctcagcataccaaatgctgacgataaatgtgtactgccatacttgggtaaatataaataactgtgtgtgtgttgtcaataattattgaagttaatttttttgttgtcaaattggccttttttctttgcagaagtatctctggtcacaggaaacaagattctgtttcatgaagaagatgaaaacaactgggctactgttaaaaaccacccaagagaacaccatagaccaatgagtagaatcaataagaacgtggtcttggcccttttaacattgacgagttctgcctttctgctgtttcagctgtactactacaagcactatttgtctgcaagggtaattgtcttttcttattcgacataactgtggctctgtgttttcttaatatatttaaatttcagtatagaaaattaataatgtttattttttaaagaaacatttctcagtgggtttctcatctttttagaatgtaataggcagtttaaaattcagttaaatgtttttgtaattatacaattaaatcaaaagtaatatttcaatagtatttaacctattcatattccctgttgaataataaattgttatccctaaataatatcagttaaattaagtcactgataagtaattttgataacctatcaaaattattttatctgctagtgtatattttgattcggaatgtacttgaattgtagtgtaacttacccttgatgctgtttgagggaatgaagtcaagatactgggctggagtcagtgggttggagtcgtagcagtgaatggctgtagctccaggtcgggatgagtacccagcattccagggtcttaggagagattaccctgagtgggtcgtggactagggaagggggctatttgctgtcttagaataaagaaggcctatttctgcttatgtttggagcaagcattactgtagatatcctcttggcccttgctgcttatttagatgtttagattttctgtgctctacaaataaaatcaatctaattatctaataattaaagataaggagcaaatacactgtatttcatagagggataggcttgacagaagacaggtttttaaaatgcaaactttctttggatgttctgtgcgggagcacaacttctcatatgcctttggcccaacagcagtcctcctcttgaggggaacgttgtcatttttgacagactgagtgcacagcttcaagaggggcaaacatggagcagtgagggaggaaggggacacttgcctctcaatcgacttgcgacagccaagtcaatcctggcagttagtggggtaacagagagcacagcaaggtcccctcacatcccgaaacaaactccagtggaatagcagcatcgtgagtactgagtagcctgccccgggggagatgaaattccaaacataaagtatcatttccgtgcagtgcatagtagtactttcatgtcattataagctcaaaatgttgtgagtctgcccactgtaagctgggatccatccagagtcagcttacagttcacaccaagaagacatatttctagggaagtttcaaccatgcattgtttttttcttactagacccaacaggttaatgtggctttagctcagtgtgcttattgaatttgtatttactaatcacttgttaatgcatagggtacatagcaggaaaactgagattaatagggcaaagctcttactttcaagatactcataatttgatagtaattcttgagtatgggttttgagttcaaatcttagttcagtcgtctgactttttgcagatcacctctttaagctttggtttctttgactggggcacagcaacattgccagttgaggtaacctagttgatgtgatgcatctcactcactgttttctacgtagtacatgctaaaaaacaatagtgtttaataacttctgtttcataccaatggtttacattacaatttttaaaataaagttgagaggctggcaagaggctcagtgcctctaagctaaacaatcctgaattcttttttttttcaaaaacattttttattagatattttcttcatttatatttcaaatgctatcccgaaagtcccctatacactcccccgaccctgctccccaacccacccactcctgcttcctggccctggcattcccctgtattgggacatatgatcttcgcaataccaaggcctctcctcttattgatggccaactaggccatcctctgctacatatgcagctagagacacgagctgttcctcctataggtttgtagaccccttcagctccttgggtactttctctagctcctccattggggccctgtgttccatccaatagttgactgtgagaatgacaatcctgaattcaattcctagaacacattcagtagagggagagaactggctcctcaaagttgtcctctgacctccacatgtgggtcatggccttctctcacccctgaatgaatgattgaatgaatgaagtaagttattagagtccttgtgaacctgtattttcactgttttatcagtgagttaactggactctagatagaatgtttctcgctgatgattcaggacctaaaactgttacctttactcgtagagctattctgatgtgtaaggaaaactatatttaacagaatatgttcacattggcagataggtaataaactggctctcagaatgctgtaggacaattgaaaatattaagcttaatggctgagtagagacagagcactatgtgaggcaaatcgtgcactgtgctttctagtcagattcggcacaccagcgccttcagcaatcactgttggtatcaacagtggccatcacagggtgctagtctgggctagcttcccactatgctgagtaatttgttttcagttagagggagagctttgaaagaagaatggcagcaattattcacagtgaacaattttgtatgccatcattaagagtgggaattaatccttacagccatgtatgtagcacatgtgcagcaaaggctcagaatagttttaagttcgctgcttactaaaatttgcaaagattttcactcagtctttgacttttgccttgctttatttttctctaaaggaaaatatataggttattcctggaatggaagtatactagacatacactagactacagtctagtgtaatatggcaaatttgggtaaatatcaccccccattattcctccatccctccagtttttcattacccagaaaaatagtgaatttcttttattacagttttttacacatggtttttattcttttgtatagtgtcaggatgtagattattggttttcagatggtttactaagtcaggcagctttcttccccttgctgataacacttaggagtccatggagaactggagagaagtgttttgtgtgaaggagcagcactgagatgcagaagaaggcagctgcccagacagatggggattcgccacagttagggccttccagctttatctgtgcaggcttataaacaattgggggaaaaaattaagtattgaagaccttaaagtttttaacaaattagtagccatgtgactctaagtgggcatgtttaaacagtcatacaaattaagaatttggattcctgtaagaatttgattattagatactgtgcatcagaaatgacaagacttttttttttttttccaagtcttagtatcttgtttctggaatgccttttctttaattacattatagttgggtcactggacttcagtagtcaccaactattcttctaccagttctttctagaatctgggtcagcccatctacttcttggtggcccttaacttttcagtatcactatccagtaggaaatatttttgaaatatctgtaggcttgttttcttaaccccttgacttgttttgtggaaactgtttaagcagagcacagtaatagactaactccctaagctcacaatttgaggcgctttggaacatatgaggaaatagaggagtaatttagcatttacttcttcagacttcttcagtgggttgacccaaggttgtttgtattttaatgttaattttggacctttaagattggttgtcctagagatgagagagtctgcatgtaagacgttgagggatcttgtctttaagttatatttgattggtaaataaagatgccaacatccaatagctgggcagaagagacataggtggggtttaggctttggggacttggggttggagaagaaccatgaggagagaagaagagtgcaggaggaggaaggagaagctgccatgggttaggagtcaagagaatgtgcctctgaggactggccaattagagttaagagcagcccagatgaagcatagtaagtgataacttagggtaacaataggaaagtagattctaatcacatagaggctagacagctgcccagctattgtgctgtttaaggcttattgaaaatataaaggttgtgtgtgtcttttatttgggaacttaaataggcaaggtgggagaaaccttgggctggaatttaaataaatttctacaagactccattctgaatattttactagttaagaattcttctatcccctagtgtttagactttgtaattcttatgtactgttagacttatttctaaaattcaaattttagaatttttgatcaagttctctgcatagcatagcataccaatagaattaaccaaaagtccatagcatagtatgaggctcttctctgtttgcctctccagatctctcctcaccatgctctatgccctgggaggctgacctctatggacttcattagctgagctcccttgccttttggtttccagttgggttcaaccaatgggaagcatcagctggagactggagactaggaagaagaggtcaggttatttacttttttggttctctgtttgtatggtcattggttggcagtggctgcagttttcttattcatttacagttgtagccactgggtaccagtagctgttcttcccatagatagaacaactattaagataatgaaattttaattctaggaccaaaaactacatagtttttagaacatttgcaaaatgtacccttgcttttcttttcttacaagaggccattaaaattatatggtctttaagctttataagactagatatccatagtgttcttagctttgactcttcaagttaagttttctggaagaaaaaaaaaaaaaaaactgaagagtagcatccttggaggacggggttactggatagttcatgggtgcacaatattttaagttggtcttatgggatgtgtaggagttttccagatgagcatgaggaatgtagaaggcctttacaattaagaaaaagcttgttggaaaagaatgaattgcgtggatatctataggagaagagttctgtgtagaacgagaggaaatagagcataaaaaccgaggtagaaagtgtctggaataacctgggtgttattgtagttggagaggagtgagagatgagaggagggttgggaaaactgaagattttgctgtcgttgagagtgttatcgaccaccatgagaactttgggtcttattggtaagattgaaccataggaatgagctattaacatggcatagttgtgactaacctatctgctctatttaggaatagattataggagcacaggctgaaagaaactagttaaaagcgactgtagtttacacaagaggtagcaatagcttagacaagggaattactaagaaaccaaaagcagagctgtgaggatctgtggattgttagatgcagggtgtgaatgacaggagggaaccaaaagttacttgtgttttgacctaggcaatagaagtgagacattgagactttgcagtttattgagagaaaaactagaaaagcaagtctgaagcagggtggagggaaggctttgcatatgccagttttaggtgcctagttgacatcctggtgacaaacagacagccagatgtacaagtctgcaattcacaggactctggtttggagttataagcaggtagatggtatatccagttctacgattcgggtcaagctggctctggtaaaggtaccttcctgagggtgagcctccgaagaagccacatagtggaaagaacaaactttcacaagttgtcctcagacccccatgcatagcatggtgcatgtgccatcactaaaataagaaagtattaaaagaagaggagggccgggcgtggtggcacacccctttaatcccagcacttgggaggcagaggcaggcggatttctgagttggaggccagcctggtctacaaagtgagttccaggacagccaggacaatacagagaaacactgtctcaaaaagccaaaaaaaaaaaaaaaaaaaaaaaaaaaaaaaaaaaaaaaaaaaaggaagaagaagaggaggaggagcagcagcagcagcagcagcggctatgggcttgagacacagcttagcagttgagaacatttgctgttcttcaagaggatctagatttggtttccagcacctgtggggtggctcaaacctcctataactctaattctaagagattttatactcacttctggcctctgcaggcactgcacacatgtgatacacatgtataagcaaaacactcatacacatataataagtaaatctttaataaaaataaaacgcaacaagactcaatgagataccaaatactaagtgaacatagatttaaaagagagactatctcgggatccgagctttggcccctgaagctcctttcaaggaattgagaactagcgagtgagactaaaaaggaataaccagagacacacagcaagagtgtagtatgggaatcatgagagtccagtaactgaagtacaccagtgaagcagaggttaccaggtcttgttagaagaaatgaggaagagctaacaaccaacggaattactattgtggaagtcagtggtaggtgtgagtgtttggcagagtggatctgagctcaagtgatctcgtaggaaggaaaggcaaggagagcaaccattgggagttttttatttcgttggttggttggtttttaatagagggtttcctcagtgtagccttgactgtcctagaactagctttatagcccaagctggcctctaactcacggagatcttcctacctctgcctcccaagtattggggttaaaggctgtaccaacacaactatccagcataaaagagaacaagaaattgttgaggaaaagggctgttaagagttttttgtttgttccttgttttaattatgtttagtgggaagaataatgttgtgtgtatatactaagaggaatggtccagcagagaaaggaaagttctggagcagtgtctttggccaagcaaaagggcatgcaatttagtaagtagagtaactataaataggaatatagacagtttatctcttatgagaaaagcaaagtcagactgtgtgactgtcatttcactggggagcaaactattgggagtgcttgaaagttcttttttcttttttttagagatttattcatttatttatttattttaaatacactgtagctgtctttagacacaccagaagagggcatcagatctcattacagatggttgtgagccaccatgtggatgctgggaattgaactcaggacctctggaagagcagtcagtgccctccatctctgagagccatctttccagcccttgagaggtctttaattccttttctcaagaaagagagagctatgctactgacagatagaatgaggaaatgagttaaaaaggcagaaagagcagaagtcacccaaggggatgagaattagtgggcaagagagtgtaggtgctccacagaatgaaggcctactcaacatctgtcgagaattggcagtgacagcagtgaacagccatggttagctgtgtgctttcatgtgcagacaactgagtagctggatttctgttgtttatcttgatttgctttttgactaagaaactcacagtgtcatgcaggttggacgtcctagaacccactaatgatcctctggcctcagccctcccatggattatatgtatattaatgttagtgtggtggcacagtggaagactggtggtcagaatgtggtttggacaaggtggagtgttctaggtagacgtgatagtaacaactgtaaatatatgtttaccattctagtcggtggcatggacctaagagagcaggcctgaaaatgaggtgaccaaagtttcatgcgatagccaaccttattcatagcatcaggcaatttacactctgagggctaaggaaagtcacctgagtaaagtgtacaatcacaaagaccaacctcatgtgcctagacacacatgaataacaacagctcaggtaaactcactgttaccctctgcacctaggaagagcacaaaaacacattccagggacacttctgagtttgaacaaacaggtcacaagactcttgtcttaagagtttctttacaagctctcagaattctccttgaatgactccattcttggactgtgttctgacaaccatacatgcagtcaactatacagtttaaaagagtagaatttgctgggcagtggtggcgcatgcctttcattccagcacttgagaggcagaggcaggtggacttctgagtttgaggccagcctggtctacagagtgagttccaggacagccagggctatacagagaaaccaaaacaccaaaaaaataaataaataaataaataaataaataaataaataaataaatgaataaaagaaaaagaaagaaagaaagaaagaaagaaagaaagaaagaaagaaaaaaagaaagaaagaaagaggtagaatttctgatatatgctcttaattccaaagaaaagctgtaatctactagctcactgaaatgtacttattccaagtacaacatattcagtgtcctctcctaaagtagggctgtagtgaaaagatgaggatctgcctgcagtttccaacccttgtcaagactgaagataacaaagttactctttagttttgttgtttatttttctcaaatgtacattgtattcagctattactcagttgcagatcttggagacactgaatccagctctgccttagttactcttcctcctgtctttctcctccagttagcaattcttcctgacatttaaccaagcactatggcagacatgctaatacagacagcttggcttgcgcacccgtccttgaggacgcaatttaatgagaagacaaacgttctttttaagaatgttgagggcattgtgtttgtaggatgaggcagttctcattatcagcatcctcatttataattcacaggtataaaaacattgaaaacataaggagctgtcagacttctttgagtttgagacagtcttctgatttctagaccatcacattctttcttctatttagttttaaagcattttggggctaatcatatgaatactgataatattgctttcttccttctgactctctaaaccacaacatttaaaaagcactattgtaagtaacctagagcatgtgaaataatagtgtacatcatgaaaagtgtgggcattggggcccatctctcaactagaaataatgaccttgctttgcaggaatgttgagggggtgtggatgagagaggaaccaccctttttcttttctttctttcttttggaagtatgaaacagaccctgacactcgggaactgctcctcattatacttttttgccatctcttcaccaactctgtgtggagatgaagttaggaatatgatgcaagatggatgaccctaatttcagagagacagctggttctagctgtaatctcagggtttaagggactggggcaggacagagagaggtggtggggaggggaaacagacaaacagacagacagacagacacaggaatgtggatgttcttttttaatgggcattaattggttcagaaatgctggccatagcattgaactatttcagcaacttgtgttactctttcaatgttttacatcttggattgtagtataaaattatattactgtttggttctgagtatgaaaataagcatgtagatattgcccgctgggctatgaatttactaaaatacctttttccccctctgttagaatggaccgggttcatcaaaatccaaagggaatcgagttggatttgatagcacacagtgggtatgtacaccagacaagaagtttcagttacaatgttgtctgtagctcactcattgattactcctctaatatgtgttgaaggatggcagtaacaataactaccttggttattgttatgagggtagaacttctaccaagagctttacatgcaatatctcactttgtccgtgtggaaaccttataaaatcagtatctattgctgttctcagtttagctagttagagagagtaaggttagttggctagtaagtatctgaatccagatgaaagtgttccatctctaaaattcttgttcactgagctatattgcttccccaaatcaatgaacaaatgaatcagaattgatctacaaacataaagggaaattaataatcaggaataaaaatcctcggtgctttctttggaagaggaaaggaacagataatgaaatatatacactacatcttttgttttacaaaatttcataacctccgtattttaaaaatgcattttttaaactttttttaaacctaattaaaaatgcaaaacaatgctgagagggtggagttaaactgtagctcagttgacagagcgtttgcctagcatgcaggaagccctgggttcaatctcaagcactgtataaaccagacatgatagcaggggggccaggagctcaagatcaccttcagctacagacagacactgtgcaggccagcctggcctgcatgagatcctgtgtcaacgacagttcttaacactgaaaagtaatgctggtttactaaacaaacaaacaaaagcctttgatttaacagttttctttgtttgtttattgcttctttgttttgtcttatttatgtctgttattttgagacaactgtagccttggttggcatggaactttctgtgtagaccaggcttgcctctcaagctttgtgatagtctcctgcctctacctctggaatgttgaggttacaggcggtcatcaccatgcttggcttttgtagtgacagagcacttacctagtaagtgtgagatccagggttcagttgccagtactggaaaaaaaaaatctattgacttaatggcttcatagagattattttcctctgaaacagcgtgcagttaagaaatttattatgctgacatccagccaaaatgtgccagtgttccttattgacccatggattctggaatcaattaataaaaacttcgaacaagtgaaaaatgcttctcaaggcccggcttcagaatgcagatttttctgtgttccgagagacttcactgcgttcgcactgcagtatcacctgtggaagaatgaggtgagtgggctgaaaatgtaaaacatctacagtcatattgggaagatttccacagaaggacgttgctattaagttcattttgccaactcattataagttcaaagcaacagtttcacatggccttgccttatagtgctcacctgtggctgcagcctcagagttgacttagaatgaatgtttttccttgaacacaaatctttcccaagcctgtttctccctttagtgtaattgtgacagctcattgtattccttattatgcagcctttacttactattctatgtggagtagcacattctaacattctattcttgattctaactttattacatctttttagcaaaacagctaaaaccatctcttaaaactttcttcccagaatcaaatcaggaattctataaaattattaatttatctaaatagtactaattaaagttcatcttcatgttgatctataggaaatttgctcagtagggtaggctaatgcccaggaaccctcaggctatgtaatagtgacaggaaaggcatatcttctacaagaagcaatcctgagatgattctcttgggaccttgcctctcagagttcacccatcttagggcatgcaaaaaggttggccacctccaggtaggccacctgctagtcttagcctttcctaaatggctcctgaaacttttacaatataataaaataatggtggttcttgatgttaatttgcctctccactgagaccagggctgaagttctatctccatttccactgttgttccagcataatcagtaccagcatagaaacattatgctcaagaccagagaacgagaggcaggaacaagaatatcagcctttccaagggaaatttttttctcagaagcttctagtaaactgctgttcagatattctattgggaaattcagtcttgactatacttaaggaggccaacatggatgttcagtctgtagacaggcaagcaggggtcttatgctgcattcccactctgttgcagaaggtacatctcagtgtgtgatttttgtctacagcagtgttcctccattttgtatgtacacagtactagtttgatagtcatggagtagtttttagatgtttccaaaagttgaacttatatttccatcctcctttgtagtttcaagatgaaaggcagacaggaataaggaggagaggtgcttctttatttcaggtatctgtcatcattttcatccagtgtagatgttgttcccccaaggtttatatgttgtaaacttggtccccggagcagaggtagggatatagaccataagtggtagagtctggtgggaaagagattaagatagcttgaatcagaaatatgagcactagtagtcagccatcatgagaaatgcagacattctatagcggatctggtaagtcatgttgactctggcaggttggactccttctggagtggcagtgtactctgggacagcagtatatgctgcaggttcctcggttgcctcaaagtcagtgtcagagatcgtgtcccacggttctgcctaggcagtgaagcaggtaagaaacaggtgaagtgtgtgtatataaggatatggtctttgttggcttgctttttttctcattttatattctaaagatgtctcaacctatagaaaaatgagaatgtgatattttaaacttcatttttatttttaagcaaaaataatactggtattgattgagttcagcaggtcagatagtaacacagacctcagtaagctagggcgctgtctgcctttccttttcctgcttactgtgagccttggacccggtcccttttgtcttgtttattttctcactcaaaaatgcttatgtgttaactagcatctcacttagataaggagttaggagaattctcctatcgtcactcattttatagttacatgatagtcagtcagtcgaccttatcataagtaaatactaactagcttactctgctcataggattctctgtgttttttagattggtgttgtgagttcagctgtgctgtcttgcagacagatcattccagctggccttgactgtttctgccctcttggagggatagacagggtctcaacagttacctaacaactgctgtatgcaacactgccttaatggcaccaggtgaagctctggggaggggctgcaggacataaatggtgaggacataaacaggatggtcactcacaacaccagtgttctgacctcagcctctaaatgccagtttattgatctaggaaatattcctccacctttccaaagtgtcccttgagtgcggtacactgctacttttaaaagaaagcaatatgctctatagttgtcaagactaaaacaacagagtccgtggacgaagcaaaggtcagttagagactggtgagatgacccatcaggtgagcttgctagctttgatcgtcaatatttgtttctgaattctgtagcagagaggtatactttcctaaagctttatgttccatgactgtaggttagtcataaataataccttcctggctgacctcacaaagtttctgtgggtatcaaaggagatcatcagtgcgcatgcaccttgtacagtttaagtgcctctgtattattagccgttttgaaagttgactttaaatatgtctccatacttaaaatactcatgctgcttcttatatagagtagatatcatatccaaatgcatatgtaagaatataagtaaaagttctttggagattttaaatttctagtgaaatgaaagattttttttgtttcaaatttataatctttctgtaaggattatagttcacagggcaccatacttagcagatactcatgtggtgtgtgtgtgggtgtgtctgtgtgtgtgtttaattgaaacagaattatatcagccatttctaggaggactgtttcccatcaggcttcctggtattctggcttttacaatttttcagaccccaccctgcaatgttccctgagccataaatgcttgagttgtgatggatatatatccactgggtcagcagatactcttaataatatttaatcatctactaaaatctacatataggataatcttaataagatttaaatcttaatggttttgaaaagcatccattgtcttacagtttgctgggctgggtttcctgatgtttgcgttgtggtgcgggttctgttaaagcatttttaaagccataggagataacaattgcaagtttgcttttctgttcctgctcctaacatccacttcatggacatcagtgagagaacgctaaatgagcattctcatcccatggggagaagtttgcattaatttttagagtccttagggacagtctccattctccacagctttcttttgctactttagtctttccgtgctaccttctgttcactactctcattaaaaatgttctagcaaaaaggcaaggataaaaacatggcctaattaatggtataacagctgctttcatcttgtcactaatatttggttttaaataatcatgcttgatccttgtcttatgctaggatggctggtttcggatagctgagaatatggggtttcaatgcctaaagactgaaagcaaggatcctcggctagatggaatagactcactttctgggactgaaatccctctgcactacgtctgtaagctgaccactcatgccatccacttggtagtctttcatgagaggagtggcaactacctctggcatggtcacctacgactcaaaggacacatggataggaagtttgttccttttcgaaagttacagtttggtcgttatcctggagcctttgacaggtaaatctataacaataaacagtaataagtcaataatatgatatgtttatatttatatatacatgtatgtatagatacacacattgaagtattataactcagggaaatccactgtgattctgcagtagtgtggatgggtcccacagtggtgagtgtctcaaggcaaaaaagactgacaggatagaggtatactgtgttcgtggatgtcttagtcagggtttctattcctgcacaaacatcatgaccaagaaacaatttggggaggaaagggtttattcagcttacaattccacattgctgtttatcaccaaggaagtcaggactggaactcaagcaggtcaggaagcaggagctgatgcagaggccatggagggatgttctttactggcttgcttcccctggcttgctcagcctgctctcttatagaacccaagactaccagcccagagatggtcccacccacaaggggcctttcccccttgattactaattgagaagatgccttacagctggatctcatggaggcatttcctcaactgaagctcctttctctgtgatagctccagctgtgtcaagttgacacaaaactagccagtacagtggatatatttaaaatagaataatggtactgagactagtaaggaaaagttactccaaagcaagatagagtgtatccctggatagggaggtagagggggagctactgagtggggtacacagagatctctagggtaactggcaaatctcagtgtatgtgatgaaggtgagatcgcaagtgttgtaactcatggtcttacgtctttatgtcttatacatacacttgagtgtgtatgcatgtgttattattactttatttccaatatggcctgaggtggtggctcgcaactgtaaatcctagcactcaaggtgaagcagatttgccagccacaggtgaggctgggctaaataacaagatctggccagcctagatggaatcacaagacattgcctcagaaaactaagaaattataggaataaaactaaaaataatactgtgtattatatgatacccttaactatcacaatgataaaaataatactgtgtatagtagtatacccttaactatctaccaaaatgataaaaatactgctggcaagaaatgggtacctgatgagactcatgtaaaattagaccataaatgtcaactttataacccagagtagtacttttctttccctttggaagtcattaataatgatgttataatatgttaatatactagaccttgatgtaaatatagcaatgaatgtcttttgctttcaacttcgtcatttataagaattttcataacaaagtccttttggggcacttttcagagatacactgctcactgttatgccatagaactataaggcacatttattctgtcttcatcttagtgtttaaaactacccatgcgagaaagagctgaaaaggtggtcagaactggagaagtcaggaatatcgttggccaaaatgattccgggttgtcagaaacagtttgttgacatcttcggctacttatatttatgcattttttcttattttgtgttttaaacaggctttttaagtaagccatttagttcttcaactagtaaaagtttacttcaaagtttagttaataatttagttcaaaatcaccgaccaaaaaataacttgtgagtgtgacatgtgccagcctgtagataaagccgtctgtgtgctttatagtttcacatagaggagtagaaagtgcccaagcagtattcatgcgggtgggttgcaggcgtctctccggtcagcgaggcttctgggttaccatgattcacttggagtttataactgtaagaactgtaactgtaactgtttataactgtaactttaaaataagttagtaactgaaaatgatgtcattcaactttcatttctgcttaaaatgccagagtacctggaaaaactattgtagacgcagaggcctgtaatccagttacctgggaggctgaggcaggagggtagcaagttcagtgccagcttcagctatttaagcagagcttgttcccccccaccccccaaaaaaagaaaaaacttttaatttaaggtgctagggtgtagctcagtggtagcatgtacaaggccctgggttccatccctcgagggaaatcgattctccttcccctcagatttagctacataagtgaaaatacttaaaactcaaactctgtgttgctacttgatgtctgattttcaaggtcctaataaagttgctgattgatgcccaaaagatttgaagaaaactcacatgatgtttagcttctttgttggtgtttactgtcttaaaaggctggcagtgctctgggttaaatcttgatagtaaagtttctttttaacttttgtttttcaggccagagttacagcaagttactgttgatggactagatatgcttattccgaaagacccagggcgctttctagaagaagtacctcactccagatttatcgagtgcaggtataaggaagctcgggcgttcctccaggttagaaacaaccaaaacctgcatttctaagctaaagctaaggagaggatttgcttattttagtttataagaggagatggagaggcttctgcagactaggctcaaatggcttcttaagtcgatcactgattttcctctcatttaaagttaaacactaaactctgtttccccgagtgctggggatgtagtctagtcggttgagtacttgtctagcatgcacagggcttgagtttgctctccgtctccacatgaaccaggcatggtaacaggtgcctgtaatcccagcacttggaagatagtggcagagagttgaaggtgacgctccactatgtggtgagttcacaggcaaccctgaccaacagacgctatctcaaaagaaaacttgaattctgctggctaatacggcaggcttgtaaccacagccagcactcagccagagatctcaagttaaaagcagccctgaacctcacgcatgggcgcgcgaacacacacacacacacacacacacacacacacacacagaggcaggcaaacttttttcttccctgaatggagaatgatcatatacttattactttattgttttatttcattagatcctgataggattaacactggcttattccacagctatgatagctcattaactgttttaaagttactttttttttttttaaagaagtccaagttggcttagaatatagccactgaagaggggtcatgtgaatttagaaaggtttttttttttttcctaagtttggcactgagtatgtgtgtgtgtgtgtgtgtgtgtgcgcgtgcgtgtgtgtgtgtgtgtttggcaaagagctatacaaagaccggctgaattttcagcttttcctctactgttctaactttgtaggtttctgactgtagtgatataaaaatgattttggtgggcgtaaaagttcaactgtaacaagtcatatgagaccagaaaggcagtgaaaacaggccgttggactgtggggatttggtaccccagttctacttgcccttcactttctggggttctctgcctctcctcacagagatctgcctgcctctgtgccatcatggccagctctccagttcttcacttgagtgctggccccgattcccctcaggcatgagctgtgactggtgagctacacccttttctcccccaagttgccctttgattgtagtgtttatcacagtactggagagcaagctagagcacataggagctactaagtgccagctctttcattgctgccccaggtccaagactcaaatacaaggcttctcacatactgtatgctgatacccaagacagcccaagaggttcttctagctcttcctggtcttttgaatttattactgtaaggctgtcaaatttactgagcttcgtggtagaggctagagagcagcatgtgtgttaggcctgttgtgcaggcaagttctgcctccaccacacagtgataagaggtaggagggatggattcagtgcttcttcctgccctatgggcattgcccacctctgccctagcagttgccatggtgaattgtgagtgtcttgcttcctcctaattttgggagcttcctggtagcaggcgtcttagtttattcacgacagtcattgcagccatgtcattagtgatgcctgacttgttttcaccgctgcccttgtgatgtgcagtgactagagggcttggtcatggtcttactttatcctcttacattagaaccatgagtaagataccaggagtgtacactttcaaattaaagttggcatacacccatttgaacacttgatggcgccaaacagtcttaaatggttgtagagatgaactaatccaataaccctagtagagtaccccctagcattctcgtttgttttaataatgatattttaaaagcagtgtctgacttatgtaacagttgccagtacaatagaaataatgcctctttttttctggcacatttgagagtaatctataaaccagtatcccaaagcctcacatagcttagttctttctaaaaacacaacagaacaaaactagactatttcctatgtctgaacatgaaaatcaagaattaacataaattgcttttaatctcaatctaagctgcgtatgatggcacatgcctgtaatcttcatgtttggaaagccagggccggaggattgccaaaagttccaggcaagccaaggcatatggcaagaccaatttaaagacaacaacgaaagtccacattcacatcttgctggttgtcctcataataggtttgtattgaaaggattctgtttacaatcacatgctatactgatttcctgtttctttaatttcttgtagtctgtgctgggttctctaccagtttgggtaactactctcatagctttgataattttggaggttatattattttgtagactgtccctctggttttcctcataaagagcatggcagtgctgctatgcttgctcttctcattatgtcccagaaggtgctacctgaccccctgttactgcttctcgcctggcttttcctgaggaagcgtgaacaattagtgttcaccccagataggacactaacagcacactgaaaaccgattccacccgagtctagcgtggtgaacccctgagtttgttaaggttacttccgagaccatgggtgagaagttccaggagtctgatgtctctgtcagctgcatcaccacgaagctcacctctgtgtgaggaacacttagaaaagctgtgtaccctgaagttccacacagcaccagggggcatcatcagtctcagcacctactatgactgcctaggggcaaggccttggggatctcctgagacctttagttctcatgacttctcgagtcctgtggcctcccttctccctctggcgggaatgttcagaggaaggccacagaacactgctggggttgcatcctgcctcttacctgctgccttcacttttgtgctattgcatttttccctttgtaatcagaagcatttgtttgcaagctactttgtaactattaaaatattatatttcttatcaaatttattgttaagataagagactcatggtttcctgtttaatgagttattttaatcttcagattggtccacatttggccagttaaaaactcttccggatagcttttgtatcttctggcttatctcattctttcttccattttagtaaaatacagatattctaggctcatcctgtgattttcctatcccagctctggggtcagccatttctcctgagtccttgtagaagccgacatctggggagtaggtagtatgcccattgctctttgggttttgctgtacacagctgtctcacttaatagaaacattgtgcatatgtctgtatatatttatttctgtgtctatttgatgaaatctgtaaattcaaatcattatttccaccctgattaagttataagagctagctaaacaacattggataacctatcaggggactggagaaaactgtttgtccatctgttagcagccattcactgcctatagctcttcatctagggattagggccttatgagatttctcccatccacactgtaatgtcagtggtactcattgtacctgtagtcctgttgaggtgaccatattgttaaagtttgggggttcatgtcgtgtcctctatagaggatgctgtctgacagtgtgatcttttcactctgagtcctgcccctcttccatagaacagggattgggttgtacatgtattggctgagctaggcaccccacgttcagttctctgcattgtggctaactgtgactctctatggtggtctccatgtgacgtagaaagaagcttcattgatgaggggtgagagctatgcttactgtggctgcaaggcaaatactcgtattcagaattcagtagaattacactggcttaggaaaggggcagtagtaggttctcctctaggctccatgacctctttcctcccctggccgggtttacaaaaccaggcacgagatccttcctactgagcaagccttaagtccaattaggtggctgttggttactcccaagatgtaagtgccactgtggaatccttggtggcatctcgccatgcggctcattgatgtggtgtagggtttgtagttgagtaaggctgttactgcttttctcctttgcagtttgcatgagcaccttcagatgctatgagaggcagtcctcaggaataaggcttccaggtcatttttagctagattcctctgagtcccgtgaataaagtgtgtagtgtcttcagctagtgccttcccttcatgttctgaaaggcaaccaaggacaatggcttatatcgtttgggagtttcttggactcctctgatcaacagcttgaagaaaggtttctcataaggcaagaattttttaacagaaaggaaaattgtagcctcaagatatcacttaacactgtcatattggcttagcatgtagtctacatggcagctgggtctgtaaactttagctctaggcattccttataacaagcataggaacatatatctcccaatccagtcgtgtgctctaaaaaaagcagtggctcaggaaagggatattttatttcaggagattctttatagtttgcttaatccataagaacaatttacctgcaaggagcgctccttcataagacactttgttcctgaagagagccatttagtggttccattccttattgtcccagtgacatctctgtaaactgtatctctcctgcattcttgtaaaggaacccagttactttaggacattgtcagaagtagttacttcctcctttagtctccctacagtatttgctgctcacctcctcaggagcacacgacattccagcgttatagattccgtggggagaagtgcggtgcctgctctcgtgtgtacagcctcactgaggagactgagacaaaaccaacagtaacaactaaagtaagaatgaacatgcggggccagagagacagctcagtggttaaaagcgctggttctcctccagaggaccaaagtttgatgcccagcacccacgtggcggttcacaaccatctataacctcaagagatttcatgttctcttctatctccatggataccaggcatgtacatagtacacagacataaaaaatattaattttttaaagaatttaaaagtatgtgtgagtggtgactgttgtaggttaatggaggagctgactgatgtatttggctttgtgtattagtacatgatcagtgggaacactgggaaaataaactcacctgtcttttaggaaaactgggttatttctcagagactggatcgaaaacatgattttcattgtattcagagtcagaggcacactaaaaaagaaaacagcatataaggtcacataggctagaaaggctgtgccatattgcttttgtttgggtggttacttgattttgtttttgtttttttttttttgagatagggtttctctgtgtagccctggctgttctggacctcacttgctctgtagaccaggctggcctcaaactcagagagatcgtcctttaaaagcatgggccaccactgccgggctgagaagttgcattttattgctataacaggacatgtaaaaagaggctagtgatgaaggcagagcagaaggcaggagggacctgtgtccttgctcttctaggccaaatagcttacattttgttccatagtgagctatcactgaagaattcatcctgttttcttcagttacaggataaaatgcagtaaatccaaacaagcaacatgactaagtaaagatgatattatacaaaactgtgtattttacagaaggctttcacttagacctgtagagtggttctgcaaagcacagttactgtctttaagttataaataaatgaagtcagtagtggcaatgaaatttgcttcctccgttctcttgttcattcatgagacgtggagatactggtgtagacatgggtatttgatgtcttttcttcatcaagcttacactcttgtgaaaggagatggacctagagccaaacacaggttatctgattcagaaagtgtccttccctgcttgactacccagtgtctaaagagaagtaaatgactgtacaatggaaacatcatgtaatctattttgtttaatgcttctagctgtgtaattagctcttcttttcccccagctgcccagcctgctaaattctgatgtgcagagaaaagtgataacagttgaagtctcatcattggggaatactagttccttccattctttccttctaaagtggttcttctagaatctatcctaattgttttaatgtgtgactaggaaactctgatttctgggcgtgttgggtctatgagtttgtgcctgtgtatatagatgtatgggcacagttgtgcacttgtatctgtgaggccagaggctaacacttggtgtcttcctctactacatcttgtttctgtccactcccaagtctcctgcactcctgcccaatgcacccccttctgccttcatttccttcatgtttataatccacagaatccacttagtacttgtacatgcactttgacatgggccatccaccagagcttggacaagttagcagcagacacactccttcaccttaggttttagataggtctctcactaaacttggagctgctggagactggttggccagtgagctccagggatctgtctgtctgtccctacctgcacagcatgggtgttgcaggcacacacaccaacactcccagcttctatctgggtgtttaaaatccaggttcaggccctcatgctcccatggcaacacattacccactgagccaacccaggccccctaaatttggatttttttacaatggaaaaacgatgcactgttaatttctcaatttgattcaaatatcgtattagtgtttctagaagtttagggattgttataatagataactgtttgttaaccctgcagcagtacattgatgataatactgtggatgctatggtctttcgaaagagggcaaaggagttactgcaactagcagccaagacgctgaaggacctgggagtgcccttctggctgagcagtgggacttgtctaggtaaaaatgctttactttttctctctctgtctctggctttaggagtaaatgcttgtggtaatcaggcatcagtaatattgacagtgtactatttataatcagaataagcattagtgtacaaagcaaagatgcattgactgctttaaaaaagtaattgataaaatataaaatagaaccttctttaaaaagatttatttatttatttatttattttatgtttactagtgctctatttgcatgtacaccttcacaccagaacagggcatcaggtcacattatagatgattgtggaccatcatgcaagtgctgggaattgaactctgaacttctggaagagcagccaatgtacttaacctctcagccatctctccagccctataaaatagactctaaggtcacttgtatttactacaagttataatgtgtacaaatttacatcagacatgtatattatggttggttttcaggtgattcttaaattacctttgttatcctgaacacctttgttttctcaaatattattattgctttacattaaaataacaacagaaacgtttacattgcaggagacatttctagtgagaggaagattgaaggcatgctctgaggtcatccattagcatttctaggtcactgagggcatcactggtttggcatcaccactcacttgagatggggaaagatacttttgtagtcttacgcagcagctattaaactctggagaaggtttccagatacacattcattaggtcagcttcttggaatttagaattatgtagatccttaaggttgttctttttatctgttccttcgcaattattactgtaggtgatatctatgttttgattgtgactatatttgtacaaaggttaattcatcttttaaaaatgacaccatagaatttgatgtccaattcaggacacttagagactgaaaggaaatgccttaaataattgtacggcaggttgtaacctaggattcgtggctctcctacagagtaggttatgtgaaagattacacacttagactgggtgtggcacacacctgtaacccagcacaggaggtagaggcagaaggctcagaagttcaaggccatagctacatagcaagttcaaagccagtctgggatacatgagaccctaaattagaaacaaaataataaaaacataaaagatcacagtggtaatctcttgtatatatgatatttgctttaaagtttaactttttagagaagcaaggttgttttatagtcagtaattaaaaattcttagtcatttgtcatgattcgagtttttagcctcgagtttatttcatttataaaataagagaattgtatttgatggtactgtgtattaaatgatatttatagtatttaaggagccttcgattttacattttggtgggcggttttgtgggtgggtggggttaattttgttataattcaacaaataatattacccagtagcaatgcctatcagggtgcctatcagacatttccatacttcaaagccatttgaatagaaacattagaaggtaatagggaagactcaggagctattagtaatgttagggagtaagctttcttagaatcaacattctgaggcatctaaacaaggagatgcacaggaatcactgggaaatagctttgctggacatcagaccttaatcagatctttttaagtgaccattgcttatgagctgtttggaattgataagtgctataagttatggactcaggaaagtccattaagagaactaaatattcttagcacatcttaaggcagtctcagtcatgaaatgttaatgattaaactctgaacagcagttgtttaagtggatcatctgtttaccatattattaaaggtaatgatctatccagaagttattatggatcctgaaaactttttcttatttccataggattcattgtgtagctttggctgttttgaaactcactgtgtagaacagaacaggctggcctaaaggtgtgagccaccacgcctgacatcattaaagcctttgaggaagctgagtactcagaccagggaaataaagaaaaagggagagaaagagggagattggttcttcaaggaaacgcctagtcgtttagtttgggatttaacttttaaaaaataatcttgccaaagcatcccaactttaaccctatgaaatcatataaccattactataaagtttgttcattataatgactaattttccaaatataatttaagccttttatccccttcccctactttaggatggtatcggcagtgcggtattattccttacagcaaagatgtcgacttagggatttttatacaagattacaaacctgatattattttggcatttcaggaagcaggacttccactcaaacacaagtttgggaaggttggtaatagtcaaattaatattgtaaatagtgtgtctctattgtaaagtttaccttatctactgtatatatacttaaatttgtgacaaacatagttttatcacccagtacttatcaggataggcttgtggaagccattatcccttaagatttctgtgctccttaaagggaagctagaaaattcagccttttattaatagtgaagaaagaaggttctttggtccttgtaagaggctgtattgctgttttattaggcgatggtatggtacaaaattaatataaagctaagatatctgaagttattttttttttctgagtatcttattctatgaccatttaggacagatttcataataacatcagcacaaatatccattgcttgctaagggatagaaatttggagtcatgtcttgtcttactcatctgtcctaaggtgagcaacttccttagaagctagcaagagccagggcaccatggcctagatgaactcttactttacaccgtttgattactgttctagaagcccatgatcctttgtgataatcctgctcttaatttgtccacagaggagtattatcctgcaaagcaatttttaaaaaaaagggaaaagttcattcctggaaaattatttctcacaataggaaataatcattctaatttaaaaaatacacacacacacacacacacacacacacacacacatttaatgttttctgcagccaagcaaagcaatagctttattcgttcagcagccacgtgccacgcgctggtgtgtggccctgtgctttgcagtggagcatacgcatggatgcattagcttttacttccgtgagggtcacatgagttgttaagtgatgctgttgaaggcacacacgcatcaagtccagcgtgaaccacacttttaggataagtttcctttcttctttagttagaaatgggcttgggaatatgatgtttccattttcccagtagagtgacagttttaaataccaggaggcatttactcaggaagttttgtcagtttaagaaccgttggtttatatgcatttaagaaaagttagtatagcatcccactttctgaagctgctatttcgcagaacttaaggttaaaatccgtgcatcttagaattaatgctttctacataaaacattaacatatttccttttttaaaaaatgaaagtgtgttcctgttgtttcagtctgtaaaggttttcactctcctataggtggaagacagcttggaactatccttccaggggaaaaatgatgtaaaacttgatatttttttcttctatgaagaggctgaccatctgtggaatggaggcacgcaggccagaacgggaaaaaagtttaagtatgaatcagataagtgcttactaaacaaaaaggggctctgggggtcactccagaaacgagaaagtctgctactgtgctgtcgcttacctagagcccagctttcctgtgaagctctcagaactcactgtggggagtgcatgaggagggatcaccaaggctgctcagctgaggacttatgaccaaaatcttgagttaccataggacaaacagcaaaatatcaagcccacagcctaaggcagaagtatgtctgtcagagttatagcgcttgataatctatagcaatgcacaaacaactgttccagacagtggactctatagacttcgtattttcggccactgttccacatggcctccataatatacttgacagtaagaagtacttagcatagtacttagcacttagcaagttaacagcatgtaggattatcactgatgcagtcacctaatgtcatgattcttttatagttactatcattgctgctattggtagtcatgtgaccacaggcatcaatttgagtcattaagcaggaaggagactattctgtatacatagaggaggaattctagacttacagtgttgctgttcttaggttcatctatcctacgagggtccctgagtcttcacgtgaagattgtaaagtaaatttgttttggaggtttgagagtaatccagacctttttctgaaagtcataaattatctccaaattgactctcatcgtagagcatattctttaaacttttgttagttataaaaactactttgctttatgacaacaaatgctattgagtaaatccaattataaagtacataggaatacagatttttataggaagaaaaatgagccagagagatggtttagcaggtaagacacttcctgtcaggctaaacaacctgagttggatcattggggacatacatggtgggaggagagaccaactcccacaagttgtcctctgatagccacacatgcagcacactgtgcccactacaggtgtacatacaaacacaaaaaacgattaaaatttttaaatatacttagaaataagtaaattaatgagcatataagtgtcttggtcatggttattactgctgtgatgaaacaccatgaccaaaaagtgagttggggaggaaagggtttacactttcacactgtagtccatcatcaaaggaacttagggcaggaacctggcggcagaagccatggacggtactgtttaatcatggcttgctcagcccgctgtattataaaccccaggaccaccactcacaatgggctgggccctccccatcagtcactcatttaagaaatgctgtacagggttccctacagtgtgagcttgaggaattttcttaatggagcttcctccctctcagatgactttagcttgtgctgagctgacatcagctccccagctgaatagtaagtagtacctaaagttagttaggtgagggggtgggggttggaaatatgcacagtttgtctattcaaaatataacagagatgtgaaagttggtgtctagagttttttccttacagactgcacaccatagaagttaggatcccagagccagcttttgagtcccagctgtatgtgttacacaacagcaggtttcttatttggcctctctgcataaggtttttccactgagaagtggaaataatattagactttgccatgcagccttgttttaaggattaaaactattaatatgctgggagggattttaagagtgtcatgatatcctgaatgctattagctggtgttaataccactacagtaatagcaacaaaaaattatgcctttcttaggcttatgacagatgtactaatgagctcgttatgaagtagcttcgtctgctttttgagaagtcatgtaagccgtcactcttctgtcttagatttcccactaagggtgagtttgtcttctcccgggtgtggtcctgacccataatccccaaaggaggcgctcgtttcagccgctgcgcttctggtagagacaactttggttctcctcacagctcgttccagtcgcagtgtttgggaagtgtgaagcgctctcactaacggagaagtgagcagtgagggagctgtctgcacagatggtgtgcgtcccacacttcctgtcatgaaactatgaccttagaaggcagagaaaagaacaggggaggctgtgtagagtggtttctttggaagactccccaaccatatgccatagtcagcactatttactttaaggaaatacaggatgtaccacacggccattttcaaaggggaaaacctgaaactgtgatggggtccgcttcagtccagtgtaactcacacaccagctcaatgcagatgacaacaatgtattgtaatgaagctgctgctgatccatcagggccgcgctgggctgcagcaatgagccagactctcccagagtggttaagcttgcaaatcataagatccatgccaaatcattgtcacattctcctaccaatcaggatgggagtcggttcctgggcctgggaatatgaacgtttaaccctgtcagcaagatggagaagttgtccctgagatggctgaactctgacaactgtctccttaaaacagaagctgttcagctattaggaagcccccagctcccctggggcctgggaccttgaacctaatttctccctatgattaatggagtctgaaaacaatacggcagtacctaggacaagcttattttgctagtttccaataaagagtaagagttggtttttgtttttaattttatagtactgtttaaagcaaaacaaacaaaaaaccatgtgttgttcatgttgagaaaaaaaaaaaaaaaacctgtggaatgcttagcattttttgaaggaaggaactccatgggaaacgcttcttgtactacactgggctccacttgccttcagactgaaaaattgaaatctaagatttaataaaaattttactattagtagcaactgtaaagatggagttaccagaatgtctgctagatgtggcccactgtatatagttttagataattttatattacacgtgcttgaggaagcttaagacagtgatatgaaggtaattctgtctaaagctgtggaccattaataactgtgccactctctaacctcaggcttgttttgctcttcctaaatacttggcttaatagcataagtgagttgatccttgtcaagtacttagaacagtactgtattagccttaagtactgcttctgttaccgctactagattatcactactctgacttcctaaggtgctggcctggcacagagcacggcacctcaacaggtgctgatggcttagttaccctttaggtgagccttttcctcccaggtatcattcagtctttcgcttctttagtccccattaagtcttttggtttttccacttttatatcttctaaaggtatatattctgtaggtttcattttcaacattgtctatgtttctctcatctgcatttcatatatagagtccagatcaggagtagtaagacgtgatgacgctctaacagggtttatgaggggtggtgggagggagagggtaatctgtttaattttcctgcagactttgtaagcattattattagcattatataagcacaattatataattatacaagcataattattagcattattgccttctaacgtattcagtggaatgtacagataaagctatcttagcccaaagttcatggtaggaagttttttctttttaaattttattagcaagctgggcgtggtggcacacgcctttaatcccagcacttgggaggcagaggcaggcggatctctaagttcgaggccagcctggtctacagagtgagttccaggacagccaaggctacacagagaaaccctgtcttgaaaaaacaaacaaacaaaaaaaaacaacaaaaaatttattagcttgtattaattgtaaacagtaatgagtttcataagtgcattttatttcaaacatttgggtcaggacgccttttttttgttgttgtttttttgtttttgttttttttaagacaggttttctctgtgtagccctggctgtcttggaactcctgacagttaaataccctgttaggactgacattgtaaagtactgtttccattattttttgagctgctgattccctgtgggccttaaaccacctactgtgcttcagataatgtcatgaaaggcaataatcttcttcttcttcttcttcttcttcttcttcttcttcttcttcttcttcttcttcttcttcctcctcctcctcctcctcctcctcctcctcctcctcttcttcttcttcttttcttcttcttcttcttcttttcttcttcttcttcttcttttcttcttttcttcttcttctttttttgtcacagcagcaggtttggccaggcagtggtggtgagagcctcccagcacttgggaagcaaaggcaggcagacctctgagtttgaggccagcctggactacagttctattctagacagcctgggctacacagaaaaactctgtctctgaaaagcccaaaacaaagaacaaacaaaaaagcagaattgtttacacccacttgtaactcattaagttatatggcaactaacttaatagaactaattgcatgtggtttgaagttgaagcaaacaaacttttagatatatattttataaataacatttctaacctaaacaaaaatcagtaattatgaatttggaatagcaattactgcagactgggaaagggagcctaaagttggtccctacatgctgtatgcatggaccatattgatatgcacattaactgatatgtattagtcaaaagtaaagcagaaatagggtcatgttgtcatcatttggctatgctatatcatacaaagaaatctaatatccatgcagttcagatcttaagcaatcatgtcacatttttatgtagtatcctcagagctaagacccatccttcctcatcagctattgaactaataaatatggatgaagaaataaattaatagggttatgatatatattgccagattgtggtcccaaaaagttattaaaatttttgatagttaccaataataagtgatacttttatgctactgaattttacattgtaatgttggtctttgtaagactgttcctttgagtcattccccccatagcttttcattaatatagcatatcataaaacaggatcagttattgatgagaggttatgaaagttattacctggcaactatttcaaaatccataggctctttggtcccactagatacatatctcccactattttctagtctccatttcaaagttcagctatgaaacattttaacactttatattatatcattttaaatattagttgaccactatgtagaaacctctatctagactttatacaagtatgagtttaggacagtgggtccaggaagtctgttagccctggattcaagcctaagatcagtgtttcaacctaagcctctgagcttcagattttcctcaatgaggagaaagacactgcgtccctcacagcatgtactacttagttgcgtactgcaaagtcaccggttgtaggactcagctcacaatagctctcatctcttcctaattcctagaagtctgactcagtatcatctagtaattaaggggaaatgtattagtatactaaagtctaccgtatgttccaggaggaaggccgatttctgacacactgtgacagagagatgaattgtagacctacaaagggtaaaggttgacttagtacagttggagtggggattgctagtaagttaccttgagttgactcttaagaactggtgaagcgtaggagcgatgctgaggacgctagtgaacagcagttgccaaggtcttcatgctgagctgcagacgcactggctgattttcttatgcatatgtatgcataacgtggagttgcctggtcattcgatatatgtttcaccttaaggactttgctaagggattgttctttgccatccttcatgcggccatcattgtattataagacacgcacttgctgcacgttcttggcagcacttgatattctctttagtttttaaccatttttcttagatatgcattgttaccataccatagatttaatttccacttttttgtattcattgactagctctgttttgtggggaacttattagctatcttagtggttttcctctgagacatcagttctcttctcactaaccatagctctatgtattaaaaaatctccttccagtatgccctttattctttttcctctcaatagtagcttactcactgaaagttcttagtttcaatgtaattctgtttatcagtctttatgttcagaaccttggtgccctttttacacaatagtttcctatttgaggtaatgaaggtattttttggtcgtcttttagacactgttttttatgtaacaacataaagatcaagtttaacctccagactttattcgtattagttttttgttagtattctctttcggttccaagagtcagtccagtgtgccacattattttagactccttggcttttgatcctttattttaatccaggagtttaagaatgccaccagtgattccagattgccacccctcattgtcctggctcttcccagtcaacggcattgacttgctctctctgtaaagtttagtaccctgtagacatgatcttccctccctccgagttgtcatagatctcccctaagccccacacaagttctttctgctgagtgttttagagtcctttgcaaacctgtctgccctaaattacagataaagtccgtcttgataactctcaggctgagtgaaacctaggtgccgcttgactctgaatcagctctctgctgtgtggtgagcaggagaggtgaaagagtgaagctaggtcattgtgcttgtctctgtgttatggagttagcttcggagctgtccctcgtgcactcccagcccaaggctgatgctgtgctcctgtagctccagctctcaagaaacacatctgtctctgcaggacatacagccgcaaagctaaaaggcagacttgagtaatttctttaaatgaggatatttaaagtgttggcttttcccaagtgatcccatctcctgctctatttatatctttgtattttgtaatataccgattatatcctgggtctccgtaattgaatctccagacagggagggaggggggagcaggtgtaagaggaagactgagggagaaactgaagaggcagtttcttctaaagtgagccttgctttattgcaaggagaaaattgtactacaaaacatctatgggaagtcaaagttgtaattttttcaaacatgtattttgttaaacataattctgtaagatactaatttgatagtgtctaaagagacatttccattacaagacttatgtacaggtgttaacagttatattcagataagcagaatggtttggttttaaccatgctacccagacgtccaactgttcaccttctggtgagcagctgcattcattgtgtattcacacaatggaatactactgagtgctgaaggggaatgagttaccagatatactaacatggatgaaggaagtcagatgcgagggggacttaaactgtccattttcatttatttgaattgtcggctgagcatagtggtatgcatatggaattccagctcccagtaggctgagtccgaggactagccacaagctcaggagtgccccaggctctatctagaatcaaaaacgctcccatgcaggttctcttccgtataggattgaactcaggtcatcaggtatggcagcaagtgcctttgaccaccagccaccactcactggtttgctttgttttggtttggttttttggtttttcgagacagggtttctctgtgtagccctggctgtcctggaactcactttgtggaccaggctggcctcgaactcagaaatctgcctgcctctgcctcccgagtgctgggattaaaggcatgtgccaccaccgcccagctggttttttttttaatcacttaaaataaatgcatttcatcctgtaagattacacctcaaagcattaagttaggttaaaaatacaaaaatactttataattttgaaaaccgatgctaagacaaaatagtctgagattgcacattgagaagtagcactgtatgggccagaggcagtgaagttgaccaaggaagacctaattgcatgaaaaccttggcatctaattagacaaattaggtaacagactatgatttttaaaatccttttgaatctggcgtgaaatttgaactcctaactttaacctctctatctaattattacatctaaagagaaattcttcaaaaattatctgacagaaaataattatagctagaatcttaattttgtctactcattaataatataaattgtatttcttcctctgctgccttcatttttttctcgtgtgtgtgtgtgtgtgtgtgtgtgtgtgtgtgtgtgtatgtttatttaggagtagagaatgagacataagatctcagacactatttcagcctatgtcctggagagtatatcaattcctctatgactccttccacatggtatcacttgtggtagaattatgaaatgtttagtgaaagagactattttgtttttcagtttctttcaagacatggtctcactgtttaacactggctgtcctggaactcactctgtagaccaggctgcttcaaactcataagatccacctgcctgtgcccatcacattgggattaaagatgtgcaccaccaccaaccacctaacagtttttaaaaagaaatactcaccagcatgctgtgactgtgggttttcaagagttgagtctaatgcttggatgaatgtgtaagagcaggattgttaaacatatacagatttgagagtggaaagtatagagatgtcataatgagtctcattattatatatggttaatacatattaataggaaaatgaaatatgaaacaaaaaggaataggaactaattgtaatagtatggtctgaacacttagaaggctaaggcaggaggagtgaaagcttgagatgcaacaagagagtaccaggtgtgccttatcaataatacagggcagcagatgatgttccatagtcatataaaagctacaataataatgatcaagttttagtgatcaacaattaaaagtcacattcagggcaaggcagaagtaacatttacaaatacttaggaaggctgagaaggttgaggcctcccagatctgtactcagagacatagtgaagaagccagaagtggtgctggggaggtggcacagtggtgaaagcatttaccatgcaagccagcagagcaggtaaaggaagcaagccaaaaaccaaaaaaattaataaagcagtaaacagtgtaagaggccaattccacctgttggtttgtttaaaaaaataatttaaaattttgtatagcatacatttagcacaattgatcaaggtgtgggagtggggttagtaaagataatatttactccccaaacccaagatgtctggccctttacacttctcgctgtctatgttgtgctaacaatgaaaaactactgcaggagacctagatcaagcatttcagcaatggggacaagatgtaagactgtgagcccaggtggaaacatgctaaaagaatagtttcctagtgcacacgcatgttagggtgattctttactgtaaaggattggagggaacacatccctgtgcagaaggcctggtatcccatccccagcctgccacaagggcttggagggcgggctgctgactgaattgatgtcactgaaaaaattctgtaagcaaaagtcttttaagaaaatttgtattaaaagggctatggggtgtccttgacttgatgaacggaagatagtgaaaaccgagagcgagcaccacgtttaatggtgaaactccagaagcctttccattacagtcagcagaagcagtgttcgtggactcctattaagtggaacgctggtgtttaggctctggaataacagataaagtgagcgaggatgactatacaagatgctaatgttaataaaccgtttgtgttgccttgaaagaagttctggggggaggggagtttggctgtgctcttgcaagtgtgtggaaaggtcaagtgcagttgtagttgatgggtctgtctcacttagcctccttaatgagcaccagtgaatacagtgatctgggctgccggaaacgctttcttctcatttcgcaattatgtccatacatagtacaattacgttgacaaaattattcttaactaccacaaagtggctttattggtttcaaggaattttggaggaaaataaacctatcctcctttctcgctcactctccaatccagcaactgtactaactgctattttaggaaaaagcagcacaaagtggttcaagttaggaacagatggggcagtttctgtggtagcgagatctcctaactgtgtagcctaagttagagtgccgtagtctaaattcaaacctgttcccattgtggatcccatcctaaggctttaaagtacagactgctctgccagacttaatcatagcttttaaatctaaggtaacacagagatgtaggatcaatcagtatttactggtgacccaggcaatgtacatggcgtgtgttgttctgtgtgacttcctgcccttctcctgtccatgtcctgacttcataattagttaaaatgttttatgggttgtttgcctctctattctaggatgctaagatattctttggttgaatagacagagcagagaaacaagaatcacggagggtttaggggatttggcagctgggggttgtgggaggggcaggtgtaggaacaaaagctaacactagagttggattgtttttgtatgattttcatggtgtgtctgcattttacatgtcctgggttggctctcagattcttcactgtcccaggcattgtatgtgtagtctgcagccttctacgacgtctgtcctaaagctgttgtctttccctctcagctgtatgaggagactgtagaactaatggttaaggagatgcttcctaaagctgttgtctttccctctcagctgtatgaggagactgtagaactaatagttaaggagatgcttcctaaagctgttgtctttccctctcagctgtatgaggagactgtagaactaatagttaaggagatgcttcctggctgctgttactaagggagatcatgtctgcctcacttcaggttcattgtgtcaacttgatggtgtgggacaggtggacattctgctgaccagcaagtgattgcggagggtggaggctgatgacagatgcttctgtctcatgacaaaatgagtaattccatggctatgagtgtgcagggtaaaattgggaccagcagatgttgcttctaagcagcatcttatttctttctcagtgaggagactttatgtgaccatcttctcagagaggccagctgggtggggctgtccgctcaccaccagtgcccattggcttttactgaggcgcttgctgctttctttagaatttattcagatggaccttcacatacgacttcatttcacttagtggtgagatgagatgttcaaaagcagaatccattctcggggttcacttagtggtaaacgtgataatcagatacctttcctccagttcactgctctgtctttagctttctagtatattaaactcttatggtccctattattgccatttcaggattaattactgaaaatcctttttgagttatgaagaaaaaaaattctcattaagaatcttaacacaaaatatagacctatgtaactctaaatagactaactacttttagttttcctttgtaatatatcatgtataattttacttaatctgaagtacctatttaaatattttgtgttttgaggcagggtcttatgtagtccaggctgccctagaactcactacatgactaatgctggacttgaacttatgatcctcacgcctttcgcttctaagtgccgcaattatagacatgtgtcactatgcccatcattatcaaagtacctttaaaatgcctatttttggttaattcataagcttacaaattcttacagttgtgtagcagatgcgagcgattcattttaatcagtattagacaggtttagagatgctctttagattctaagaggaaagggaggtagaaggtaaagctattgtctgtagagcaggggaaagcctagaggtgctattggattcagtccatatcccttggaacgccagagtatgcaagagaagaacgtgaccgttttttacatcttgtggaaactctgccatgacacctctttccctaggtttcccaacacaatcccagatctgattttgattgtctaatcttggtaggctcccatctctgtagcagtcactgtaacttagctagtaccaagcctggatttggtttagtttatagtttggttggtattttttctcatcttcggagcttatggatgggattaactctccttcagattggtagagactagaagaagactgagatagcattaatccaggaagacagaagggatgctgggcaggtttgaagatgcacagcagccaagttacttggtctaatgctccctgcttgcctatgctttgctgcaggtatctgtttcccaagtttacactgtgctggactgagtttgtagacatcaaagtgcatgttccctgtgaaacggttgactacattgaagccaactatggtaagacctggaagattcctatcaagacatgggactggaagagctcacccccgaatgtgcagcccaatggcatctggcctatttcggagtgggatgaggttatccagttgtactgagaaaactaagctcaggtggcacatttcccagaaagaaggcgggtaactgtttaaagcactactgtttttttgcctgatgtgagagccaaagaagagaaatgacaagttagaagacagaaaaggttttctgattcatgggccatctaattagttctgccattcagcatttcctgaggagttgatgcaccaggtggaatacgaggagctggtgaatgagcgaatgccagcctctcttgtcctgttggtaagcactacagttttcttttgaaagaaacttactcaccctctgaagagctggtacacgatatgatgtattccatcataatttttaaaatgttaattaatctttatgctggaaagtgagctcatcggatgaagcttacaaaggatatgttagttaagaataattcactcctgcctgtcctcaggatttttagtgctgcttttaaggttgtagaacatgagttaatattccagtgagtgattagactttgtctcacagagaaaagatggtagcaaactcattttataagcagtgtggtacacagttggcttcaagcacagggggttctataagggaagatgagagcccatatcagctattgtcaagacatacactgttctcatatctgaagtggacagtgggtgcttagatgatgcttgaatgcctgacatcataggatattttccctgacctgcagtggtacttgctgataaatcatccagtcatgctatccgaaaggtgtgacatcccaaagcttactttccttatttcattttcaatcattcttagatttaaaaatggaagttattcatgaatatttttatattttatgaatgtataactcttctgcccttaattttaatattcacactaaatactaatagacatacctctgaatttttaaaaaaatactctttatttatttatcaaccatagctccatgtttaatttatggcctacataataatttatttagcataaagatatgactgttcttctattccaatattacttcaagtttccaaaatggaaggttaacatgaacctggaaactattcctttttccagatcactgtctttaaagcctgtgtccatctctagatttttcattctgctgtgtgtaagagggcaaggacttcctactgccaagtactgcacatgtgggaccccttgattttctttttcttctcaaaatacacccatgagtaggttggggtagctgtgcactctcagtgagagatgacacagtgaatgcctgtcttcctggcctggaaggggaggggctctgctccctgctgcttagggatgtgcttcagggccgccctgcagatctcccttggaatgtgtagtcactaaaacgaacaagagtagctgagggaatgggctggcagaaagtaaaagaaggaaagaaaaagaaaaacttggagccgggtttaatcccagcactcaggaggcagaggcaggcagatttctgagttcaaggccagcctggtctacaaagtgagttccaggacagccagagctatacagagaaaccctttctcgaaaaaacaacaacaacaacaacaaaaaaaaaaaaaaacccaaaaaacccccaaaacaacaacaaaaaaatgaaggaagtaacttaaagccagctacttccaaattttaatttcaacatgaaaactgtctttgttgtatgacaagcagcagtctgttaggatgcagcctctctgtaggaatattgtctctccatatgcatctcatcagattgctgtaattattagcaaacttgtacccaaataacagatcataatcagttctttcctagaaaataagtccatagaatatgtatccaagttttagatagccaaccctatatatttttatgcacctagaaacaaaacaaaacaaaacaaaaatcaaaaacaaaacaaacccagtaacaacaaccagataacagtgtccttgaggacaaagccaccctatctggagagggtcatttgcttgtactcaatatcaaggagtaggcgtgtttacatcacgttccttgagagctcccaccttctgccaggagatcttacccacccctgctccaggttcttctctcacgtctatcattggagggcaaggtctgctagtgtccagaatacaaactctcttggtcctgtgcagaggttctgcagtcttccctccatagacgatgggcaaacttgtcttcaccctggtttagctttagcttttaggttctgccccaccttggagaaagtttcccagaatttgcaggtgaggtttacgtctgaaaatacctccatgattcagtcatactgaagccagtgctcttgaccttggagctctgatgagtggcccaagaccttgggtcgggggtgcccagcacctgactgaccctttgcagatcagttttcttccctccctgagtacgctaactttattctcctaacgcgactactgtctgctgccatttgcctggcttgcttgaagataccttttatattaacttgttctcacgtcaccgaggatagtcccagggagaccctgagaagcagacacgttgtcagtttctgacagccagctacttccctaagcatggacaacttgcctctccttctcttggctacagttaccgaccttggccactgaggtaaaataatagtaactgaaaccgggcatccctaagagtagctgggatcaggtctttgtggagcctccatggcacctcagtgcgtgatgagttttccagcgtctcagtggcgtgtggggacaaaattgctgagcagagatattccttcttctccagaatcctcaggctaccttcttaccttgattgggttgggtgggggagacagtttctgtctgaagacattacctgtggtttctgactcttgaaatgtttaacggattaaatgagatgtataaggtgcttccattcaggaccagggttaagtaagtactcatgagacgtgccgcttcctcattcactgttccttcgtaacttggaagaccgcacaacagagttgcttagaaataaaattggagctgaggctctggtgagatggcttagcaggtgaaagcactgtcaccaagtctgacatgattttgatccccaggacccatatagtggaaggagagaacctcaaattgcctgtcctcaaatacacaggctctgatgtgctcggagctcctctccagcacaagaggacaccaaacacacacacacacacacacatgagtaaataaatataaagaaaagtttttactgtatctaagcattacaggtcaaattatgtgatttatgaattcagagtcattgctacgttacctccccctgaagcagagccggccggttctcatttagttgatcaagttgctgtcttctagtcctaacgcattgcactgtttcctttcaagcccagtcagattactcttaaactgtgtgcctagtctgatatggacttgcctttctgtaatctagctttgggcagcaagcatcactatatataatgatttgcagaaccaaagattttggaatgcttcgttttatttaactacctgctctgtatgaaatgtggcttagtggtacactaattgcccagcatgtgtgaggtctggattcagtacaaagcaccagaagtcagagaccgaaggcttaccacatgcttgggctccctagtgaataccagcctatcctgggctacagtgtaaggccctgtattgagggaggacaaaggaggggagagaaagagagacagagatagaatgagaataaatctgcccacagatttaggtttttatctaagctaggcaaaatagcaggatatataatgctattttaagtagtcagttgtaggcggcagaccaactcggtgtcaatgccttttgtgtaggaccaatcggcaagtatacattccctgagaagtttgttcccacaccttcagaacacctaggctaaaatgctgcttctggacctaacctaagagaatttctctgagggcccatttagtcatccagacttctgtctacttacgagtagctttcgcagaagggcactgtcatataaagtagtctgtcatgcactttacaaattataagcttgtacagccttatgacagtttattctaagcatgaaaactggttcatgagtttattaaatgtagctctgtcagcctgtggcatatgactgtgacacatgtatgtgaatcttctggacaaggttatgttttaaacatgaaatttcagtatatgcttaccagtttaatatttggttttatcttcaggtatagtttatggtactactgaaaatagttttaatattattactctgatctgaatttgtaatatacaatctactttgagatgattaataaaaatttttaatctcttgctcttttgtgtttgtttttgaaagtttaactagaaataaaaagcagttgcattggaaactggtaaaatagtaattgtgccacaaaatatgtatttctaaaattcaagtctggaaaccctggaagtctgtctacacacatacactgagatcaaaacttctcagtgacaaagtctaccacatgacacctctaatcatgcagagtgtggcttgtcagctcaggatagccaggaaaaacaccctctgaggagaagcctgtcatactttagcatcagagatctctagaaaggtcttttatagtagttgagtgtaagcccaactactgtaaaatatatatacctctggaggaagaagtgaaaggtctagtttatgcaaacccaaaagtctgtaaaggaattatgttcatctaaaaatgtcaagaacaggggtggtaagatggctcagcagttaagaacactagctgctcttccagaggtcctgagttaaattctcagcaatgatggtgtcgcgtgaccatttataaagagattagatggctttttctggcatgtaggtgtacatgcagacaaatcactcctacattaaaaaaattaataaatatttttaaatgtcaagaagaaaccaaagaagactatataaatggagggactgtgtcaagcattaggaaacttgaagatgtaaaatttgccaaaattgatgcatagatttggtgtgcaactcctatgataatctcagccatgattttctaaaattcgtatgacagatttacctagagtagctcaagcaatcttcagttctcagcatgcacatggcggctcacaactgtccttaactccagttccaggggatctcacaccctttcctgtttctatgggcaccaggcatatacatggcgcacatatatacatgcaagcaaaagaaacacatttaaaaaaaatcttcaggaaagggagggagacagtcagaggaggggaggcaagagaacaggagcagactaatgtggaactagatgtgagtctcctctcatcctaataggcctgcgatcttatacgggagctagacagtcccctgtgttttacagtgcagttgctctgtagagatatgacagatcttaaacccttgtcttctcatttgaaatccactggttacaattgctgccaattcttattactactggtctgaaaataattttttaaataataacttgaatccaacattttttcaaaatgtatatgcttggtataaaaaccacctggtgctacctctgcaagactgccatgagtttttacaagatggtgaatacagtctttttctggaagtcaagggtcaagtaactccaggtcttaaagatagcatcagaggtgaccttgtgaagttgtccagtgtatcagtgcagccccagctcatatatagcggtcatcagtgctgaccagcagcagctggaatacaagaatgggtgtgatgcccatgcttctcaggggcagggatgaggcaccccagcgcagagccacagcaacctgtcatctcatgtagtacagtgtgagctgtttcattcttattccaccagtaaccataacctctgccctgggacacgggtgccagcagctaccttcttgggactcatgacactcaggccaacaaaaccattgcagtccccagtggctacacagctggccagcccaagtctgcttcaaccatggcctgatcttcaaaaccttatcaagggactctccaagggagggtcaataatctcatgtccctgtgtgggcagaggaacagaagatcttcaggatcttcgtcttcatggctttgatcagggccataagttggtggtgtcttgtgtttggctctgcctccagggccccacatttttgaccccagtcttaactaccatggcctccatgaaaacttcagagtcctctcaagcatgagcctctgtgctccgggacctcctgcatgatccacttgatcttttcttgaacgagaagtgagtccgacttgaaaaaaggtttctatctccagaactaagaaacatgccccttatgttcaaggccatgaagacgaagttcctgaagctcttccgttcctctgcccacacaaggacatgagattattgaccctcccttggagagtcccttgataaggttttgaagatcaggccagggttgaagagacttgggctggccagctttgtagccactggggactgcaaatgttctgttgacctgagtgttgtatgtaaaacccacaccatggtttgcatgcttaaaagctcaccctgagaaaggttcaatgttatactgggatcctgaatacccagtatagtcactggctggctaatacagactttctattggcttaaacccaaagtctgagcagtctcctctggtgaataccccacaacacttacctacctaagtaagtggctcctaccatgcactgatttcttggccagtatctccagatcttctaaaggttggcttaaggggatctgtggcccatgccctaatttcccctcctcctacagggctacgcaccccaacagctttcttcttaccttacggttctggctcacggtggctcctagagctagtcccctagatgtcatccaggcctaggaggagacccctgcttgggcagtctgtgggcttccagaggttgagctgcatggtgacttgtacagagaaagcagggccagctgaggtgttggtggagcatagaagagccaggtacggtaggccagcgctagcagaagaatagcacctctgttaggcatctgggtctaaatgccagagaccactcggcatgctcaggcagagaatctatctcagcatccaggcttcggggggcagatgacctctgctgtttgccgtgggaatcccctgagaaccgaaccaaaggaaggggaaacaatacagctgacaacccctgatcctctcacctctgctctgagagagatgccccatccatctaacccttacccccagcttcttacagtgatgctacagttattctgcccaatattaacttttacatataaaattatatagtaagagagacaaaagaccaaaagaaaaaaattctaaatgtatgcaatacatttatttatattatataattgttaggggcacccttaaaattcagatatttcagtcccaacttaactttcagtatgcaaaatattatgggatgtagaaacagaaccattaaatagccaattaaagtaaaatggaaaatatatgtgtaactactaatccaggggtgattgaatcattgttaagagagagcaggacaagaatgtttcgaaaagagagtgccatgtgtggtcaggaagaggtgtccatctactgccaacaccttaatatggatttctagctccataactaagaaaaagtccactatctacacaagaagtgtggaactttattaaggccctcacaatctaatgctgtagtggagaccatagtgttaacaaagaatggacactgatgagcaaagtaaagcaaaacaagccacacaaatatactatagatggtttatgggaagaggatagctttgcttcttcagcagacggaaacccagcaacaattagtgtagctgctaaatggttattctgataaatgtaatttaagacaactatagtgtgtgtgtgtgtgtgtgtgtgcacatgtgcatgcctgtcagtctgtggctgtgtacactaatgctagggagtatgtatgaggtcctgagcccaatctccagcaatgacagaaaataaaaattaaaaacccaaaacctttaaaaggttattatacaggctggagagatgtctcagcggttaagagcactgactgctcttccagaggtcctgagttcaatttccagctaccacatgatggctcacatccatctgtgatgggattcgatgccctcttctggtgtgtctgaagacggctacagtgtactcatgtacatgaaataaatctttgaggaaaagaaaggttctcatccatccatgtaaatcagtgatgaaagaaaagcaaaataaggcctgaagcactagctcagtgggtgcagagactgtgctttaaggattagaacttgagcttgaatgcacgtaccagcagacagccagggaaaggctagccctgggagttgggagcagaggcaggtggacttggtgggctgcacagcccagtcggtcagctctgggttcagtaagagatgttgcctttaaaaataaggtgaagagcaatagaggaagacactcaatgtcagtttctggcccctgtgcatgctgcttgtgctagtgtctcccctcccccaacgcacacacacacacacacacacacacacacacacacacacacacacacaaaactaaaaacctgcctcctaaaaatggagataagattatttctttagattttatcctgaagagtattaaatactatgagtttgtaaaaacaacatatatagtaggaattcaaaaagagaagcatagtagcgtggagagatcttcagcaattaagagcatttgttgctcttgtagaggacccaggttcaattcccagcacccacaaccatctattgctgagatcctagagttccaagtgatgtttagccagggaagcactgaacccaagatggctcagataaggtcactcctggcactagcctaccagtgccagcctcaaacagggctccaacatcaaaattactcatgggcagggtgagcagggaggcatcggttagtagtggtcttgctcagtagcacagaggacgtacgacaggacaaggcaaggcaaggccttgcacaggcttttgaaaactactttagaagtcagttgaatagaggtaagaaagctgctagtaggattttctgggttgtgggaaggacatgaaggcagtttttgaaatctaagaatcaagttgatgaggaagccctgtactccatgcagggcctgtgcttcactgtgcaggcaatgtgaagaagagacaagagacatgtctgcacctgctgcaaactggagatcagggaaggatggacttcacattcagagatggctctgtaaagatgctcaattctgggtctcaagttgcattctcagctcctgaaaccccaggctcagaagggtcacacattcctggagttgtgagggtggctgagatgagccactgaccttccgtcttctgttctatttgcccctctacacaaatgtttgggccttaaacaatcaggtgggataagtccatcatgttttcattcgtgccatttccaccgagccagagagtccgctgcctcagccagagaaagctcaaattcttactacaagtgaatggtgctgggccagccttgaatccctacaatggggcagtgggcagtgggtgggagctgaaccaggctcagggcagacggctgccattagggtggggtcttcaaaatgggtctgagacagcagctgtaacatttgtttcagatcgtttgcaaagacttcaaatcctcactggttaaaaagacagatacagtcttgagtggagaagtcagcactgatagctgtcactaaaggcagaggtgagaaccctgctgggaaagctagcttttctttgttgatctattttctttgtaggtcttccttgatcggatttaaagtgacatctcctagtttttctaagaagcttcctggaaccctctgctggatttgggggataaggaggccaggctttcatgtcctggtgtgtgtgtttgctttgggatttgtcagtgcctggggctctgagcagcttgagcctggcagagttcccccacctgcctaaaatacagcccagggggaacaggggcccctctcagcccaacccagcacctccactctttgctcctggaactgtggcctttattttaagtctggtcccctggggatggtgtggggaatgaagacagctgataagcctggcactattgactttatggggaatattcaatgtatttactttctacaagtaagctaccctcttatctgctgcccacagagcatctaaatcctgtccagggagccagtctatgagtcgtgttcttatacaaagaccagagaataaataggggaaaacagtcccacccacccctttctgccccggtacct

SEQ ID NO: 1328 - DNA, 1652 bp, Mus musculus
gaagtatctctggtcacaggaaacaagattctgtttcatgaagaagatgaaaacaactgggctactgttaaaaaccacccaagagaacaccatagaccaatgagtagaatcaataagaacgtggtcttggcccttttaacattgacgagttctgcctttctgctgtttcagctgtactactacaagcactatttgtctgcaaggcgtgcagttaagaaatttattatgctgacatccagccaaaatgtgccagtgttccttattgacccatggattctggaatcaattaataaaaacttcgaacaagtgaaaaatgcttctcaaggcccggcttcagaatgcagatttttctgtgttccgagagacttcactgcgttcgcactgcagtatcacctgtggaagaatgaggatggctggtttcggatagctgagaatatggggtttcaatgcctaaagactgaaagcaaggatcctcggctagatggaatagactcactttctgggactgaaatccctctgcactacgtctgtaagctgaccactcatgccatccacttggtagtctttcatgagaggagtggcaactacctctggcatggtcacctacgactcaaaggacacatggataggaagtttgttccttttcgaaagttacagtttggtcgttatcctggagcctttgacaggccagagttacagcaagttactgttgatggactagatatgcttattccgaaagacccagggcgctttctagaagaagtacctcactccagatttatcgagtgcaggtataaggaagctcgggcgttcctccagcagtacattgatgataatactgtggatgctatggtctttcgaaagagggcaaaggagttactgcaactagcagccaagacgctgaaggacctgggagtgcccttctggctgagcagtgggacttgtctaggatggtatcggcagtgcggtattattccttacagcaaagatgtcgacttagggatttttatacaagattacaaacctgatattattttggcatttcaggaagcaggacttccactcaaacacaagtttgggaaggtggaagacagcttggaactatccttccaggggaaaaatgatgtaaaacttgatatttttttcttctatgaagaggctgaccatctgtggaatggaggcacgcaggccagaacgggaaaaaagtttaagtatctgtttcccaagtttacactgtgctggactgagtttgtagacatcaaagtgcatgttccctgtgaaacggttgactacattgaagccaactatgcatttcctgaggagttgatgcaccaggtggaatacgaggagctggtgaatgagcgaatgccagcctctcttgtcctgttggtaagcactacagttttcttttgaaagaaacttactcaccctctgaagagctggtacacgatatgatgtattccatcataatttttaaaatgttaattaatctttatgctggaaagtgagctcatcggatgaagcttacaaaggatatgttagttaagaataattcactcctgcctgtcctcaggatttttagtgctgcttttaaggttgtagaacatgagttaatattccagtgagtgattagactttgtctcacagagaaa

SEQ ID NO: 1329 - protein, 470 aa, Mus musculus
EVSLVTGNKILFHEEDENNWATVKNHPREHHRPMSRINKNVVLALLTLTSSAFLLFQLYYYKHYLSARRAVKKFIMLTSSQNVPVFLIDPWILESINKNFEQVKNASQGPASECRFFCVPRDFTAFALQYHLWKNEDGWFRIAENMGFQCLKTESKDPRLDGIDSLSGTEIPLHYVCKLTTHAIHLVVFHERSGNYLWHGHLRLKGHMDRKFVPFRKLQFGRYPGAFDRPELQQVTVDGLDMLIPKDPGRFLEEVPHSRFIECRYKEARAFLQQYIDDNTVDAMVFRKRAKELLQLAAKTLKDLGVPFWLSSGTCLGWYRQCGIIPYSKDVDLGIFIQDYKPDIILAFQEAGLPLKHKFGKVEDSLELSFQGKNDVKLDIFFFYEEADHLWNGGTQARTGKKFKYLFPKFTLCWTEFVDIKVHVPCETVDYIEANYAFPEELMHQVEYEELVNERMPASLVLLVSTTVFF
